United States Patent
Hirt et al.

(10) Patent No.: US 11,118,159 B2
(45) Date of Patent: Sep. 14, 2021

(54) COMPOSITIONS AND METHODS FOR PROVIDING PLANTS WITH TOLERANCE TO ABIOTIC STRESS CONDITIONS

(71) Applicant: King Abdullah University of Science and Technology, Thuwal (SA)

(72) Inventors: Heribert Hirt, Thuwal (SA); Axel de Zelicourt, Thuwal (SA); Maged Saad, Thuwal (SA)

(73) Assignee: King Abdullah University of Science and Technology, Thuwal (SA)

( * ) Notice: Subject to any disclaimer, the term of this patent is extended or adjusted under 35 U.S.C. 154(b) by 94 days.

(21) Appl. No.: 16/072,137

(22) PCT Filed: Jan. 20, 2017

(86) PCT No.: PCT/IB2017/050314
§ 371 (c)(1),
(2) Date: Jul. 23, 2018

(87) PCT Pub. No.: WO2017/125894
PCT Pub. Date: Jul. 27, 2017

(65) Prior Publication Data
US 2019/0021342 A1   Jan. 24, 2019

Related U.S. Application Data

(60) Provisional application No. 62/281,404, filed on Jan. 21, 2016.

(51) Int. Cl.
| | | |
|---|---|---|
| *A01N 63/20* | (2020.01) | |
| *C12N 1/20* | (2006.01) | |
| *A01H 5/10* | (2018.01) | |
| *C12R 1/01* | (2006.01) | |
| *C12R 1/05* | (2006.01) | |
| *C12R 1/12* | (2006.01) | |

(52) U.S. Cl.
CPC ............... *C12N 1/205* (2021.05); *A01H 5/10* (2013.01); *A01N 63/20* (2020.01); *C12N 1/20* (2013.01); *C12R 2001/01* (2021.05); *C12R 2001/05* (2021.05); *C12R 2001/12* (2021.05)

(58) Field of Classification Search
CPC combination set(s) only.
See application file for complete search history.

(56) References Cited

U.S. PATENT DOCUMENTS

2015/0373993 A1   12/2015  Maltzahn

FOREIGN PATENT DOCUMENTS

| CA | 2953466 | 12/2015 |
| JP | 51446766 | 11/1979 |
| JP | 5702081 | 4/1982 |
| WO | 2015/091967 | 6/2015 |
| WO | 2017/125894 | 7/2017 |

OTHER PUBLICATIONS

Hayat, R. et al., Ann. Microbiol. 2010 vol. 60, pp. 579-598.*
Andres-Barrao, et al., "Complete Genome Sequence Analysis of *Enterobacter* sp. SA187, a Plant Multi-Stress Tolerance Promoting Endophytic Bacterium", *Front Microbiol*, 8:1-21 (2017).
Bolger, et al., "Trimmomatic: a flexible trimmer for Illumina sequence data", *Bioinformatics*, 30:2114-2120 (2014).
Chaves, et al., "How plants cope with water stress in the field. Photosynthesis and growth", *Ann Bot*, 89:907-916 (2002).
Chen, et al. "Application of Plant growth-promoting endophytes (PGPE) isolated from *Solanum nugrum* L. for phytoextraction of Cd-polluted soils", *Apl. Soil Ecol.*, 46(3):383-389 (2010).
Coleman-Derr, et al., "Building the crops of tomorrow: advantages of symbiont-based approaches to improving abiotic stress tolerance", *Front Microbiol.*, 5:283 (2014).
De Zelicourt, "Rhizosphere microbes as essential partners for plant stress tolerance", et al., *Mol Plant*, 6:242-245 (2013)).
Deinlein, et al., "Plant salt-tolerance mechanisms", *Trends Plant Sci*, 19:371-379 (2014).
Eckert, et al., "Ethylene-forming enzyme and bioethylene production", *Biotechnol Biofuels*, 7:33 (2014).
Gao, et al., "Symbiotic adaptation drives genome streamlining of the cyanobacterial sponge symbiont Candidatus Synechococcus spongiarum", *MBio*, 5(2)e0079-14, (2014).
Glick, et al., "Plant Growth-Promoting Bacteria: Mechanisms and Applications", *Scientifica*, 2012:1-15 (2012).
Guzmán, et al., "Exploiting the triple response of *Arabidopsis* to identify ethylene-related mutants", *Plant Cell*, 2:513-523 (1990).
Han, et al., "Beneficial soil bacterium Bacillus subtilis (GB03) augments salt tolerance of white clover", *Front Plant Sci*, 5:525 (2014).
Hanin et al., "New Insights on Plant Salt Tolerance Mechanisms and Their Potential Use for Breeding", *Front Plant Sci.*, 7:1-17 (2016).
Hossain, et al., "One-step biosynthesis of $\alpha$-keto-$\gamma$-methylthiobutyric acid from L-methionine by an *Escherichia coli* whole-cell biocatalyst expressing an engineered L-amino acid deaminase from Proteus vulgaris", *PLOS One*, 9(12):e114291 (2014).
Kaplan, et al., "A survey of the microbial community in the rhizosphere of two dominant shrubs of the Negev Desert highlands, Zygophyllum dumosum (Zygophyllaceae) and Atriplex halimus (Amaranthaceae), using cultivation-dependent and cultivation-independent methods", *Am J Bot*, 100:1713-1725 (2013).

(Continued)

*Primary Examiner* — Heidi Reese
(74) *Attorney, Agent, or Firm* — Pabst Patent Group LLP

(57) ABSTRACT

It has been discovered that the desert endophytic bacterium SA187 SA187 can provide resistance or tolerance to abiotic stress conditions to seeds or plants. Compositions containing SA187 can be used to enhance plant development and yield under environmental stress conditions.

11 Claims, 14 Drawing Sheets

Specification includes a Sequence Listing.

(56) References Cited

OTHER PUBLICATIONS

Karlidag, et al., "Plant Growth-promoting Rhizobacteria Mitigate Deleterious Effects of Salt Stress on Strawberry Plants (*Fragaria xananassa*)", *Hortic Sci*, 48:563-567 (2013).

Konishi and Yanagisawa, ",Ethylene signaling in Arabidopsis involves feedback regulation via the elaborate control of EBF2 expression by EIN3", *Plant J*, 55:821-831 (2008).

Lafi, et al., "Draft Genome Sequence of the Plant Growth-Promoting Rhizobacterium Acinetobacter radioresistens Strain SA188 Isolated from the Desert Plant *Indigofera argentea*", *Genome Announc*, 9-10 (2017).

Marasco, et al., "A drought resistance-promoting microbiome is selected by root system under desert farming", *PLoS One*, 7:e48479 (2012).

Nadeem, et al., "Variation in growth and ion uptake of maize due to inoculation with plant growth promoting rhizobacteria under salt stress", *Microbiology*, 25:78-84 (2006).

Negrao et al., "Evaluating physiological responses of plants to salinity stress", Ann Bot, 119:1-11 (2017).

Park et al., "Abscisic acid inhibits type 2C protein phosphatases via the PYR/PYL family of START proteins", Science, 324:1068-1071 (2009).

Rifat, et al., "Soil beneficial bacteria and their role in plant growth promotion: a review", *Annals of Microbiol.*, 60(4):579-598 (2010).

Roman, et al., "Genetic analysis of ethylene signal transduction in *Arabidopsis thaliana*: five novel mutant loci integrated into a stress response pathway", *Genetics*, 139:1391-1409 (1995).

Schwartz, et al., "Biochemical characterization of the aba2 and aba3 mutants in *Arabidopsis thaliana*", *Plant Physiol*, 114 :161-166 (1997).

Shabala, et al., "Learning from halophytes: physiological basis and strategies to improve abiotic stress tolerance in crops", *Ann Bot*, 112:1209-1221 (2013).

Singh and Jha, "Boosting Alfalfa (*Medicago sativa* L.) Production With Rhizobacteria From Various Plants in Saudi Arabia", *Acta Physiol Plant*, 38:110 (2016).

Staswick, et al., "Methyl jasmonate inhibition of root growth and induction of a leaf protein are decreased in an *Arabidopsis thaliana* mutant", *Proc Natl Acad Sci USA*, 89 :6837-6840 (1992).

Sun, et al., "Potassium Retention under Salt Stress Is Associated with Natural Variation in Salinity Tolerance among *Arabidopsis* Accessions", *PLoS One*, 10:e0124032 (2015).

Trapnell, et al., "Transcript assembly and quantification by RNA-Seq reveals unannotated transcripts and isoform switching during cell differentiation", *Nat Biotechnol*, 28:511-515 (2010).

Zhang, et al., "Soil bacteria confer plant salt tolerance by tissue-specific regulation of the sodium transporter HKT1", *Mol Plant-Microbe Interact*, 21:737-744 (2008).

Arshad, et al., "Kinetics and effects of trace elements and electron complexes on 2-keto-4-methylthiobutyric acid-dependent biosynthesis of ethylene in soil", Letters in Applied Microbiology, 39(3):306-309 (2004).

Martensson, "The occurrence of 4-methylthio-2-hydroxybutyrate in human urine", Analytical Biochemistry, 154(1):43-49 (1986).

Sunaina, et al., "Bacterial Metabolites from Bacillus Cereus B4 Responsible for Potato Plant Growth", Potato J., 32(3-4):167-188 (2005).

* cited by examiner

Figure 1. Yield losses of eight representative crops due to environmental stress. Average yields and losses caused by abiotic and biotic stresses are illustrated as a percentage of the record yield obtained for each of the crops: maize, wheat, soybean, sorghum, oat, barley, potato and sugar beet. Data taken from Buchanan et al. (2000).

COMPOSITIONS AND METHODS FOR PROVIDING PLANTS WITH TOLERANCE TO ABIOTIC STRESS CONDITIONS

CROSS-REFERENCE TO RELATED APPLICATIONS

This application is a National Phase application under 35 U.S.C. § 371 of International Application No. PCT/IB2017/050314, filed on Jan. 20, 2017, entitled "COMPOSITIONS AND METHODS FOR PROVIDING PLANTS WITH TOLERANCE TO ABIOTIC STRESS CONDITIONS", which claims benefit of and priority to U.S. Provisional Patent Application No. 62/281,404 filed on Jan. 21, 2016, and are incorporated herein in its their entirety.

FIELD OF THE INVENTION

The invention is generally directed to bacterial compositions and methods of use to increase abiotic stress tolerance or resistance in plants.

REFERENCE TO SEQUENCE LISTING

The Sequence Listing submitted Jan. 20, 2017, as a text file named "KAUST_ST25.txt" created on Jan. 20, 2017, and having a size of 5.4 KB is hereby incorporated by reference pursuant to 37 C.F.R. § 1.52(e)(5).

BACKGROUND OF THE INVENTION

The United Nations predicts that the world population will reach 8.5 billion by 2030 (UN News Centre, 2015). A key challenge for feeding the world population is the global water shortage which limits crop yields in more than 70% of arable lands (Timmusk, S. et al., PLOS One, 9(5) 1-13 (2014)). Abiotic stresses, such as drought, heat and salt, are the most important limiting factors in agriculture not only in Saudi Arabia but worldwide. These environmental stresses are the cause of more than 50% of crop losses globally (FIG. 1). Therefore, major efforts are underway on improving plant stress tolerance by molecular breeding and genetic manipulation (GM) techniques. However, these processes are long term investments of high costs and require extensive registration procedures before marketing of the products is possible.

An alternative approach to improve plant stress tolerance has been largely overlooked in the past decades is to make use of rhizosphere microbes which offer a cheap GM-free alternative.

Therefore, it is an object of the invention to provide compositions and methods for providing plants with resistance or tolerance to abiotic stress conditions.

It is another object of the invention to provide seed coating compositions that provide plants with resistance or tolerance to abiotic stress conditions.

It is still another object to provide methods for growing plants under abiotic stress conditions.

SUMMARY OF THE INVENTION

It has been discovered that *Enterobacter* sp. SA187 (hereafter named SA187) can provide resistance or tolerance to abiotic stress conditions to seeds or plants. Compositions containing SA187 can be used to enhance plant development and yield under environmental stress conditions. One embodiment provides an isolated culture of SA187. In another embodiment, the SA187 is genetically modified to express one or more heterologous genes or proteins.

The desert endophytic bacterium SA187 confers abiotic stress tolerance and enhances yield and biomass production of model and crop plants, respectively, using a 2-keto-4-methylbutyric acid (KMBA) dependent ethylene signaling activation. SA187 was found to colonize both surface and inner plant root and shoot tissues and to modify several plant phytohormone pathways. Transcriptome and genetic studies showed that the ethylene signaling pathway was the major contributor for mediating abiotic stress tolerance by SA187. Interestingly, neither plants nor SA187 produce ethylene directly, but upon colonization, plants induce expression of the methionine salvage pathway in SA187 to produce KMBA that is subsequently converted to ethylene in planta. These results reveal a complex molecular communication process during beneficial plant-microbe interactions and prove the potential of beneficial microbes for strengthening agriculture under adverse environmental conditions.

One embodiment provides a plant substrate containing an effective amount of *Enterobacter* sp. SA187 to inhibit or reduce abiotic stress in the plant. In a preferred embodiment suitable plant substrates include, but are not limited to soil, peat, compost, vermiculite, perlite, sand, clay and combinations thereof.

Still another embodiment provides a non-desert plant inoculated with an amount of SA187 to provide abiotic stress tolerance, enhance yield, enhance biomass, or a combination thereof. Preferred non-desert plants include, but are not limited to crop plants that are not indigenous to desert environment.

The disclosed compositions and methods can provide tolerance or resistance to abiotic stress conditions including, but not limited to drought, high heat, high salt, bright light, ultraviolet light, too high and too low temperatures, freezing, heavy metals and hypoxia.

Still another embodiment provides a plant substrate inoculated with SA187 and one or more additional plant growth-promoting bacteria and/or one or more plant growth-promoting rhizobacteria. Exemplary additional plant growth-promoting bacteria or rhizobacteria include but are not limited to *Pseudomonas putida, Pseudomonas aeruginosa, Klebsiella* sp., *Enterobacter asburiae, Rhizobium* sp. (pea), *Mesorhizobium* sp., *Acinetobacter* spp., *Rhizobium* sp. (lentil), *Pseudomonas* sp. A3R3, *Psychrobacter* sp. SRS8, *Bradyrhizobium* sp., *Pseudomonas aeruginosa* 4EA, *Pseudomonas* sp., *Ochrobactrum cytisi, Bacillus* species PSB10, *Paenibacillus polymyxa, Rhizobium phaseoli, Rahnella aquatilis, Pseudomonas fluorescens, Ralstonia metallidurans, Azospirillum amazonense, Serratia marcescens, Enterobacter* sp., *Burkholderia, Pseudomonas jessenii, Azotobacter* sp., *Mesorhizobium ciceri, Azotobacter chroococcum, Klebsiella oxytoca, Pseudomonas chlororaphis, Bacillus subtilis, Gluconacetobacter, diazotrophicus, Brevibacillus* spp., *Bravibacterium* sp., *Xanthomonas* sp. RJ3, *Azomonas* sp. RJ4, *Pseudomonas* sp. RJ10, *Bacillus* sp. RJ31, *Bradyrhizobium japonicum, Variovorax paradoxus, Rhodococcus* sp., *Flavobacterium, Sphingomonas* sp, *Mycobacterium* sp, *Rhodococcus* sp, *Cellulomonas* sp., *Azospirillum* sp., *Azospirillum brasilense, Rhizobium meliloti, Kluyvera ascorbata, Rhizobium cicero, Rhizobium leguminosarum, Paenibacillus polymyxa* strain A26, a *Alcaligenes faecalis* strain AF, and combinations thereof.

Yet another embodiment provides a plant seed coated with an effective amount of SA187 to provide the seed with resistance to abiotic stress conditions as the seed grows. The coating can contain one or more additional plant growth-promoting bacteria or rhizobacteria.

Another embodiment provides a plant root coated with SA187 optionally including one more additional plant growth-promoting bacteria or rhizobacteria.

Still another embodiment provides a method of providing a seed or plant with resistance to abiotic stress conditions by coating the seed or a root of the plant with an effective amount of SA187 to provide the seed or plant with resistance to the abiotic stress conditions.

Yet another embodiment provides a method of improving growth of a seed or plant under abiotic stress conditions by growing the seed or plant in a plant substrate, wherein the plant substrate comprises an effective amount of SA187 to colonize the seed or a root of the plant to provide abiotic stress resistance to the seed or plant.

Another embodiment provides a method of improving tolerance of a seed or plant to abiotic stress conditions by coating the seed or root of the plant with an effective amount of SA187 to provide the plant with resistance to abiotic stress.

Still another embodiment provides a method of improving tolerance of a seed or plant against abiotic stress conditions by growing the seed or plant in a plant substrate comprising an effective amount of SA187 to provide the seed or plant with tolerance to the abiotic stress conditions.

Yet another embodiment provides a method of providing a plant with abiotic stress resistance by inoculating the plant's rhizosphere with SA187.

Another embodiment provides a seed coating composition containing SA187. The SA187 can be encapsulated with a non-toxic, biodegradable coating. The seed coating composition can also contain a coating adhesive. Exemplary seed coating compositions contain gelatin, cellulose, alginate, xanthum, or a combination thereof. Certain seed coating compositions can have multiple layers.

One embodiment provides SA187 whose genome contains SEQ ID NO:1, 2, 3, 4, 5, 6, 7, 8, 9, 10, 11, 12, 13, or a combination thereof. In still another embodiment provides SA187 whose genome contains all of SEQ ID NO:1-13.

BRIEF DESCRIPTION OF THE DRAWINGS

FIG. 8D is a graph of phenotype and FIG. 8F is a bar graph of heat survival rate of one-week-old SA187-colonized or mock-treated *Arabidopsis* seedlings exposed to heat stress. FIGS. 8H and 8KI are graphs showing growth parameters of SA187-colonized 25-day-old field-grown alfalfa plants using 2 water regimes, normal and high salinity. Percentages indicate improvement of SA187-colonized plants compared to mock-treated plants. Asterisks indicate statistical difference based on the Mann-Whitney test between mock- and SA187-treated plants under the same conditions (P<0.01, *P<0.001).

DETAILED DESCRIPTION OF THE INVENTION

I. Definitions

Figure 1:
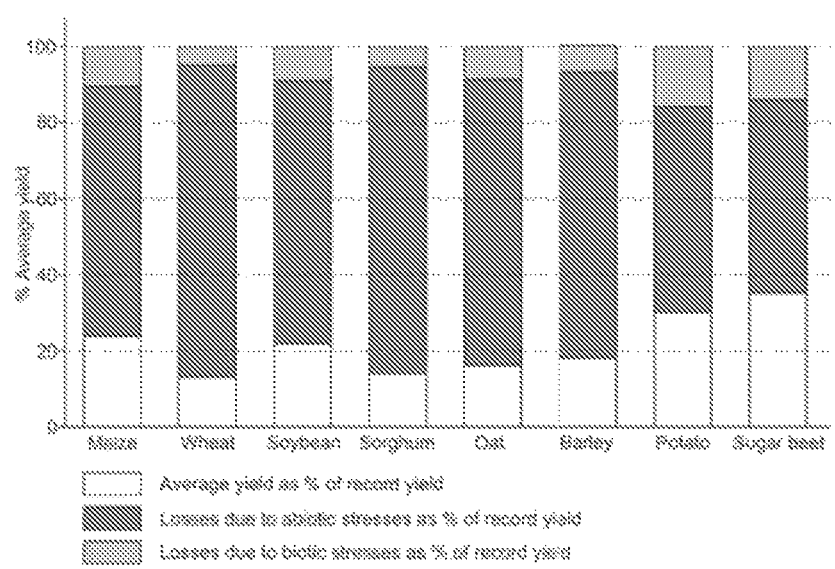
FIG. 1 is bar graph of various crops showing the percent average yield for average yield as % of record (open box), losses due to abiotic stresses as a % of record yield (solid black box), and losses due to biotic stresses as % of record (solid grey box). Data taken from Buchanan et al., Am Soc Plant Physiol. 1367 (2000).

The use of the terms "a," "an," "the," and similar referents in the context of describing the presently claimed invention (especially in the context of the claims) are to be construed to cover both the singular and the plural, unless otherwise indicated herein or clearly contradicted by context.

Recitation of ranges of values herein are merely intended to serve as a shorthand method of referring individually to each separate value falling within the range, unless otherwise indicated herein, and each separate value is incorporated into the specification as if it were individually recited herein. Use of the term "about" is intended to describe values either above or below the stated value in a range of approx. +/−10%; in other embodiments the values may range in value either above or below the stated value in a range of approx. +/−5%; in other embodiments the values may range in value either above or below the stated value in a range of approx. +/−2%; in other embodiments the values may range in value either above or below the stated value in a range of approx. +/−1%. The preceding ranges are intended to be made clear by context, and no further limitation is implied. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

The term "plant substrate" refers to a substrate commonly used for growing plants, including plant seeds, plant roots and plant seedlings. Non-limiting examples of such plant substrates include, but are not limited to soil, peat, compost, vermiculite, perlite, sand, clay, and combinations thereof.

"Plant growth-promoting rhizobacteria (PGPR)" refers soil bacteria that colonize the roots of plants following inoculation onto seed and that enhance plant growth (Kloepper, Joseph W.; Schroth, Milton N., Proceedings of the 4th International Conference on Plant Pathogenic Bacteria (Angers, France: Station de Pathologie Végétale et Phytobactériologie, INRA) 2: 879-882 (1978); Aziz, Z. F. A., et al., Malaysian Journal of Microbiology 8(1): 47-50 (2012)).

"Abiotic stress conditions" refer to conditions caused by non-living factors on the living organisms in a specific environment. Exemplary abiotic stress conditions include, but are not limited to drought, high heat, high salt, bright light, ultraviolet light, too high and too low temperatures, freezing, heavy metals and hypoxia. High salt concentrations typically refers to 100-300 mM salt (such as NaCl) or higher. Saline soil has an excess of soluble salt in the soil solution, the liquid located between aggregates of soil. A sodic soil has too much sodium associated with the negatively charged clay particles. Salinity occurs through natural or human-induced processes that result in the accumulation of dissolved salts in the soil water to an extent that inhibits plant growth. Natural salinity results from the accumulation of salts over long periods of time and is caused by two natural processes. The first is the weathering process that breaks down rock and release soluble salts of various type, mainly chloride of sodium, calcium and magnesium, and to a lesser extent, sulphates and carbonates. Sodium chloride is the most soluble salt. The second is the deposition of oceanic salt carried in wind and rain. Human-induced salinity results from human activity that change the hydrologic balance of the soil between water applied (irrigation or rainfall) and water used by crops (transpiration). The most common causes are (i) land clearing and the replacement of perennial vegetation with annual crops, and (ii) irrigation schemes using salt-rich irrigation water or having insufficient drainage (Roberto (2011). Soil Bacteria Support and Protect Plants Against Abiotic Stresses, Abiotic Stress in Plants—Mechanisms and Adaptations, Prof. Arun Shanker (Ed.), ISBN: 978-953-307-394-1, InTech, DOI: 10.5772/23310). With regard to heat, a transient elevation in temperature, usually 10-15° C. above ambient, is considered stress, but heat stress also depends on temperature intensity, duration of treatment and rate of temperature increase.

II. Compositions for Promoting Abiotic Stress Resistance

Compositions containing SA187 are provided that can be used to provide seeds and plants with resistance or tolerance to abiotic stress conditions. *Enterobacter* sp. SA187 is an endophytic bacteria isolated from surface sterilized root nodules formed on roots of pioneer plant *Indigofera argentea* Burm.f. (Fabaceae). SA187 was deposited on Sep. 24, 2019, with American Type Culture Collection (ATCC), P.O. Box 1549, Manassas, Va. 20110 USA, and given Patent Deposit Number PTA-126210. Preferred seeds and plants, preferably roots that can be inoculated with or coated with SA187 include, but are not limited to alfalfa, cotton, wheat, maize, soybean, oat, barley, potato, and sugar beets.

One embodiment provides seeds or plants inoculated with an effective amount of SA187 to provide the seed or plant with resistance or tolerance to abiotic stress conditions. The seeds or plants can be coated with SA187. One embodiment provides a root of a plant coated with SA187.

A. SA187 Containing Plant Substrates

Rhizosphere microorganisms, particularly beneficial bacteria and fungi, can improve plant performance under stress environments and, consequently, enhance yield both directly and indirectly (C. Dimkpa, et al, Plant, Cell and Environment, 32 1682-1694 (2009)). Some plant growth-promoting rhizobacteria (PGPR) may exert a direct stimulation on plant growth and development by providing plants with fixed nitrogen, phytohormones, iron that has been sequestered by bacterial siderophores, and soluble phosphate (R. Hayat, et al., Annals of Microbiology, 60 579-598 (2010)). Others do this indirectly by protecting the plant against soil-borne diseases, most of which are caused by pathogenic fungi (B. Lutgtenberg and F. Kamilova, Annual Review of Microbiology, 63 541 556 (2009)).

Bacteria of diverse genera such as *Arthrobacter, Azotobacter, Azospirillum, Bacillus, Enterobacter, Pseudomonas* and *Serratia* (E. J. Gray and D. L. Smith, Soil Biology & Biochemistry, 37 395 412 (2005)), as well as *Streptomyces* spp. (Dimkpa, C. et al., Canadian Journal of Microbiology, 54:163 172 (2008)) have been identified as PGPR and can be combined with SA187 in the disclosed compositions.

One embodiment provides a plant substrate containing an effective amount of a species of the genus *Enterobacter* to inhibit or reduce abiotic stress in the plant. In a preferred embodiment, the *Enterobacter* species is SA187. Suitable plant substrates include, but are not limited to soil, peat, compost, vermiculite, perlite, sand, clay and combinations thereof. Typically, the plant substrates contain $10^6$ to $10^9$ bacteria per/g of substrate.

B. Co-Inoculation

Plants and seeds can be co-inoculated with SA187 and one or more other plant growth-promoting bacteria or rhizobacteria to provide the seeds or plants with resistance or tolerance to abiotic stress conditions. Co-inoculation is based on mixed inoculants, combination of microorganisms that interact synergistically, or when microorganisms such as *Azospirillum* are functioning as "helper" bacteria to enhance the performance of other beneficial microorganisms. In the rhizosphere the synergism between various bacterial genera such as *Bacillus, Pseudomonas* and *Rhizobium* has been demonstrated to promote plant growth and development. Compared to single inoculation, co-inoculation can improve the absorption of nitrogen, phosphorus and mineral nutrients by plants.

Suitable bacteria that can be co-inoculated with SA187 include but are not limited to *Pseudomonas putida, Pseudomonas aeruginosa, Klebsiella* sp., *Enterobacter asburiae, Rhizobium* sp. (pea), *Mesorhizobium* sp., *Acinetobacter* spp., *Rhizobium* sp. (lentil), *Pseudomonas* sp. A3R3, *Psychrobacter* sp. SRS8, *Bradyrhizobium* sp., *Pseudomonas aeruginosa* 4EA, *Pseudomonas* sp., *Ochrobactrum cytisi, Bacillus* species PSB10, *Paenibacillus polymyxa, Rhizobium phaseoli, Rahnella aquatilis, Pseudomonas fluorescens, Ralstonia metallidurans, Azospirillum amazonense, Serratia marcescens, Enterobacter* sp., *Burkholderia, Pseudomonas jessenii, Azotobacter* sp., *Mesorhizobium ciceri, Azotobacter chroococcum, Klebsiella oxytoca, Pseudomonas chlororaphis, Bacillus subtilis, Gluconacetobacter, diazotrophicus, Brevibacillus* spp., *Bravibacterium* sp., *Xanthomonas* sp. RJ3, *Azomonas* sp. RJ4, *Pseudomonas* sp. RJ10, *Bacillus* sp. RJ31, *Bradyrhizobium japonicum, Variovorax paradoxus, Rhodococcus* sp., *Flavobacterium, Sphingomonas* sp, *Mycobacterium* sp, *Rhodococcus* sp, *Cellulomonas* sp., *Azospirillum* sp., *Azospirillum brasilense, Rhizobium meliloti, Kluyvera ascorbata, Rhizobium cicero, Rhizobium leguminosarum, Paenibacillus polymyxa* strain A26, a *Alcaligenes faecalis* strain AF, and combinations thereof.

Additional bacteria that can be inoculated with SA187 and exemplary plants that can be inoculated include those listed in Table 1.

TABLE 1

Bacterial Inoculates for Abiotic Stress (From Bianco Carmen and Defez Roberto (2011). Soil Bacteria Support and Protect Plants Against Abiotic Stresses, Abiotic Stress in Plants - Mechanisms and Adaptations, Prof. Arun Shanker (Ed.), ISBN: 978-953-307-394-1, InTech, DOI: 10.5772/23310)

| Stress type | Bacterial inoculate | Plant Species |
| --- | --- | --- |
| Salt | *Pseudomonas pseudoalcaligenes, Bacillus pumilus* | Rice (*Oryza sativa*) |
| Salt | *Bacillus megaterium* | Maize (*Zea maize* L.) |
| Salt | *Azospirillum brasilense* | Barley (*Hordeum vulgare*) |
| Salt | *Pseudomonas mendocina* | Lettuce (*L. sativa* L. cv. *Tafalla*) |
| Salt | *Azospirillum* sp. | Pea (*Phaseolus vulgaris*) |
| Salt | *Bacillus subtilis* | *Arabidopsis thaliana* |

TABLE 1-continued

Bacterial Inoculates for Abiotic Stress (From Bianco Carmen and Defez Roberto (2011). Soil Bacteria Support and Protect Plants Against Abiotic Stresses, Abiotic Stress in Plants - Mechanisms and Adaptations, Prof. Arun Shanker (Ed.), ISBN: 978-953-307-394-1, InTech, DOI: 10.5772/23310)

| Stress type | Bacterial inoculate | Plant Species |
| --- | --- | --- |
| Salt | *Pseudomonas syringae, Pseudomonas fluorescens, Enterobacter aerogenes* | Maize (*Zea maize*) |
| Salt | *P. fluorescens* | Groundnut (*Arachis hypogaea*) |
| Salt | *Azospirillum* | Lettuce (*Lactuca sativa*) |
| Salt | *Achromobacter piechaudii* | Tomato (*Lycopersicon esculentum*) |
| Salt | *Aeromonas hydrophila/caviae Bacillus insolitus, Bacillus* sp. | Wheat (*Triticum aestivum*) |
| Salt | *Azospirillum* | Maize (*Z. maize*) |
| Salt | *A. brasilense* | Chickpeas (*Cicer arietinum*), faba beans (*Vicia faba* L.) |
| Drought | *Pseudomonas* spp. | Maize (*Zea mays* L. cv. Kaveri) |
| Drought | *Pseudomonas* spp. | Asparagus (*Asparagus officinalis* L.) |
| Drought | *Pseudomonas mendocina* | Lettuce (*Lactuca sativa* L.) |
| Drought | *Rhizobium tropici, Paenibacillus polymyxa* | Common bean (*Phaseolus vulgaris* L.) |
| Drought | *Bacillus* | Lettuce (*Lactuca sativa* L.) |
| Drought | *Ensifer meliloti* bv. *mediterranense* | Bean (*Phaseolus vulgaris* cv. Flamingo) |
| Drought | *Bradyrhizobium elkanii* | Flat crown (*Albizia adianthifolia*) |
| Drought | *Achromobacter piechaudii* | Tomato (*L. esculentum*), pepper (*Capsicum annuum*) |
| Drought | *Azospirillum* | Wheat (*T. aestivum*) |
| Drought | *A. brasilense* | Maize (*Z. mays*) |
| Drought | *A. brasilense* | Common bean (*P. vulgaris*) |
| Osmotic stress | *Bacillus subtilis* | Arabidopsis |
| Osmotic stress | *A. brasilense* | Rice (*Oryza sativa* L.) |
| Osmotic stress (45% PEG) | *Arthrobacter* sp., *Bacillus* sp. | Pepper (*C. annuum*) |
| Osmotic stress (20% PEG) | *Azospirillum* | Wheat (*T. aestivum*) |
| Flooding | *Enterobacter cloacae, Pseudomonas putida* | Tomato (*L. esculentum*) |
| Temperature | *Burkholderia phytofirmans* | Grapevine (*Vitis vinifera*) |
| Temerature | *Pseudomonas fluorescens, Pantoea agglomerans, Mycobacterium* sp. | Wheat (*Triticum aestivum*) |
| Temperature | *B. phytofirmans* | Potato (*Solanum tuberosum*) |
| Temperature | *Aeromonas hydrophila, Serratia liquefaciens, Serratia proteamaculans* | Soy bean (*Glycine max*) |
| Temperature | *Burkholderia phytofirmans* | Grapevine (*Vitis vinifera*) |
| Temperature | *B. phytofirmans* | Potato (*Solanum tuberosum*) |
| Temperature | *Aeromonas hydrophila, Serratia liquefaciens, Serratia proteamaculans* | Soy bean (*Glycine max*) |
| Nutrient deficiency | *Azospirillum* sp., *Azotobacter chroococcum, Mesorhizobium ciceri, Pseudomonas fluorescens* | Chickpea (*Cicer arietinum* L.) |
| Nutrient deficiency | *Azotobacter coroocoocum, Azospirillum brasilens, Pseudomonas putida, Bacillus lentus* | Zea maize L. (*Zea maize* L.) |
| Nutrient deficiency | *Bacillus* sp., *Burkholderia* sp., *Streptomyces platensis* | Zea maize L. |
| Nutrient deficiency | *Bacillus* sp., | Zea maize L. |

TABLE 1-continued

Bacterial Inoculates for Abiotic Stress (From Bianco Carmen and Defez Roberto (2011). Soil Bacteria Support and Protect Plants Against Abiotic Stresses, Abiotic Stress in Plants - Mechanisms and Adaptations, Prof. Arun Shanker (Ed.), ISBN: 978-953-307-394-1, InTech, DOI: 10.5772/23310)

| Stress type | Bacterial inoculate | Plant Species |
|---|---|---|
| Nutrient deficiency | *Bacillus polymyxa*, *Mycobacterium phlei*, *Pseudomonas alcaligenes* | *Zea maize* L. (*Zea maize* cv. *Felix*) |
| Heavy metals toxicity | *Sanguibacter* sp., *Pseudomonas* sp. | *Nicotina tabacum* |
| Heavy metals toxicity | *Bacillus subtilis*, *Pantoea agglomerans* | Oat (*Avena sativa*) |
| Heavy metals toxicity | *Pseudomonas fluorescens*, *Microbacterium* sp. | Rape (*Brassica napus*) |
| Heavy metals toxicity | *Methylobacterium oryzae*, *Burkholderia* sp. | Tomato (*Lycopersicon esculentum* L.) |
| Heavy metals toxicity | *Bacillus subtilis*, *Bacillus megaterium*, *Bacillus* sp. | Rice (*O. sativa*) |

C. Seed Coating Compositions

One embodiment provides a seed coating composition having at least one layer coating all or part of the seed, wherein at least one layer contains an effective amount of SA187 to provide the seed or the plant that grows from the seed with resistance to abiotic stress conditions. The SA187 can be from $10^6$/ml to $10^9$/ml of seed coating composition.

Another embodiment provides a seed coating composition containing SA187. The SA187 can be encapsulated with a non-toxic, biodegradable coating. The seed coating composition can also contain a coating adhesive. Exemplary seed coating compositions contain gelatin, cellulose, alginate, xanthum, or a combination thereof. Certain seed coating compositions can have multiple layers.

In another embodiment, the seed coating composition contains multiple layers for example, 2, 3, 4 or 5 or more layers. SA187 and/or one or more additional plant growth promoting bacteria can be in any or all of the layers of the seed coating composition; however, at least one of the layers of a multiple layer seed coating composition contains an effective amount of SA187 to provide the seed or the plant growing from the seed with resistance to abiotic stress conditions. Preferably, the SA187 or other plant growth promoting bacteria are in the layer adjacent to the surface of the seed.

In one embodiment, at least one layer contains guar gum, derivative guar, polyacrylamide, poly(methacrylic acid), poly(acrylic acid), polyacrylate, poly(ethylene glycol), phosphonate-end capped polymers, polyethyleneoxide, poly(vinyl alcohol), polyglycerol, polytetrahydrofuran, polyamide, hydroxypropyl guar, carboxymethyl guar, carboxymethyl hydroxypropyl guar, starch, derivatized (e.g., cationic) starch, corn starch, wheat starch, rice starch, potato starch, tapioca, waxy maize, sorghum, waxy sarghum, sago, dextrin, chitin, chitosan, alginate compositions, xanthan gum, carageenan gum, gum karaya, gum arabic, pectin, cellulose, hydroxycellulose, hydroxyalkyl cellulose, hydroxyethyl cellulose, carboxymethylhydroxyethyl cellulose, hydroxypropyl cellulose, a derivative of any of the foregoing or a combination of any of the foregoing. As non-limiting examples, the layer can contain a 90 wt % derivatized guar and 10 wt % starch (or derivatized starch) mixture, or a 60 wt % hydroxypropyl guar and 40 wt % carboxymethyl hydroxypropyl guar mixture.

In some embodiments, the layer can act as a carrier coating. Fungicides and beneficial microbes that protect the seed and emerging seedling are carried in the carrier coating. For example, alfalfa seed coating with incorporated SA187 is used to inoculate the field in which desired crop plants are planted or are growing.

Another embodiment provides agglomerates of seed. The agglomerate or grouping of seed is a grouping of 2 or more individual seeds together. The seeds can be for the same plant or for different plants. In another embodiment, the agglomerate is a grouping of more than 5 individual seeds together. In a further embodiment, the agglomerate is a grouping of more than 10 individual seeds together. In yet another embodiment, the agglomerate is a grouping of more than 25 individual seeds together. In yet a further embodiment, the agglomerate is a grouping of more than 50 individual seeds together. In another embodiment, the agglomerate is a grouping of more than 100 individual seeds together.

1. Seed Agglomerates

The agglomeration of seed can aid in the application of the seed coating composition because the seed coating composition, when using an agglomeration of seed, can be shaped or formed to be consistent in shape or form. For example, the agglomeration can be formed as spherical or substantially spherical, thus allowing the seed coating composition to be likewise substantially spherical. This can allow for improved or more consistent casting or spraying, can minimize the occurrence of blockage or clogging of the nozzles, hoses, etc. due to uneven particle size distribution. Typically, a binder or adhesive is utilized to bunch (e.g., agglomerize) the grouping of seeds together.

The agglomeration can also aid in seed or seedling establishment as a layer of the wetting agent (or other layer than affects the soil) can be concentrated to a local area of soil, thus, increasing its chance of wetting the soil surrounding the seed(s). the agglomeration can also promote survival by allowing the seeds, when germinating into seedlings, to generate sufficient force to penetrate hydrophobic areas or soil such as, for example, a hydrophobic (i.e., encrusted) soil surface In one embodiment, the seed coating composition contains an agglomeration of seeds of from between 2 seeds to 100 seeds, typically between 2 to 50 seeds, typically between 2 to 25 seeds; and at least one layer selected from the group consisting a layer of a filler, a layer of a binding agent, a layer of a wetting agent, a layer of an anti-bacteria agent, a layer of an active ingredient and any combination thereof.

In one embodiment, the seed coating composition is of substantially uniform size of from between 10 micrometers and 4 mm in diameter. In another embodiment, the seed coating composition is of substantially uniform size of from between 25 micrometers and 2 mm in diameter. In a further, the seed coating composition is of substantially uniform size of from between 500 micrometers and 2 mm in diameter.

2. Binder

The seed coating composition can also contain a binder as one of the layers, the binder is sometimes referred to as an adhesive. In one embodiment, the binder can include but is not limited to molasses, granulated sugar, alginates, karaya gum, guar gum, tragacanth gum, polysaccharide gum, mucilage or any combination of the foregoing. In another embodiment, the binder is chosen from, but is not limited to, gelatin, polyvinyl acetates, polyvinyl acetate copolymers, polyvinyl alcohols, polyvinyl alcohol copolymers, celluloses (including ethylcelluloses and methylcelluloses, hydroxypropylcelluloses, hydroxymethyl celluloses, hydroxymethylpropyl-celluloses), polyvinylpyrolidones, dextrins, malto-dextrins, polysaccharides, fats, oils, proteins, gum arabics, shellacs, vinylidene chloride, vinylidene chloride copolymers, calcium lignosulfonates, acrylic copolymers, starches, polyvinylacrylates, zeins, carboxymethylcellulose, chitosan, polyethylene oxide, acrylimide polymers and copolymers, polyhydroxyethyl acrylate, methylacrylimide monomers, alginate, ethylcellulose, polychloroprene, syrups or any combination of the foregoing.

3. Active Ingredients

The seed coating compositions can also include one or more active ingredients in one or more of the layers of the coating. Compounds suitable as active ingredients, which in some embodiments form all or part of at least one layer of the seed coating composition, include but are not limited to herbicides, plant growth regulators, crop desiccants, fungicides, insecticides, insect repellants, and combinations thereof. Suitable pesticides include, for example, triazine herbicides; sulfonylurea herbicides; uracils; urea herbicides; acetanilide herbicides; and organophosphonate herbicides such as glyphosate salts and esters. Suitable fungicides include, for example, nitrilo oxime fungicides; imidazole fungicides; triazole fungicides; sulfenamide fungicides; dithio-carbamate fungicides; chloronated aromatic; and dichloro aniline fungicides. Suitable insecticides, include, for example, carbamate insecticides; organo thiophosphate insecticides; and perchlorinated organic insecticides such as methoxychlor. Suitable miticides include, for example, propynyl sulfite; triazapentadiene miticides; chlorinated aromatic miticides such as tetradifan; and dinitrophenol miticides such as binapacryl. Other active ingredients can include adjuvants, surfactants, and fertilizers.

4. Filler

The seed coating composition can also include at least one filler as all or part of a layer. In one embodiment, the filler is selected from the group consisting of wood flours, clays, activated carbon, carbohydrates, sugars, dextrins, maltodextrins, diatomaceous earth, cereal flours, wheat flour, oat flour, barley flour, fine-grain inorganic solids, calcium carbonate, calcium bentonite, kaolin, china clay, talc, perlite, mica, vermiculite, silicas, quartz powder, montmorillonite or mixtures thereof.

5. Nutrients

The seed coating composition can also contain a nutrient such as a micronutrient or macronutrient in one or more layers of the seed coating composition. The nutrient can be in all or part of a layer. The nutrient can also be included with the grouping of seeds as part of the binder or adhesive. "Nutrient" as used herein can refer to an additive or substance utilized by plants, grasses, shrubs for plant, grass, and shrub growth, respectively. Macronutrients can be utilized in larger amounts by plants, grasses, etc. in proportionally larger amounts relative to micronutrients. Nutrients include but are not limited to manganese, boron, copper, iron, chlorine, molybdenum, and zinc, potassium, nitrogen, calcium, magnesium phosphorus and sulfur, among others. The seed coating compositions can include various combinations and relative amounts of individual macronutrients.

D. Coating Techniques

Equipment utilized to for coating seeds with the disclosed seed coating compositions include, but are not limited to drum coaters, rotary coaters, tumbling drums, fluidized beds and spouted beds to name a few. The seeds can be coated via a batch or continuous coating process.

The seeds can be separated prior to coating which, in one embodiment, utilizes mechanical means such as a sieve. The separated seeds can then be introduced into a coating machine having a seed reservoir. In one embodiment, the seeds in the mixing bowl are combined with one or more of the coatings described herein and adhered with a binder or adhesive.

In one embodiment of the process, one or more layers as described herein can be added to coat the seed or agglomeration. Outer layers can be introduced sequentially to the rotating drum.

In another embodiment, agglomerators or agglomerator devices may also be utilized. Coating is performed within a rotary coater by placing seeds within a rotating chamber, which pushes the seeds against the inside wall of the chamber. Centrifugal forces and mixing bars placed inside the coater allow the seed to rotate and mix with a coating layer. Binder or other coating materials can be pumped into the proximate center of the coater onto an atomizer disk that rotates along with the coating chamber. Upon hitting the atomizer disk, liquid adhesive is then directed outward in small drops onto the seed.

In one embodiment, seed coating techniques include, for example, seed in a rotating pan or drum. Seed is then misted with water or other liquid and then gradually a fine inert powder, e.g., Diatomaceous earth, is added to the coating pan. Each misted seed becomes the center of a mass of powder, layers, or coatings that gradually increases in size. The mass is then rounded and smoothed by the tumbling action in the pan, similar to pebbles on the beach. The coating layers are compacted by compression from the weight of material in the pan. Binders often are incorporated near the end of the coating process to harden the outer layer of the mass. Binders can also reduce the amount of dust produced by the finished product in handling, shipping and sowing. Screening techniques, such as frequent hand screening, are often times utilized to eliminate blanks or doubles, and to ensure uniform size. For example, tolerance for seed coating compositions described herein can be about 1/64th inch (0.4 mm), which is the US seed trade standard for sizing.

In yet another embodiment, the seed coating compositions and methods described herein comprises "in situ coating". In situ coating means, in one embodiment, where a raw or non-coated seed is implanted in a hole, cavity or hollowed area in the ground and immediately or soon thereafter a coating composition is sprayed or applied directly into the hole, cavity or hollowed area to surround or partially surround the seed. Typically, the application of the seed as well as application of the coating composition are performed mechanically, but is understood that either or both of the referenced applications can be performed manually as well.

The coating can also be applied to a seed by spraying, dipping or brushing.

III. Methods for Providing Tolerance or Resistance to Abiotic Stress Conditions

Methods for providing seeds and plants with resistance or tolerance to abiotic stress conditions are provided. The methods include inoculating the seed or plant with an effective amount ($10^6$-$10^8$ bacteria/ml) of SA187 to provide the seed or plant with resistance to the abiotic stress conditions. The inoculation of the plant can be in the rhizosphere of the plant. The rhizosphere is the area around a plant root that is inhabited by a unique population of microorganisms. Alternatively, the plant root can be inoculated directly. In certain embodiments, the plant root is coated with SA187.

A method for providing a seed or plant with resistance to abiotic stress condition include coating the seed or a root of the plant with an effective amount of SA187 to provide the seed or plant with resistance or tolerance to abiotic stress conditions.

Yet another embodiment provides a method of improving growth of a seed or plant under abiotic stress conditions by growing the seed or plant in a plant substrate, wherein the plant substrate includes an effective amount of SA187 to colonize the seed or a root of the plant to provide abiotic stress resistance to the seed or plant.

Still another embodiment provides a method of improving tolerance of a seed or plant against abiotic stress conditions by growing the seed or plant in a plant substrate comprising an effective amount of SA187 to provide the seed or plant with tolerance to the abiotic stress conditions.

Yet another embodiment provides a method of providing a plant with abiotic stress resistance by inoculating the plant's rhizosphere with SA187.

One embodiment provides a method for increasing crop yield or crop biomass by inoculating fallow soil with SA187, planting crop seeds or crop seedlings into the inoculated fallow soil, cultivating the crop seeds or crop seedlings into mature plants, and harvesting the mature plants, wherein the harvested mature plants have increased crop yield or crop biomass or both relative to similar crop seeds or crop seedlings cultivated in soil without SA187.

Another embodiment provides a method for increasing crop yield or crop biomass by inoculating roots of crop plants with SA187 to increase crop yield or crop biomass or both relative to crop plants grown without SA187. The crop plants can be grown in a field, pasture, land, farmland, or in gardens.

Crops that can be treated with SA187 include but are not limited to alfalfa, cotton, wheat, maize, soybean, oat, barley, potato, and sugar beets.

EXAMPLES

Example 1: Identification of SA187

Methods

Organisms

*Enterobacter* sp. SA187 is endophytic bacteria isolated from surface sterilized root nodules formed on roots of pioneer plant *Indigofera argentea* Burm.f. (Fabaceae). Plants were collected from different regions in the Jizan area (16° 56.475' N, 42° 36.694' E) of Saudi Arabia. SA187 has been shown to possess plant growth promoting activities, such as the production of siderophores and indole acetic acid (IAA).

Sequencing

The genomic DNA of SA187 was extracted using the Qiagen's DNeasy blood and tissue kit following the manufacturer protocol. The DNA was then sequenced using paired-end Illumina MiSeq and the library preparation was constructed as described previously (1). Contig assembly was done with Spades assembler version 3.6 (4) with a 1 KB contig 52 cutoff size.

Total RNA was extracted from 5-day-old plants inoculated or not with SA187 and transferred for 10 more days on ½ MS plates with or without 100 mM NaCl using the Nucleospin RNA plant kit (Macherey-Nagel), including DNase treatment, and following manufacturer's recommendations.

RNA samples were used for Illumina HiSeq deep sequencing (Illumina HiSeq 2000, Illumina). Three biological replicates were processed for each sample. Paired-end sequencing of RNA-seq samples was performed using Illumina GAIIx with a read length of 100 bp. Reads were quality-controlled using FASTQC (http://www.bioinformatics.babraham.ac.uk/projects/fastqc/). Trimmomatic was used for quality trimming[8]. Parameters for read quality filtering were set as follows: Minimum length of 36 bp; Mean Phred quality score greater than 30; Leading and trailing bases removal with base quality below 3; Sliding window of 4:15. TopHat v2.0.9[9] was utilized for alignment of short reads to the *Arabidopsis thaliana* genome TAIR10 (Supplementary Table 1), Cufflinks v2.2.0[10] for transcript assembly and differential expression. To identify differentially expressed genes, specific parameters (p-value: 0.05; statistical correction: Benjamini Hochberg; FDR: 0.05) in cuffdiff were used. Post-processing and visualization of differential expression were done using cummeRbund v2.0.0". Gene is considered as regulated if fold change>log $2^{|0.6|}$ and q-value <0.05. Results were confirmed by analyzing 12 genes using qPCR method.

For qPCR analysis, plant RNAs were purified as described previously. For bacterium, SA187 incubated 4 h in ½MS or ½MS+100 mM, at 28° C., under the dark, were used for RNA extraction, using the RiboPure™ RNA Purification Kit, bacteria (Ambion) following manual instructions for Gram-(−) bacteria, with the exception that no beads were used during bacterial lysis. RNA extraction was followed by DNAseI treatment in order to obtain purified total RNA.

cDNAs were synthetized using SuperscriptIII (Invitrogen), 1 µg of total RNA and oligo-dT following manufacturer's recommendations. For *Arabidopsis* gnee expression analyses, ACTIN2 (At3g18780) and UBIQUITIN 10 (At4g05320) were used as reference genes. For SA187 gene expression analyses, infB, rpoB and gyrB were used as reference genes. All reactions were done in a CFX96 Touch™ Real-Time PCR Detection System (BIO-RAD) as follows: 50° C. for 2 min, 95° C. for 10 min; 40×[95° C. for 10 sec and 60° C. for 40 sec]; and a dissociation step to validate the PCR products. All reactions were performed in three biological replicates, and each reaction as a technical triplicate. Gene expression levels were calculated using Bio-Rad CFX manager software.

Hierarchical Clustering and Gene Family Enrichment

*Arabidopsis* regulated genes were used to generate HCL tree using Multi Experiment Viewer (MeV 4.9.0 version, TM4, https://sourceforge.net/projects/mev-tm4/files/mev-tm4/MeV %204.9.0/). Raw data were normalized for every gene and transformed in log 2. Hierarchical clustering was performed using Euclidian distances, average linkage and leaf order optimization. Heat colors indicate log 2 fold change.

Gene enrichment analyses were performed using AmiGO website (http://amigo1.geneontology.org/cgi-bin/amigo/term enrichment). Each cluster were analyzed using default parameter.

Results

De novo assembly of MiSeq reads for *Enterobacter* sp. SA187 resulted in 14 contigs with a total length of 4,404,403 bp and a mean contig size of 314,600 bp. The N50 was 2,296,004 bp and the L50 has been reached in 1 contig. The GC content of this draft genome was 56%. Megablast (5) comparison of the SA187 concatenated contigs against the NCBI reference genome database (http://www.ncbi.nlm.nih.gov/genome/) revealed the 57 closest relative genomes being *Enterobacter sacchari* SP1 with a coverage of 63% and sequence identity of 95% (Accession number NZ_CP007215.2) (6). The annotation of *Enterobacter* sp. SA187 was carried out using the default INDIGO pipeline (7) with the exception of open reading frame (ORFs) prediction by FragGeneScan (8). The annotation of SA187 resulted in 3,087 ORFs, 9 rRNA, 75 tRNA, and 145 ncRNA.

The annotation predicted a number of siderophore pathway genes such as entE, entC, entA, entB, entF, as well as entS, an MFS transporter of enterobactin. An ABC transporter involved in iron uptake, sitABCD, was also found, as well as five copies of the iron complex outer membrane receptor (fhuA) and a TonB-dependent outer membrane iron-enterobactin/colicin (fepA). Generally, PGPR bacteria enhance plant growth through the synthesis of IAA from tryptophan via indole pyruvate as the main pathway (9). The SA187 genome harbors a number of genes involved in this pathway, but lacks the gene encoding for indolepyruvate decarboxylase (ipdC). Moreover, the SA187 genome codes for the enzyme tryptophanase (TnaA) (EC: 4.1.99.1), which can transform tryptophane into indole.

Example 2: Nucleotide Sequence Accession Numbers

Genome of *Enterobacter* sp. SA187 was deposited at DBFEMBL/GenBank under accession number MORB00000000 (which is incorporated herein in its entirety. The genome of SA187 contains SEQ ID NO:1-13.

Results

Based on 16S rDNA sequencing and comparison, SA187 was suggested to belong to the *Enterobacter* genus, with high homology with *Enterobacter kobei* strains.

The 16S ribosomal RNA gene sequence (or 16S rRNA) is deposited at DDBFEMBL/GenBank under the accession no KY194757.

Based on the 16S rRNA gene sequence the SA187 is closely related to *Enterobacter* kobei CCUG 49023$^T$ and *Enterobacter aerogenes* strain KCTC 2190 with 99% sequence similarity. One embodiment provides a bacterium comprising SEQ ID NO:1, 2, 3, 4, 5, 6, 7, 8, 9, 10, 11, 12, 13, 14, or a combination thereof.

Example 3: Salt Tolerance on *Arabidopsis thaliana*

Materials and Methods

SA187 was first tested in vitro on *Arabidopsis thaliana* plants. *Arabidopsis thaliana* Columbia-0 ecotype have been germinated on ½ strength MS medium plates, a generic synthetic plant growth medium (adapted from Murashige and Skoog, 1962), containing $10^7$ bacterial cells per plate, control plants were grown on regular ½ MS plates. After 5 days of germination, seedlings were transferred on 2 different medium: ½ MS (control condition), ½ MS+100 mM NaCl (Salt condition).

*Arabidopsis thaliana* Columbia-0 seeds were surface sterilized 10 min in 70% EtOH+0.05% Sodium Dodecyl Sulfate on a shaker, washed 2 times in 96% EtOH and let to dry. Sterilized seeds were sawn on ½ MS plates (Murashige and Skoog basal salts, Sigma) containing $2 \cdot 10^5$ cfu·mL$^{-1}$ (+SA187), stratified for 2 days at 4° C. in the dark and then placed vertically for germination during 5 days. Calculated amount of bacterial suspension was added to pre-cooled agar medium during plate preparation.

Germination was considered as occurring when a radicle was detectable under the stereomicroscope. Average length of root hairs was determined based on images of 5 day-old roots (1 image per root at constant distance from the root tip, 25 seedlings per condition) captured using a Nikon AZ100M microscope equipped with an AZ Plan Apo 2× objective and a DS-Ri1 camera (Nikon). All root hairs in focus were measured in ImageJ (https://imagej.nih.gov/ij/), average value and standard deviation were calculated from 10% longest root hairs to eliminate non-developed root hairs and describe the maximal elongation capacity of root hairs.

Figure 4A:
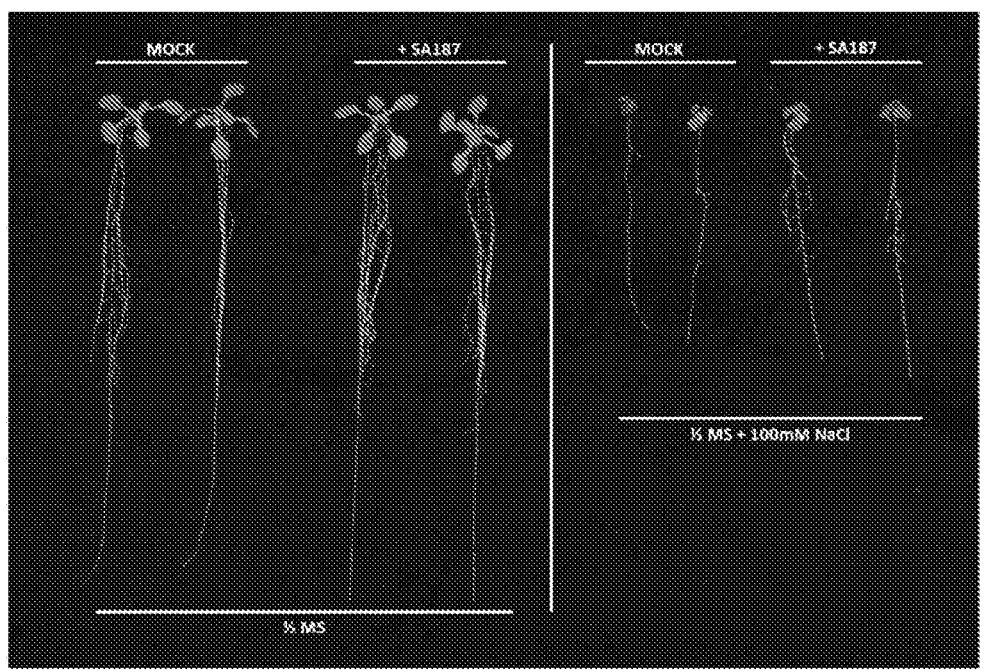
FIG. 4A is a photograph of germinating *Arabidopsis thalia* seeds grown on ½ MS containing $10^7$ bacteria per plate (left panel) with (+SA187) or without (−SA187). Five day old seedlings were then transferred to ½ MS+/−100 mM NaCl plates (right panel). Photographs were taken after 10 days of treatment.
Figure 4B:
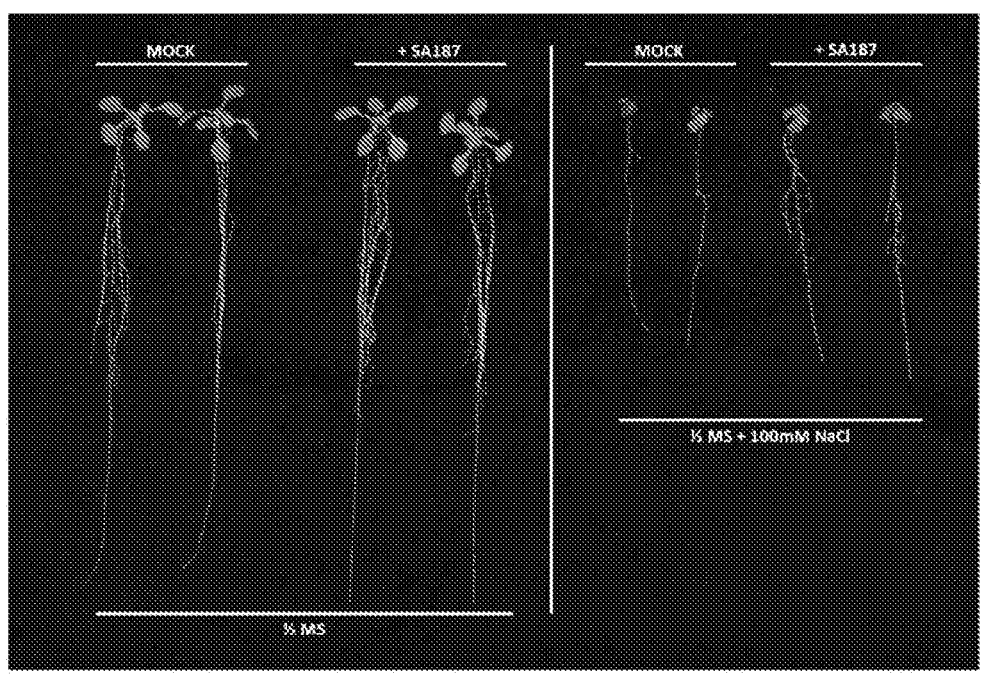
FIG. 4B is a photograph of germinating *Arabidopsis thalia* seeds grown on ½ MS containing $10^7$ bacteria per plate (left panel) with (+SA187) or without (−SA187). Five day old seedlings were then transferred to ½ MS+/−100 mM NaCl plates (right panel). Photographs were taken after 20 days of treatment.

Five-day-old seedlings were transferred on ½ MS plates with or without 100 mM NaCl (Sigma). Primary root length was measured using ImageJ software after scanning the plates. Lateral root density was evaluated as detectable number of lateral roots under a stereo microscope divided by the primary root length (FIGS. 4A-4B). Fresh weight was measured 12 days after transfer of seedlings. Dry weight was measured by drying the different plant organs 2 days at 70° C. To address the ethylene involvement on *Arabidopsis* adaptation to salt stress, ACC (1-aminocyclopropane-1-carboxylic acid, Sigma), KMBA (2-keto-4-methylbutyric acid, Sigma), AVG (Aminoethoxyvinylglycine, Sigma) and AgNO$_3$ (Silver nitrate, Sigma) were added concentrations in ½ MS plates with 100 mM NaCl.

For osmotic shock treatment, stress evaluation was performed by transferring plants on PEG plates (−0.5 MPa) as described previously[4]. For the heat stress treatment, 6-day-old seedlings plants were given a 37° C. preheat treatment for 1 h, and then subjected to heat stress of 42° C. for 3 h. Plants were then transferred to normal growth conditions (22° C.) for one week. The survival rate was quantified by counting the percentage of the surviving plants. All plants were grown in long day conditions in growth chambers (Percival; 16 h light/8 h dark, 22° C.) for 10 to 12 more days. Each experiment was performed at least in three biological replicates.

Na$^+$ and K$^+$ Content Determination

Dry rosettes and root systems were weighted. All samples were measured individually except for salt-treated root systems, whereby pools of 3 samples were used for measurements. Sodium and potassium concentrations were measured for shoot and root dry samples by digestion method, using 1 mL of freshly prepared 1% HNO$_3$ (trace metal grade, Fisher Scientific) that was added to the pre-weighed samples. The concentrations of sodium and potassium were determined, using Inductively Coupled Plasma Optical Emission Spectrometer (Varian 720-ES ICP OES, Australia).

Results

Figure 2A:
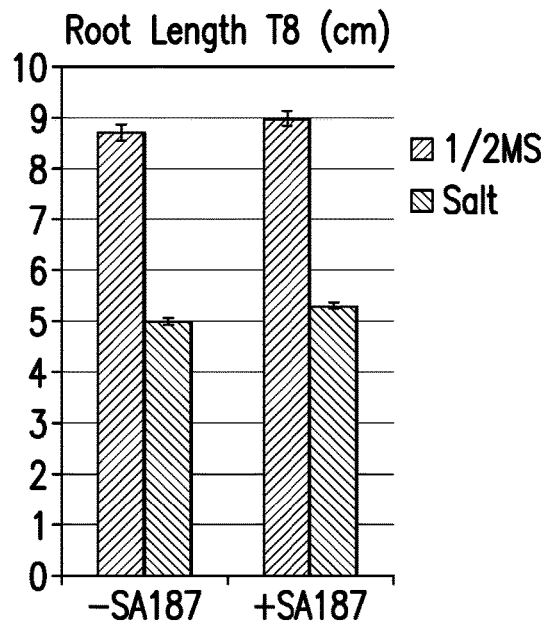
FIG. 2A is a bar graph of root length (cm) for 13 day old *Arabidopsis* seedlings treated for 8 days with ½ MS (control condition; left column) and 100 mM NaCl (salt condition; right column) for plants inoculated with (+SA187) and plants without (−SA187).
Figure 2B:
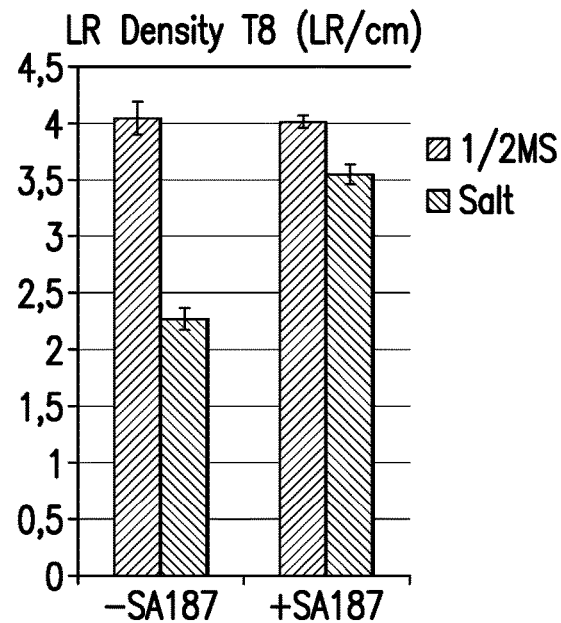
FIG. 2B is a bar graph of lateral root density (cm) for 13 day old *Arabidopsis* seedlings treated for 8 days with ½ MS (control condition; left column) and 100 mM NaCl (salt condition; right column) for plants inoculated with (+SA187) and plants without (−SA187).
Figure 3:
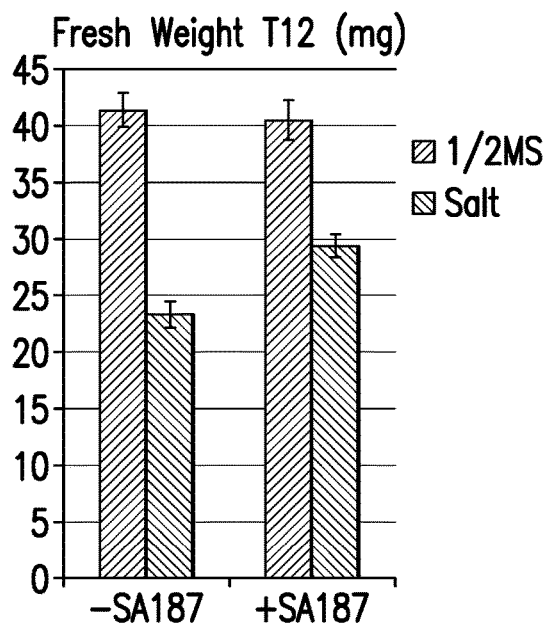
FIG. 3 is a bar graph showing the fresh weight (mg) of 17 day old *Arabidopsis* seedlings treated for 12 days with ½ MS (control condition, left column) and 100 mM NaCl (salt condition, right column) for plants inoculated with (+SA187) and plants without (−SA187).

Root length, lateral root density were assayed after 8 days (FIG. 2). After 12 days of treatment, plants were weighed (FIG. 3). Overall those results indicate that SA187 can enhance *Arabidopsis* growth under salt stress conditions by ca. 25% fresh weight and increasing the lateral root density of the stressed plants by 60%. As shown in FIG. 3, this increase will be amplified over time indicating that this beneficial action will increase over time ending with highly improved plant growth when faced by salt stress.

Similar results were obtained using ½ MS+5% PEG (PolyEthylene Glycol 6000), a compound known to induce osmotic stress on the plants.

Figure 5:
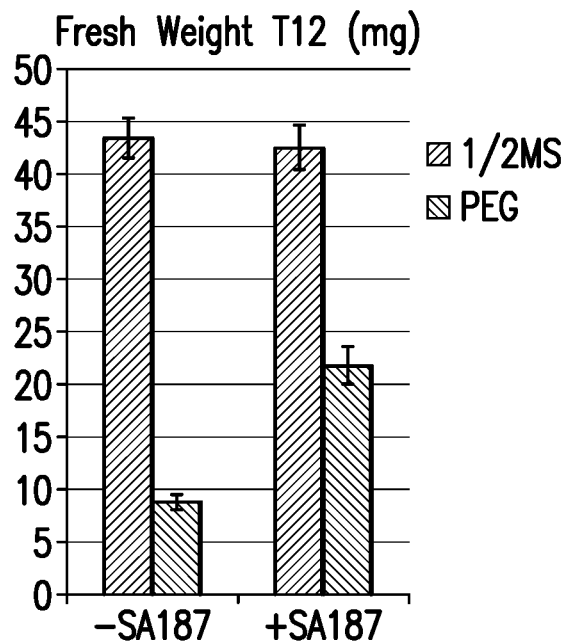
FIG. 5 is a bar graph of fresh weight (mg) of 17 day old *Arabidopsis* seedlings treated for 12 days with ½ MS (control, left column) and 5% PEG (drought mimicking condition, right column) treated with (+SA187) or without (−SA187) SA187.

SA187 possess a number of plant growth promoting (PGP) traits, such as the solublization of Zn, production of siderophores and production of indole acetic acid (IAA). SA187 can tolerate different abiotic stresses including salt stress up to 2M NaCL and osmatic stress-up to 20% poly ethylene glycol 8000: PEG8000) mimicking drought stress in vitro (FIG. 5).

Those results show that SA187 induces tolerance to multiple environmental stresses on *Arabidopsis thaliana*. It is also important to note that SA187 does not have any detrimental effect on plant growth under optimal conditions.

Example 4: Drought Tolerance Test on *Arabidopsis thaliana*

Materials and Methods

The beneficial effect of SA187 was also tested in a greenhouse: Bacterialized 3 week old *Arabidopsis* plants were submitted to a 3 week drought treatment and then rewatered again. After one week of rewatering, aerial parts were collected and weighed.

Results

Figure 6:
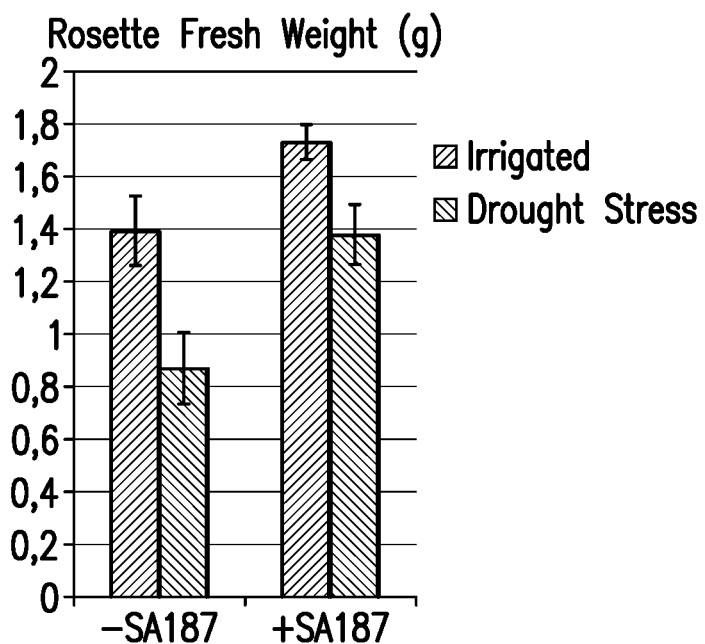
FIG. 6 is a bar graph of rosette fresh weight (g) of *Arabidopsis* plants submitted to a 3 week drought treatment as in FIG. 5 with (+SA187) or without (−SA187).

As shown in FIG. 6, SA187 increases *Arabidopsis* fresh weight by 25% in optimal conditions and almost 60% after water stress confirming the results obtained in vitro. This experiment also points out that SA187 acts beneficially in the long term on the development of *Arabidopsis thaliana* in normal conditions.

Example 5: Field Trial on Durum Wheat

Materials and Methods

SA187 was tested during a field trial at the ICBA station in Dubai (United Arab Emirates). These assays aimed to verify if the results obtained in highly controlled conditions could be confirmed in field conditions. Seed lots of durum wheat were inoculated by soaking in a bacterial solution and kept shaking for 4 hours, then allowed to dry on filter paper. Seed sowing was performed on the fields of the ICBA experimental station. Soil samples were collected from the plots irrigated with fresh water for analysis. The average value for the pH was 7.45 and the salinity of the soil was EC=4.9 ds/m (EC>4 ds/m is considered saline). Germination was recorded in all plots without any visible differences between subplots.

Field Trial

Two field stations were chosen to conduct the trail experiments; both fields are located in desert area exposed to high average temperature through the year, low rain, availability of source of ground water, poor loamy sandy soil, with poor organic matter. Unless mentioned later, other agronomic practices were kept uniform across the treatments throughout the experiment in the two field station.

Seeds of durum wheat (*Triticum durum*) local Karim variety were washed thoroughly in sterile distilled water and then soaked in bacterial suspension solution ($2.10^8$ cell·mL$^-$ $_1$) for 4 h with shaking, bacterial suspension was removed and the seeds left to air dry over 3 mM filter paper (Whatman) for 6 h. Durum wheat field trail was carried out at the SCADA field station at International Center for Biosaline Agriculture, Dubai, United Arab Emirates (ICBA-UAE), in period of 2014-2016 (N 25°5'40.9", E 55°23'23.6"). The experiment was conducted using a randomized complete block design; each plot is (2.5×2.0 m) with three replicates. Ten-row plots were prepared with intra- and inter row distances of 20 cm and 50 cm, respectively. All the plots were irrigated with ground water with EC=0.3 dS·m$^{-1}$, the average soil pH was 7.45 and soil salinity EC=4.9 dS·m$^{-1}$. The agronomical data were collected on plant height, plant biomass, number of tillers per plant, spike height, number of spikes plant, number of seeds per spike, and total grain yield per plot.

For inoculation of alfalfa which has smaller seeds size, a slurry was prepared consisting of sterilized peat, a broth culture of SA187, and sterilized sugar solution (10%) in the ratio 5:4:1 (w/v/v). Subsequently, alfalfa seeds were coated with the slurry at a rate of 50 mL·kg$^{-1}$. For the control, seeds were coated with a similar mixture without bacteria. Field trial was conducted at experimental station in Hada Al-Sham, Kingdom of Saudi Arabia, in the period of 2015-2016 (N 21°47'47.1" E 39°43'48.8"). The experiment was a randomized complete block design with a split-split plot arrangement of four replicates, plots (2×1.5 m) with seed spacing 20 cm row-to-row. The field was irrigated using saline ground water with three different salinity level (EC 3.12, 5.46, and 7.81 dS m$^{-1}$), at the research station, two sources of water were available with a salinity of EC 3.12 and 7.81 dS m$^{-1}$, and saline water with EC 5.46 dS m$^{-1}$ was prepared by mixing the two sources. The average soil pH was 7.74 and soil salinity EC=1.95 dS m$^{-1}$. The agronomical data were recorded every 25-30 days after each cut; this includes plant height and yield as fresh and dry weight.

Results

Figure 7A:
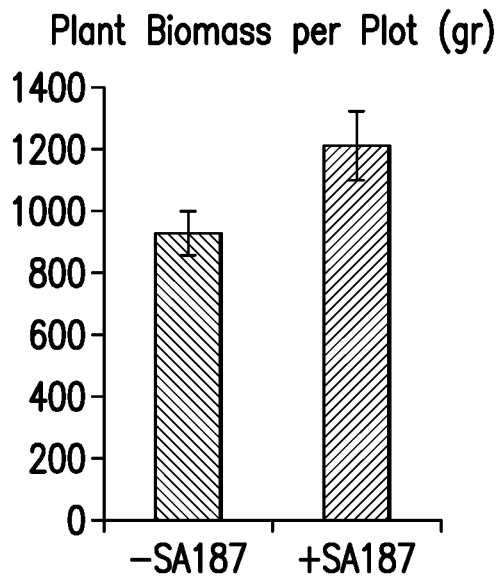
FIG. 7A is a bar graph of plant biomass per plot (gr) of Durum wheat inoculated with (+SA187) or without (−SA187).
Figure 7B:
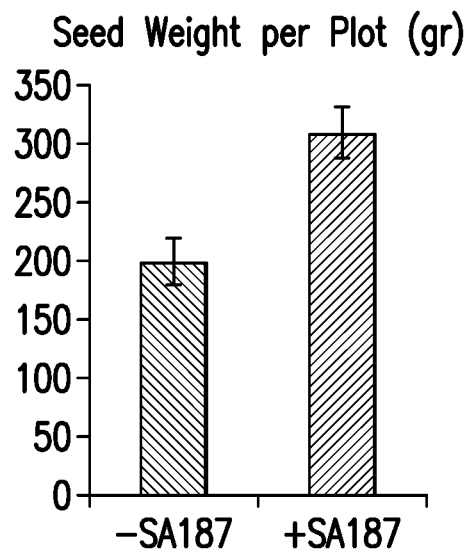
FIG. 7B is a bar graph of seed weight per plot (gr) of Durum wheat inoculated with (+SA187) or without (−SA187).
Figure 7C:
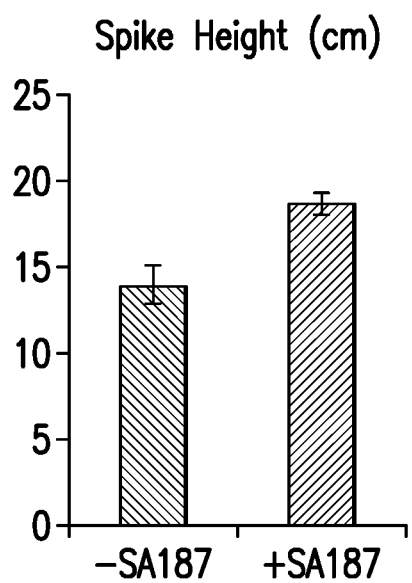
FIG. 7C is a bar graph of spike height (cm) of Durum wheat inoculated with (+SA187) or without (−SA187).
Figure 7D:
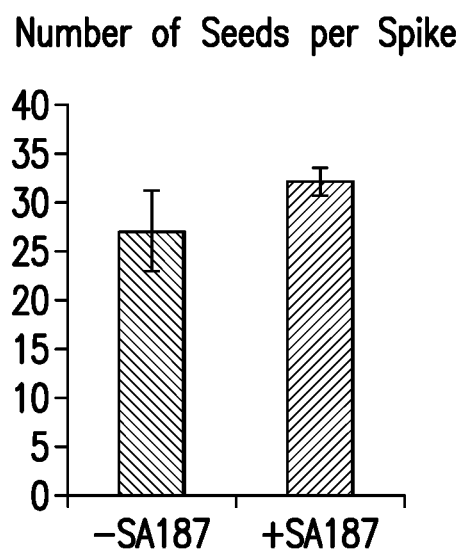
FIG. 7D is a bar graph of number of seeds per spike of Durum wheat inoculated with (+SA187) or without (−SA187) *Enterobacter endophyticus* sp. nov.

Overall this field experiment proved that SA187 increased crop yield by 50% in the hot and arid conditions of fields in the United Arab Emirates showing increased plant biomass (FIG. 7A), seed number per spikes (FIG. 7D). and seed weight per plot (FIG. 7B). These results establish that SA187 can be used for agronomical purposes as it can significantly enhance crop yield.

All together, the results show the beneficial impact of SA187 on plant growth and yield. This bacterial strain is performing positively on different plant species and improves their development and yield under environmental stresses in controlled in vitro and greenhouse conditions but also in open field trials showing its wide potential for agronomical application.

Example 6: Assessment of Stress Tolerance

To test whether SA187 can confer enhanced stress tolerance to plants beyond its natural host, the model crucifer plant *Arabidopsis thaliana* was tested. SA187 did not negatively influence the germination rate of *Arabidopsis* seeds, and morphological changes became obvious 5 days after germination: Primary roots were significantly shorter and exhibited longer root hairs compared to non-treated seedlings.

Materials and Methods

SA187 inoculated plants were transferred on medium with or without 100 mM NaCl to monitor PGP or stress-tolerance promoting (STP) capacity.

Results

Figure 8A:
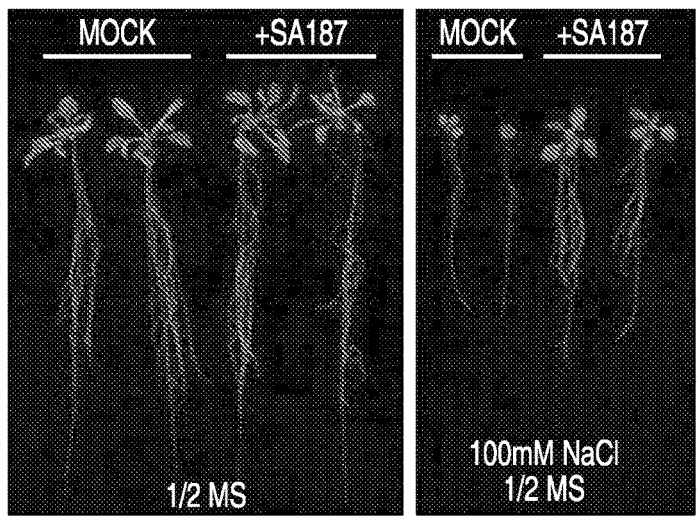
FIG. 8A is a photograph of SA187-colonized 25-day-old *Arabidopsis* plants showing enhanced growth under salt stress.
Figure 8B:
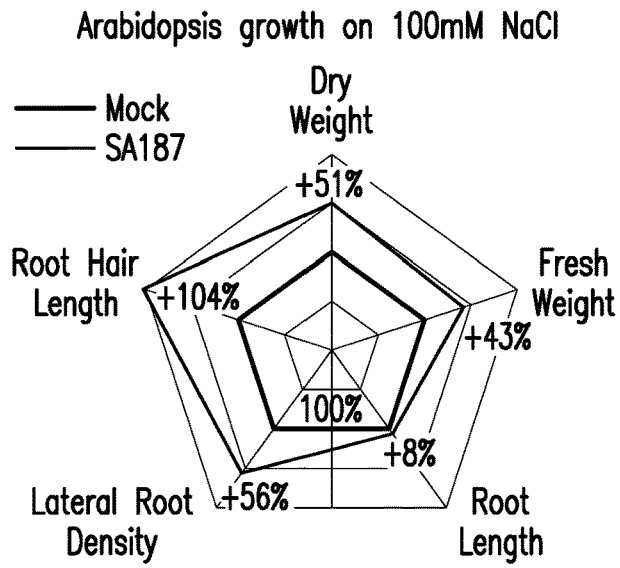
FIGS. 8B and 8D are graphs showing growth parameters of 17-day-old SA187-colonized seedlings exposed to salt stress (½ MS+100 mM NaCl) or osmotic stress (−0.5 MPa) (FIG. 8D). Root hair length was measured on 5-day-old seedlings.
Figure 8C:
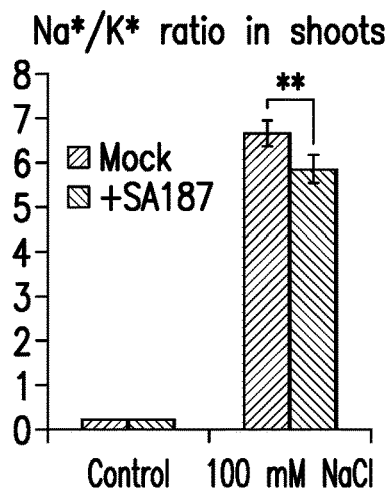
FIG. 8C is a bar graph of shoot Na+/K+ratio of SA187-colonized seedlings exposed to salt stress for 12 days.
Figure 8D:
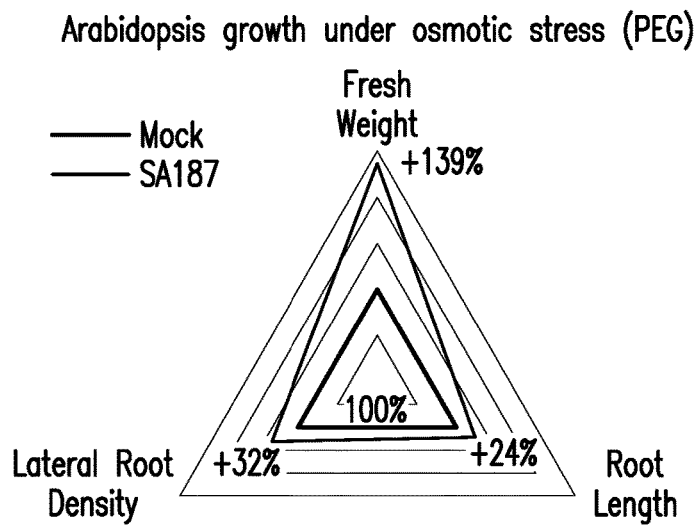

As evaluated by shoot and root fresh and dry weight, root length, lateral root density or ion content, SA187 had a neutral impact on *Arabidopsis* growth in control conditions, indicating that SA187 is not PGPR per se. However, under salt-stress condition, SA187-treated plants exhibited clear positive effects as shown by an increased fresh weight of roots and shoots (FIG. 8A, 8B, 9A-9C). Principal root growth was similar between control and SA187-inoculated plants under salt stress conditions, but lateral root density was significantly increased (FIG. 8B). The higher salt tolerance of SA187-inoculated plants can be explained by an enhanced K$^+$ content, thereby changing the Na$^+$/K$^+$ ratio under salt stress conditions.

Figure 8E:
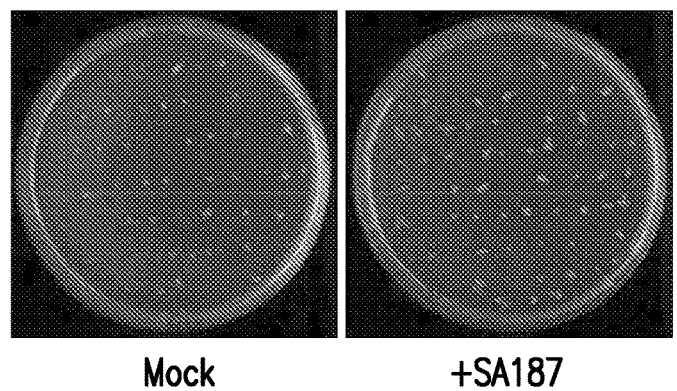
FIG. 8E is a photograph showing increased survival into heat stress in *Arabidopsis* inoculated with SA187.
Figure 8F:
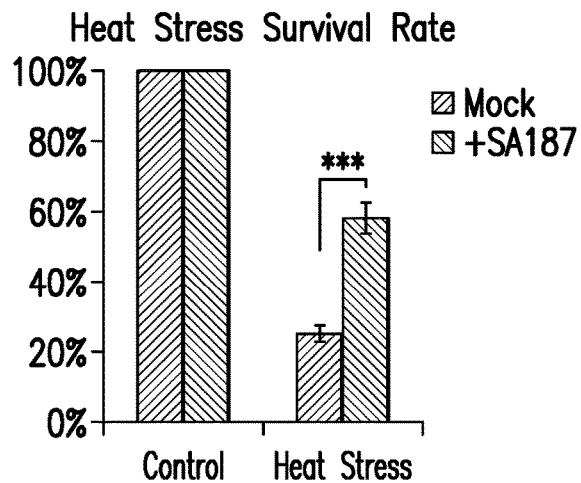
Figure 8G:
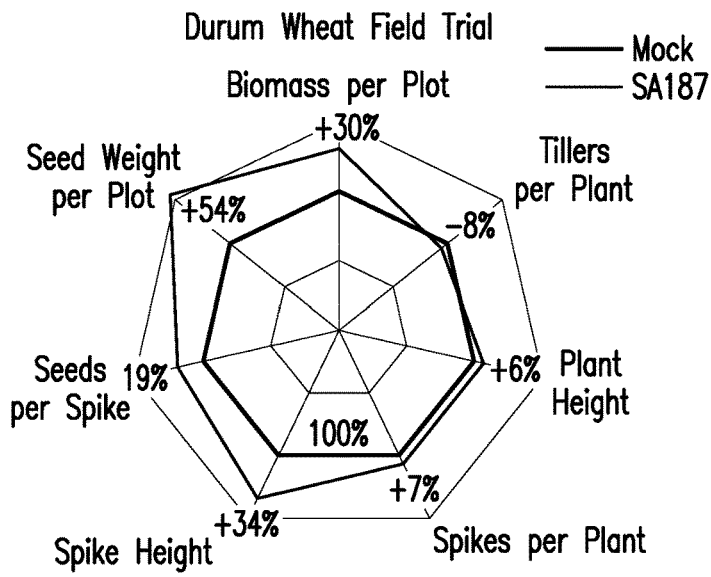
FIG. 8G is a graph of growth parameters of SA187-colonized 140-day-old field-grown durum wheat plants.
Figure 8H:
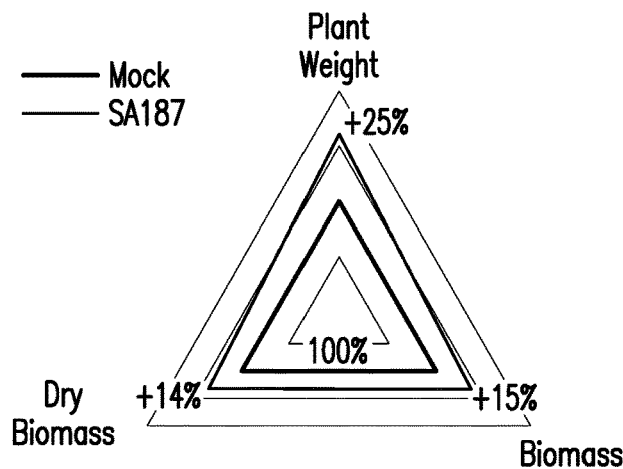

SA187 was also evaluated for its capacity to enhance *Arabidopsis* tolerance to other abiotic stresses. SA187-inoculated plants exhibited a higher heat stress survival rate (52%) when compared to non-treated plants (22%) (FIG. 8G, 8H). Plant growth was also improved by SA187 when subjecting plants to osmotic stress (FIG. 8). These results indicate that SA187 confers multi-stress tolerance to *Arabidopsis thaliana*.

Example 7: Assessment of Agronomic Use of SA187

Materials and Methods

To evaluate the potential agronomic use of SA187, its beneficial activity was tested under desert field conditions using two agronomically important crops: A durum wheat field trial was performed in poor sandy soil in the hot desert climate of Dubai, United Arab Emirates.

Results

Figure 8I:
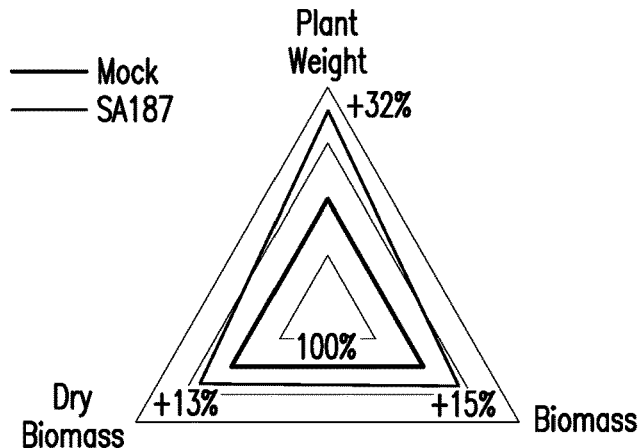
Figure 9A:
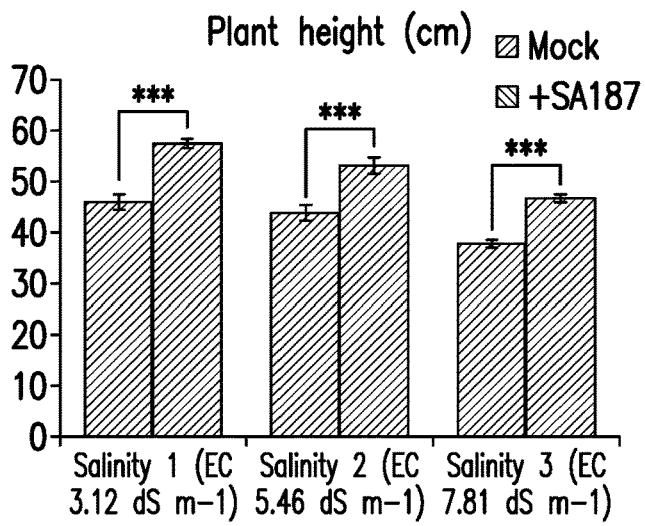
FIG. 9A is a bar graph of plant height under salinity conditions when treated with SA187.
Figure 9B:
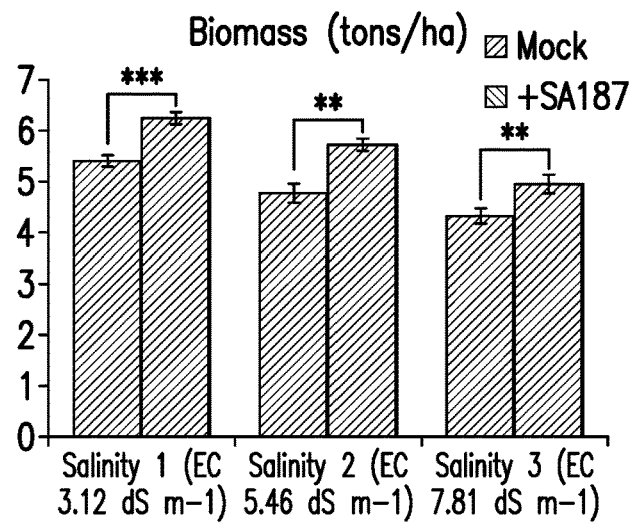
FIG. 9B is a bar graph of biomass of plants treated with SA187 and cultured under salinity conditions.
Figure 9C:
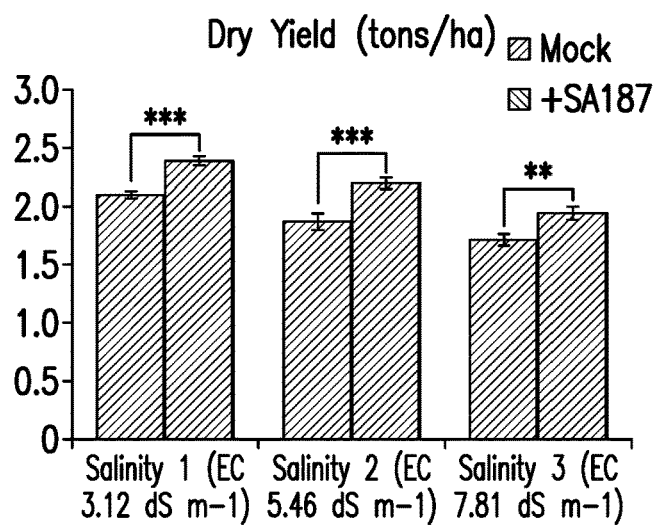
FIG. 9C is bar graph of dry yield of plants treated with SA187 and cultured under salinity conditions.

During a typical growing season, SA187 enhanced wheat biomass by 30%, but also spike height, and most importantly grain yield by over 50% (FIG. 8I). Alfalfa was grown on sandy soil fields near Jeddah, in Saudi Arabia. SA187-treated alfalfa exhibited an increase of around 20% for plant height and biomass, independently of irrigation, with regular or high salty water (FIG. 8E).

Example 8: Assessment of Plant Interaction with SA187

Materials and Methods

To characterize the interaction of SA187 with plants in more detail, its capacity to colonize *Arabidopsis* seedlings was analyzed on ½ MS agar or turf-based soil.

Generation of GFP-Labelled Bacteria

SA187 was genetically labeled with the GFP expressing cassette by taking advantage of the mini-Tn7 transposon system[5]. In order to specifically select for the bacterium carrying the GFP integration in the genome, a spontaneous rifampicin resistant version of the strain was obtained first[6]: an overnight-grown culture of SA187 was plated on LB plates amended with 100 µg·ml$^{-1}$ of rifampicin and the plates were incubated for 24 h at 30° C. At least 10 colonies, representing spontaneous rifampicin resistant mutants of the strain were streaked twice on LB plates containing 100 µg·ml$^{-1}$ of rifampicin and thereafter twice on LB plates supplemented with 200 µg·ml$^{-1}$ of rifampicin. The rif$^R$ SA187 strain was then used for the transformation assay by conjugation as described previously.

Results

SA187, which was stably transformed to express green fluorescent protein (GFP) while having the same effect on plant as the wild type strain colonized both roots and shoots (data not shown). On roots, colonies established themselves preferentially in grooves between epidermal cell files, before forming large colonies proportionally to the age of the root region. On vertical agar plates, SA187-GFP colonies were found inside root tissues in 22% of cases around the base of lateral roots (data not shown). Occasionally, SA187 was detected in the root apoplast of soil-grown seedlings far from lateral roots (data not shown). Bacterial colonies were also found deep inside the apoplast of hypocotyls, cotyledons and leaves, and in several cases bacterial cells were observed to penetrate through stomata of these organs (data not shown).

Example 9: Assessment of Signaling Pathways Affected by SA187

Materials and Methods

Figure 10A:
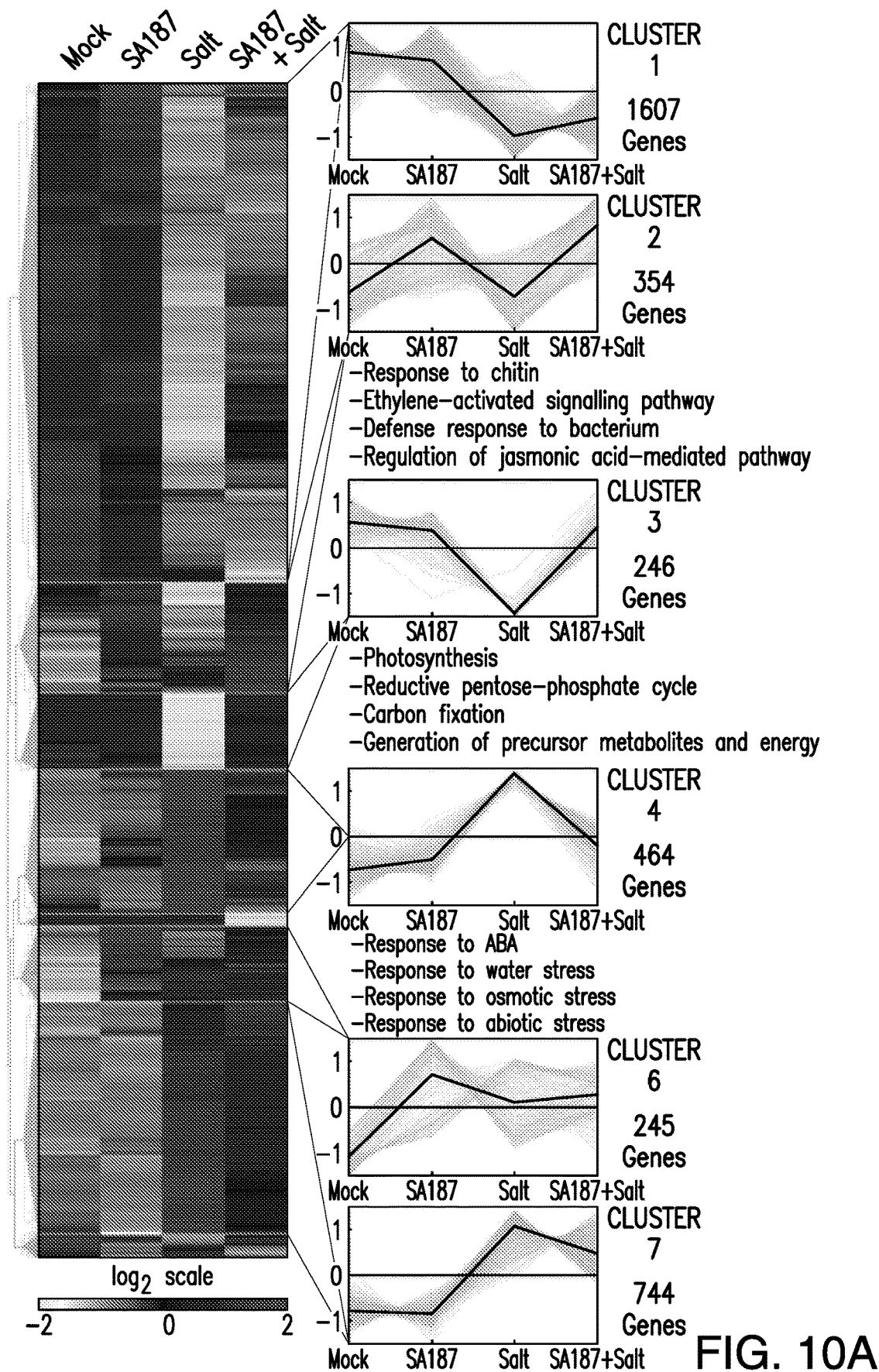
FIG. 10A is a hierarchical clustering (Euclidian distances) of deregulated genes in response to SA187, salt or both.

To identify which signaling pathways are affected in plants upon SA187-colonization under normal and salt stress conditions, RNA-seq analyses were conducted, comparing 4 conditions: Mock treated plants (Mock), SA187-inoculated plants (SA187), salt treated (Salt) and SA187-inoculated plant under salt stress (SA187+Salt) (Extended Data Table 1). The transcriptome data were analyzed by hierarchical clustering into 8 groups (FIG. 10A).

Results

The major differences between SA187- and non-inoculated plants were observed in clusters 2, 3 and 4. Cluster 3 corresponds to genes with a role in primary metabolism, such as photosynthesis and energy metabolism, that are downregulated under salt stress conditions in non-inoculated plants, whereas cluster 4 genes are involved in ABA and abiotic stress, that are found to be upregulated in salt treated plants, but not when they are treated with SA187. These results indicate that under salt stress conditions, SA187 might maintain a high metabolic rate and not activate all of the abiotic stress response pathways. Cluster 2 represents defense related genes and in particular those for ethylene, jasmonic acid and chitin signaling. Interestingly, this cluster of genes is already upregulated when plants are inoculated by SA187 under non-salt conditions.

Figure 10B:
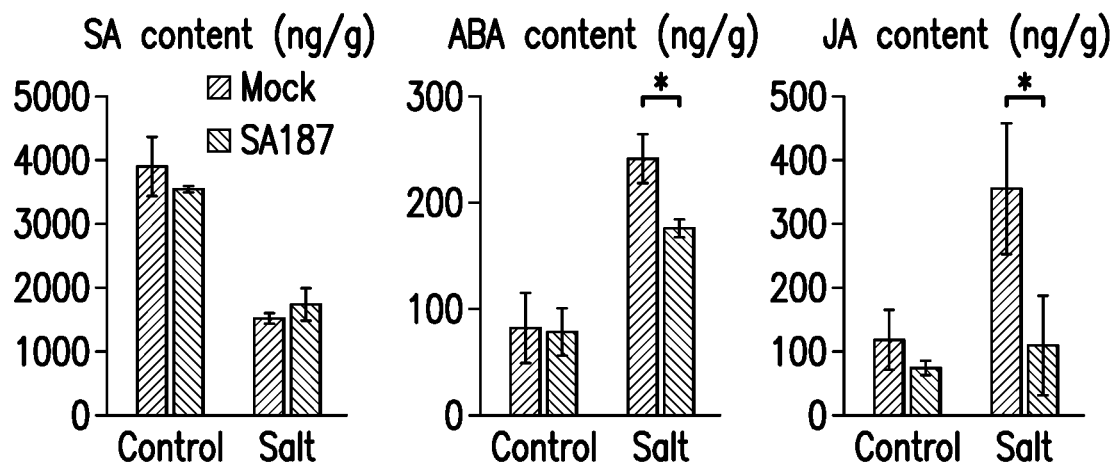
FIG. 10B are bar graphs of Salicylic acid (SA), abscisic acid (ABA) and jasmonic acid (JA) content of SA187-colonized or mock-treated plants after growth on ½ MS+/−100 mM NaCl for 12 days.

Since the transcriptome analysis indicated possible roles of the hormone pathways involved in abiotic and biotic stress, we measured SA, JA and ABA levels in control and colonized *Arabidopsis* plants. SA quantification showed that SA187 did not significantly change salicylate in the absence or presence of salt (FIG. 10B). ABA and JA levels in the absence of salt stress remained unchanged upon SA187 colonization, but their accumulation was significantly lower in SA187-colonized plants under salt stress (FIG. 10B). These data largely confirmed the transcriptome data and show that JA and to a lesser extent ABA levels are modulated by SA187 in salt stressed plants.

Example 10: Phytohormore Quantification

Materials and Methods

To complement the phytohormone quantification, hormone-deficient or insensitive mutants were analyzed. The beneficial activity of SA187 was evaluated on the JA-receptor coil-1 mutant[15] and JA-insensitivejar1[16], the ABA biosynthesis aba2 mutant[17] or the ABA receptor quadruple pyr1pil1pil2pil4 mutant (quad pyr)[18].

Hormone Content Analysis

For each sample, 10 mg of freeze-dried powder were extracted with 0.8 mL of acetone/water/acetic acid (80/19/1 v:v:v). For each sample, 2 ng of each standard was added to the sample: ABA, salicylic acid, jasmonic acid, and indole-3-acetic acid stable labelled isotopes used as internal standards were prepared as described previously[12]. The extract was vigorously shaken for 1 min, sonicated for 1 min at 25 Hz, shaken for 10 minutes at 4° C. in a Thermomixer (Eppendorf), and then centrifuged (8000 g, 4° C., 10 min). The supernatants were collected, and the pellets were re-extracted twice with 0.4 mL of the same extraction solution, then vigorously shaken (1 min) and sonicated (1 min; 25 Hz). After the centrifugations, three supernatants were pooled and dried.

Each dry extract was dissolved in 140 µL of acetonitrile/water (50/50; v/v), filtered, and analyzed using a Waters Acquity ultra performance liquid chromatograph coupled to a Waters Xevo Triple quadrupole mass spectrometer TQS (UPLC-ESI-MS/MS). The compounds were separated on a reverse-phase column (Uptisphere C18 UP3HDO, 100×2.1 mm, 3 µm particle size; Interchim, France) using a flow rate of 0.4 mL·min$^{-1}$ and a binary gradient: (A) acetic acid 0.1% in water (v/v) and (B) acetonitrile with 0.1% acetic acid. For ABA, salicylic acid, jasmonic acid, the following binary gradients were used (time, % A): (0 min, 98%), (3 min, 70%), (7.5 min, 50%), (8.5 min, 5%), (9.6 min, 0%), (13.2 min, 98%), (15.7 min, 98%), and the column temperature was 40° C. Mass spectrometry was conducted in electrospray and Multiple Reaction Monitoring scanning mode (MRM mode), in the negative ion mode. Relevant instrumental parameters were set as follows: capillary 1.5 kV (negative mode), source block and desolvation gas temperatures 130° C. and 500° C., respectively. Nitrogen was used to assist the cone and desolvation (150 $L \cdot h^{-1}$ and 800 $L \cdot h^{-1}$, respectively), argon was used as the collision gas at a flow of 0.18 $mL \cdot min^{-1}$. Samples were reconstituted in 140 μL of 50/50 acetonitrile/$H_2O$ (v/v) per mL of injected volume. The limit of detection (LOD) and limit of quantification (LOQ) were extrapolated for each hormone from calibration curves and samples using Quantify module of MassLynx software, version 4.1.

Results

Figure 10C:
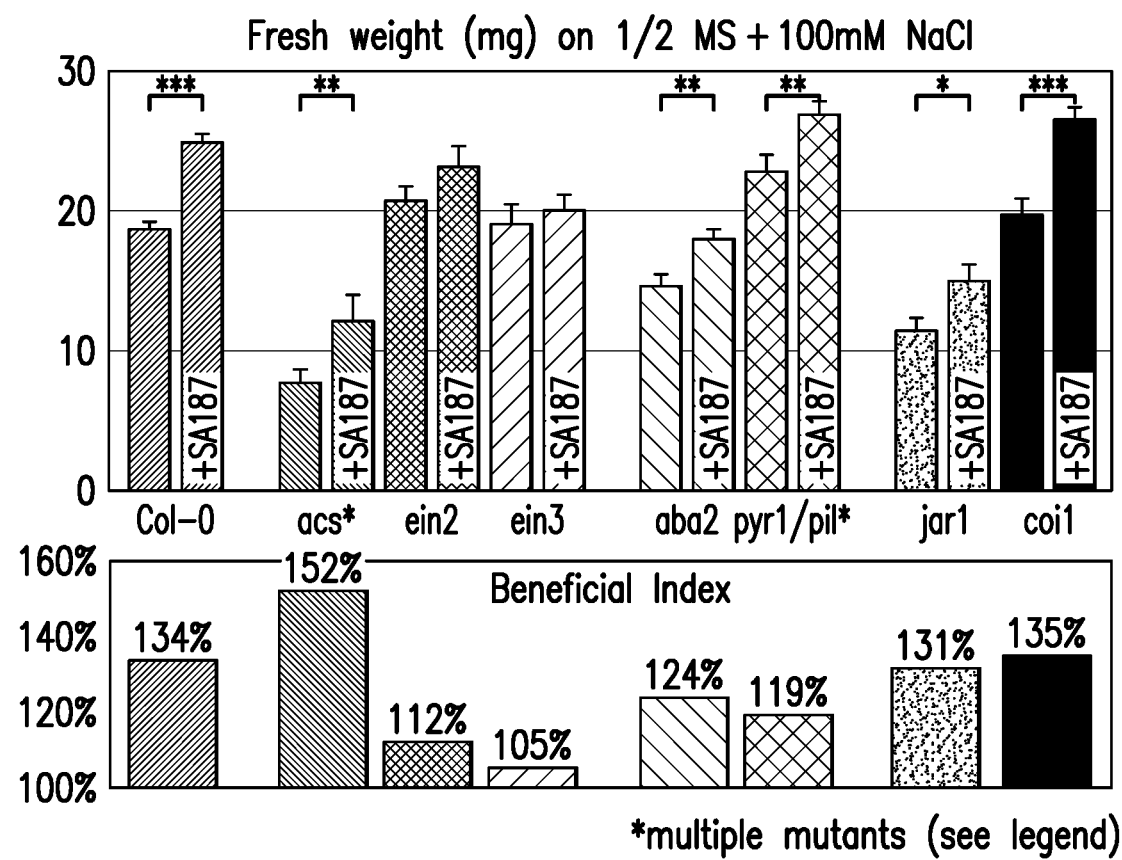
FIG. 10C are bar graphs of fresh weight and beneficial index of SA187-treated mutants in hormonal pathways under salt stress during 12 days.

In all cases, SA187 beneficial activity was maintained upon salt stress in these hormone-related mutants (FIG. 10C). However, the ethylene insensitive ein2[19] and ein3 mutants[20] were strongly compromised in the beneficial effect of SA187, indicating that ethylene signaling is a major factor in this process.

Figure 10D:
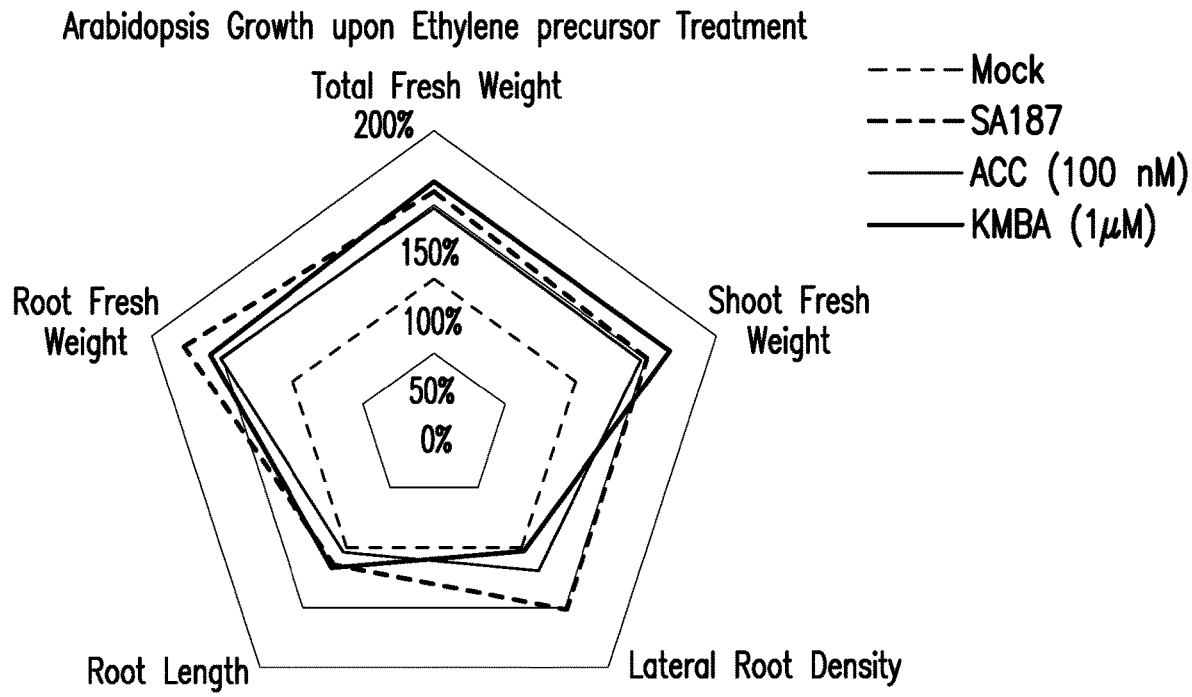
FIG. 10D is a graph showing 100 nM ACC and 1 μM KMBA partially mimic the beneficial effect of SA187 during salt stress treatment.

This result was validated by qPCR analysis of a number of ethylene-induced genes upon colonization by SA187 and by demonstrating the strong activation of the ethylene-dependent reporter EBF2::GUS in response to SA187 (data not shown). Moreover, application of the ethylene precursor ACC (100 nM) during salt stress could largely mimic the beneficial activity of SA187 on plants (FIG. 10D).

Figure 10E:
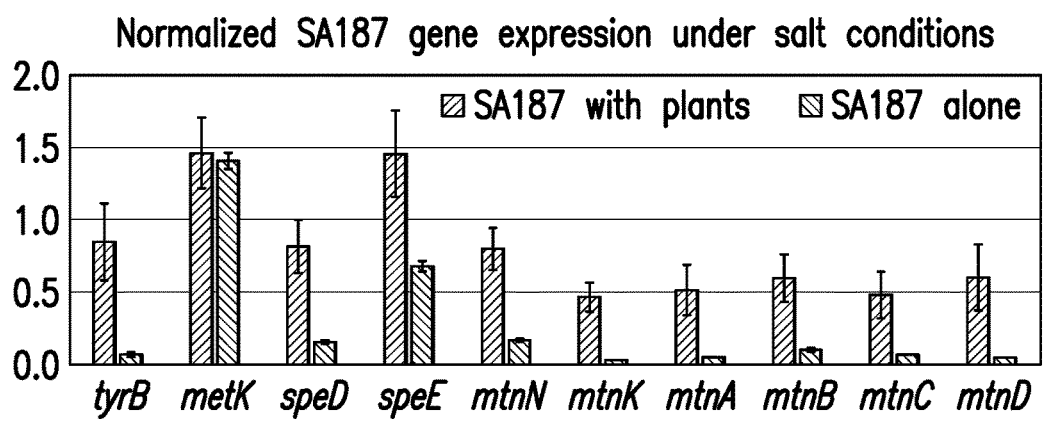
FIG. 10E shows qPCR analysis of expression of SA187 methionine salvage cycle genes under salt stress conditions: SA187-inoculated plants versus SA187 alone incubated in synthetic broth.
Figure 11:
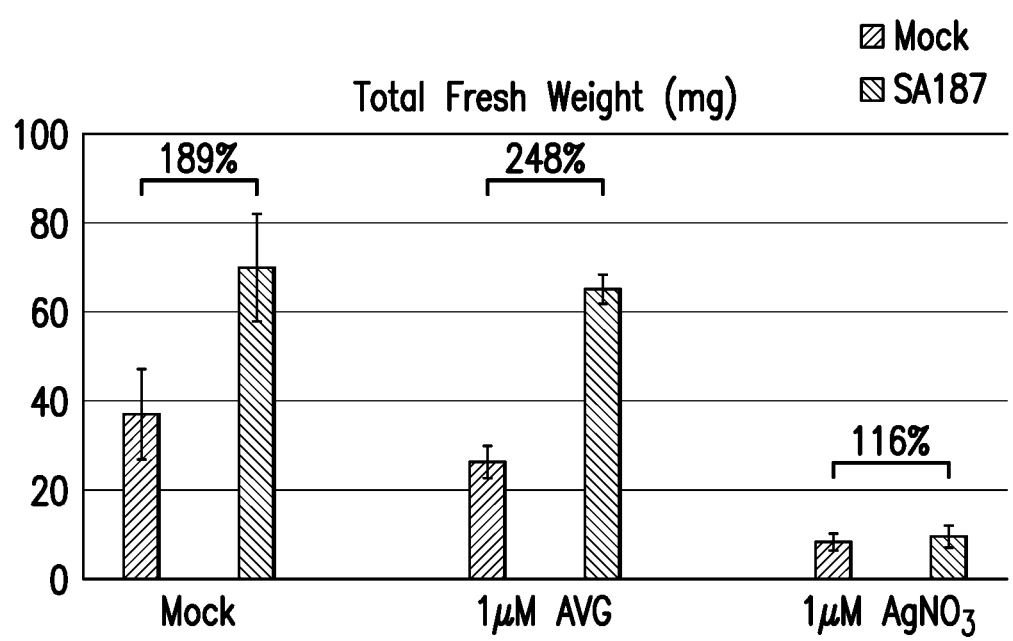
FIG. 11 is a bar graph of total fresh weight of 18-d-old *Arabidopsis* seedlings on medium with ethylene synthesis/signaling inhibitors. SD are displayed.

Surprisingly, the heptuple ethylene biosynthesis deficient mutant acs1-lacs2-lacs4-lacs5-2acs6-lacs7-lacs9-1 (hept acs)[21] still showed full sensitivity to the beneficial activity of SA187 (FIG. 10C). Moreover, SA187-beneficial effect is still existing while using the ethylene production inhibitor Amino ethoxyvinylglycine (AVG), however when they were treated with Silver nitrate ($AgNO_3$), an interferer of ethylene perception, SA187 lost its activity towards Arabidopsis (FIG. 11). This would suggest that ethylene production might not originate from plants but be derived from SA187 itself. To elucidate this question, we searched for ethylene forming enzyme (EFE)[22], or ACC Synthase genes in the genome of SA187, but no related genes were found. We confirmed our bioinformatic analysis by showing that SA187 does not produce ethylene when grown on synthetic media, However, some bacteria can indirectly produce ethylene via the production of KMBA, an intermediate of the methionine salvage pathway[23,24]. KMBA can spontaneously convert to ethylene by photo-oxidation or by peroxidases[25], which are rich in the plant apoplastic compartment. Interestingly, the KMBA pathway is completely conserved in SA187 and gene expression levels of most of the KMBA pathway enzymes were shown to be highly upregulated upon plant colonization compared with bacteria grown on synthetic medium (FIG. 10E).

To confirm that KMBA could function as an ethylene precursor during the beneficial plant-microbe interaction, different concentrations of KMBA were tested on Arabidopsis in the absence of SA187. As shown in FIG. 10D, a 100 nM KMBA concentration showed similar beneficial activity on salt stress tolerance on Arabidopsis plants as SA187 or ACC (FIG. 10D).

In summary, the endophytic bacteria Enterobacter sp. SA187 promotes plant tolerance to abiotic stresses. The capacity of SA187 to colonize both outer and inner tissues of Arabidopsis roots and shoots supports a functional interaction, using natural openings for internalization. Interestingly, based on transcriptomic and genetic evidences, it was demonstrated that SA187 beneficial activity is mediated by indirect production of ethylene through the production of KMBA, a pathway only activated when bacteria interact with plants. Although microbial PGPR activity is commonly attributed to a reduction of the plant ethylene contents through the activity of bacterial ACC deaminases[26-29], or independent of the ethylene signaling pathway[30,31], the role of ethylene in plant abiotic stress tolerance is not clear[32]. Up to now, only few reports hypothesized the involvement and activation of the ethylene signaling pathway to explain abiotic stress tolerance induction of rhizospheric bacteria, and are largely based on volatile emission or by comparison with plant-fungal interactions[12,33-35] These results strongly agree with those of Peng et al. (2014), where pretreatment with external ethylene or an EIN3/EIL1 gain-of-function mutant were sufficient to enhance salt stress tolerance[36]. Finally, an important outcome of this work is to show that SA187 can also promote biomass and yield increases on taxonomically unrelated plant crop species. These results show that the use of bacterial strains such as SA187 could provide an eco-friendly non-GMO solution for increasing agricultural production of many crops in a sustainable way.

While in the foregoing specification this invention has been described in relation to certain embodiments thereof, and many details have been put forth for the purpose of illustration, it will be apparent to those skilled in the art that the invention is susceptible to additional embodiments and that certain of the details described herein can be varied considerably without departing from the basic principles of the invention.

All references cited herein are incorporated by reference in their entirety. The present invention may be embodied in other specific forms without departing from the spirit or essential attributes thereof and, accordingly, reference should be made to the appended claims, rather than to the foregoing specification, as indicating the scope of the invention.

SEQUENCE LISTING (13 sequences)

SEQ ID NO: 1 - DNA, 2127260 bp, Enterobacter sp SA187
cggagtggacgcatcactggtgttcgggttgtcatgccaatggcattgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcgtgatttgagagattttcagctgatacagattactgtttaatgccttaaggcgttagacgaacagaatttgcctggcggcactagcgcggcggtcccacctgaccccatgccgaactcagaagtgaaacgccgtagcgccgatggtagtgtggggtctccccatgcgagagtagggaactgccaggcatcaaattaagcagtaaaccggggtgacagccggtagttgtaaagaaattcggtggagcggtagttcagtcggttagaatacctgcctgtcacgcagggggtcgcgggttcgagtcccgtccgttccgccacttatttataagacgtcttttaacgtctttgcgaaagaaaccgtatcactcaggtgatgcggttttttttcgtctgtagaaaacccactgcaaccctgcgtattacggcgttgaggcaaatgaccaacggtattacctcaccgttggtcatctcattaccgtctgattaacccttcctgtttcccgccagcgccagcgccaaacacgccaccgcaacaggacatgccagccagataaacacatctgacagactttgtgcctggctgaacagcaatccccctgacaacgatccgcaaatagaacctgcccggcctgcgcttaatgcccaactgacgcccgttgccctggcatgggtcgggtagaaagttgaagcaagcacgctcagattgttcatcgttccggtcagggtaaagcccagcacaaatatcaccgccagtaatgcctgcggatgcgcaagctgcgcgccggttaaggttaacgtgatcgcggcgataacgctggcgactgtcagtacatgcaggctcgataaacgatccagcaatgtcgccattacgatcccgcccagcactccgcccaggggcaacatagctgcgatatgggtcatttctgccactggataaccgcttttcgacaggatcagcggcagccagctggtcagcagataaaacacaaacataaaggcaaaaaaggcgcaccacagcaccagggtaacgcggatagtgtctctatggaaaagcgccgcaaccggcgaggacacctgcacggtttcgttattgatataacagaccgtctcgttttttatgcccgttattttgctgacgatatggttgagctttttacggtatcgatcgcggcccgccataaagcagagggattccggcaaccagactatcgctatcgggatcagaataagcggagcgaggcctcccaccagtagcagaccatgccactgaaagatcggtaaaatgatcccggcgatccagcctcccgctgcgagtcccagcgtaaaaccggaatagctcagggtcactaacaatattttgctgcgtgacggagaatactctgaggcaagcgtaatactgttgggcagaatagcgcccatgccgatccctgtgataaagcgtaacaccgtcatttccatcaccgaatcggtcaggatggtcgccagcgtgccggtcgccacgatcataaggcttaagatcagaatgatctttctgccgtaccggtccgcaagaattccgaacccggtcgccccggcgaacatgccaaataatccggcggcaaacaccggagccagttgctgcggcgaaatgtgccaggctttggtgagcgtcggcgcaatatagccaataacagcggcgtcaaaaccatccagcactaccataatgcagcataacagcagcactcttatctggagcgcggaaagcggcgccgcattgattacgtcagaaatagccagacgattgtcgtccatgttaattttccttgaagatgattatgttaaagagcaccgtcctgtccgggaataaataaggcagggcggtttgggtgattacagataaagcgtgaacagtaaattgagctgcgtgtcgaatggcgctgcgccatagagcgtatctttgccaggtgaataatgctgccactgcacagccgtatcccagcgcgtaaagtggtaacgaaattcgccccagtacagattgctgtcgttaacctgatcaagacgaaccatggcgttcacatccagcttatccatcagactgtcctgccagttaaaaaagaagaagatcccctcgcgggtggcgatttcctgtgaacggacgagataagcgctataagcggcctgcatagccggaggcgacgtcctgagtttttcccattcgtcacggttgggggcggcttcgttatactgatactcagcggtcagcgagattttactggcggaggtaaaggttcctccgacggccagctgtgagcgaaaatgcccggcggtatcccgttgccaggctttgtcccactgatcctgctgtttgcctcccgcccactctgcatagagcgtcgtgttgtcattcagcaacagacttaaattgacgcccgtctgcaaagcttcgtcttcggagaagagcgccagaaactgtggcttgagccggtcgtttatctgtggactgtaactcagctgtccacggtgctggttattggtgctgcccaaatccgcgctgaaggaggcggtgctgctttcctgcgacaggcgcggcgaccagagcagggacaccgcgccgctgtcccacagccactgactgttcagcatcacgctgccctgacgattctgccgcaggctggtcggatcgatatcggtaacgacgcgggttgcgccatcgcgaaaccagtcggtcggcgaatagccagtcgcaacgccgttgcggatgttgatccgtccggcatccaacgccagcccttccacgggctgccagttcaggtaaccctcctgccaggtatttatggtgtggtggcccgtcaggccagcggtatcaaggtgatccagccggtcgcgaaacaccagtcgcagggtgtcggtcaggccgctgtcgaggctgaactgctccgagccgcgccagtagcggctctgtccgtcgtcacggttctgatagcccgccgcgccgtcgatttgcaaacgccaggcttttggcgcggctgattcaacagccgcttcgtccgccagcgccagcgccgccagcgaactgtcatcagcctgcgcccccgctgccattaacagcccgcaggctgaagcaatgatgaacggtttcatggcgtcgcatctgcccggaagttgaccagatagtcgcgctggaaccagcgttccgggatgtcacgaaagtgataatcctgattgcgcataatagtgacgagctgcggatccagtccgtcaatgatcacgatttcagtcggacgcgatgcccccagctgttgctgataacggcgataccaggcggttttcagcaggcgctcgctctcgctgtaaaactgcgctttgatcggatcccagccctcttttttcacccacagctcaatgtggtgatagaccgcctgtggcgtgctggcctttaacgtcaggcggatgctgacctgctgcttacggtggccgtcttcaatgacttcttccgcctgggccgtggctttatagtcggcggcaaaattggtggataccacatcgccattggctgcctgtcccagcaggcgctgctgcggcgaaatacgcacgctcgctttgctggcgggctcatagaaccagatgtcctgatcctgtttaagcatcagcttaccggcatcgcgctccggcgcggtaaagcgcagcagactgcggtactgaccgctgcgcggatccggacgggaataaacgatcaccgtggtggcgtctttctgtttgccgttctgataatccagcaactgagtggtcagtgaaaaactttgcgtcgggttacggatcgcatcgctggcagagaggatcgcctgtggatcctgggcggcaaaggccgctggcagataacacaacaggccgcagaccatcaggcgagcgcgcttccttgtaaaaaacatacacttttcctttcgtttgattcagacatgccgcagggcatcgataatgttcagaccggccgcccgtcttgcggcaaagccgacggcgaatacggccagacaggccgcgccaaggctgacctgcgcgataagcgccggatggctcgccacgttcgccagtaatggcactgaataggtcatgcccggcggcacccagcgcagggagaacaggcgcagtgctgcatcccccgtcagcgccagcgcaatgcccgcgccgcagcccagcagcaccatcagcaggctttcagtgacaaacaggccgatcacgccgctacgctgtacgcccatggcgcgcagcgtgccgatttccgtggtgcgctccatcaccgccatactcatggtgttgccgatcatgaacatggcgacaatacccaccagcagcgacgcaaggccaaaaaaggtatcgaacatatgcataatctgaccgtgcatcgggttaagctcgaaaacgtcatgcagctccaggcgctgatcggcaaaggaggtcgccatcagcatgtcgatccgcgcccgcgcggcggcaatctgatcggtgtgcgcaagctgaatgataatgccggtcacgcgacggtctcctgcgccgaagaccagccgttgcgctgtcgacagatgcatcgccagatagacgttatccagcggctgtaagccctggtttagggcatcgatcaccgttagccgcgcaatatcaggcgcgccggtcagacgcgtggtcagcacatctacctggcggtcggtttgttgcgccaggctttgcgtctgctgactggcaagcgcggcgatatcctcatccagcacggcggcggcctcgttatctgccacggcagccgacggcggcggacagtcctccagcttcagcgtatggcacagtccgaggatccgggcaacgccggtaccgataagcgcgctgttctccccggtgcccgccagcgggtaggacggtgtggtgatcgggtagttatagtcattccactgctgcaactggttttgctcgtcagggatcacgccgctgatcatcacctgggtggaggtctggcgcaggaaattaccggcgatcccgccggtatccagcaccggcgtcaccacgcgcagcattggctttaacagcggatcgttttcgagagtcgcgatcagccgatcgctgtcggcaatgctgaaggcggtgggattgccgctgccgagcgccatatatcccgcgcggtgaagttgcagatggcccgcgcgctgcacataggcggtttccagcccgctggcgatgtcgctgacaaaaccgccgaacagcaacagcgcggcggtgccgatggtcagcgccagctgcgttgaaagggtacggcgaccattacgccgcagattacgtaacgccagacgcagcaatttcatgacgcctcccggactaactggccatctttcagggtaaagaccctgtcggcatgggcgatgagctgcggatcgtgcgaggaaaaaacaaaggtggtctggtgctcgtgctggagcctgcgcatcagcaggataatttgcagcccggtggcgctgtccagattcgccgtcggctcgtctgccagcaccagttttggggtatgcgccagcgcgcgggcgatcgccacccgctgacgttgcccaccggataattcccccggcatggcgtcggttttacctgccagcccgacctcatcaatcaggcgggccacgcgcgcgcggcgttgcgccggcttcatgccgcacatcagcagcgggtattcgatgttctccccggcggtcagtaccggcagcaggttgaagttctggaacacaaaaccaatgtgggtggcgcgatacgcggtcatctggcgatcggaccagccgcgcaccgactcgccgtgcagataaatctcgccgtcgtcctgcttgtcgagacagccaataagattgagcagcgtgcttttaccgctgccggaaggccccgccagcacggaaaactggttcgcagggatcgcaaggctgacgtcgctcagcgccgctacccgctcccggcccatctgataatattttgcaaccttgctcagggtgacggcggtcatagtgcctcccggtactgccagctgatgtccgccaccgaggcaaaacgcgcgggcacccgccagcgcagcatattttgcgtgatatccagcatgtgcaggctcatggccgccatcagccgtggcgcggaaaccccggcgaacatatcgcgactgcgggcgatctcccgtgccgtgtcggcacgctgttcggcgctggcgaaacgcgcttttgaacgcagcatgcaatgaaagctgcggatatccccctcatcgggcagcagtacgggcgcgtcggcatcccgggcgttcagcagcctggccccggcgttatccagcaacagcaggccgttggtggcgcgcggattacactctacgatggccaggccgtcccgcgtctccatcagatcgaagctgatttggccgctgagggaatgctgagcgataaagcggcggcagaaggcttcgacatcagggtgacgcagcgcctcaaagccgaaggccgcgctctgtttccagcggtggcggggcagatagcaggcgtgggccagcagtttacccttatgcgcgaggttgtaggtgcaaagttcacgaccgatcagcttttcctggattagccagcggccgccatcgcggcgggtgagttgcgcttccatttgggggatggacggatccatgaataccccatgaccgaagctggaaaactcctgtttaagcagcggggcgcgataatcgacagaaaagcggcgccagtctgccacgctgcccaccacctcagtgcgcggcgtaatcagccccgcatctttcgccagcgccagcacctcgtatttgctgtgcaaacgggtaatcagcgtatccgacagggcaaagagttcgatggacggatccagccgcccgagggcatgctgccgcgccagccagaagctctcttcaaacatcggaataaggcgtgtcgccggggcctgttgcgccagccggtttaccgcctcaagaaaacgctgcggatgggcgcgtaaacagggcaggcgaatgaaaggcacgtccggcgcgataagttttgaaagcgcggcgcggttgctgtcgatagccgtcacctgcgcaccggcctcctgtaacgaacgggcaaaccaggcggcgaagggaaagcgaaagccgctgattaaaaaccgggatgtattcataacgatgcttcttccctgagccagtcgatcatgctcgccgcaacctgcggcagagcgtcatgtttaagcatttcatagtggttagcgttcacgcggcgcacttccacggcggcggtaaattgtccccagccgtagtcgcgctgttgcaggttttgccggaactggttcatcgcctgggtcagcgtttcatcgcccagcagccgcagcgagagatgagaaaaccagtcgatgcgattgcgctcgccgcgcagcaacagcagcctgaccgggcaggtctgcggccggtagcgcatgacggcgttattgatgctgatataggtagccagcgtgcgctggatttgctgcggactgagccgccagctccgcccgccgacgcgatagctgataaattccagcgccttccagcgtggaccggcaggcaccaggccgagcagcgagccgagcacgcccgccgccagggttttcccccattgcgggatcaggcgcagcagcgggcgttccgcggataccagaccgagaaaatcgcgcaggaacatctggaaatagagtttttccgacggcggcggaacgtcataaatacagaaggcgtcgataaaacagaggctgactttttccccggcgcaggccagctgtcgcgccatctcaaaggcggtctgcgcgccgaaagagtaagcgccgataaaataaggcccgctgggctgcgtgctgcgtaccgcctgaagatagtaagcgctcatctcctccacgctgtcgagcggcgtggtgccttccgcaatgccggaggcctgcaggtaatagacgtcggcataaggccgcaacagcggcgtcaggccggtgtagtgtgaaatattgccgtccccggcgtgaaccagaaacagcgatggccgcacggtggcgttggtcttacccattattcatccctgatgtcgttatgtttagcggcggcgcgtccttccccgctgcgccgccgtagtgcatttacgctttgataagcgggcttgccacagccggtttcagcggcctctgttcttccaggagctgtttcgcgttggggcggcggtacatatcctccagctctaacgtcagaccataatcgctgcgcagttcatagaggatctgcacgatcaccagcgacgtcgccccgtaatcgaggaagttcgcttcataaggcagatcctggccgatgtacttctggaacacggaaaacgcctgcgggtgcgcggcaggtttttcagaatcgctggtggtctggctgatgagcgtcaatagcgcccggcggtcaaatttcccgttagcggcattgcgtggcagttcatccaccagatggatatgctgcggcaccagccactccggcagatggcgctgacagtgctggcgcagggtggcgacatcgcagccgggggcgaccaccacgctgtgcaactgttttagcgccccctcgctggcaagcgtggtgcagtacaccacctgcggatgcgtcatcagcgcgccgtcaatttccagcgggttaacccggtagccggaaatcttcacctgaccgtctttacggccgaagaaggtcagcccctcttccggcgaccagcgcaccagatcgccggtggcgtagcgttgcggcggcaacaggccctcccctggcgcgatgaacgggcgatcgcagtagccgcgtgcgacgtgacgccctgcgacaatcagctcgcccagacatcccgccggtacaggcaggccattttcatccgccaccataaaggcgcaatggggcaggggctggccgatgggcacgccggttttgcggtacgcctccattttttgcgcctcgacctgcccggcgctgacgatacaggtggcttcggtcgggccgtaggtgttgaatagcgcaggcgtgcgcggcagcgcgaaccagtgttgcagcgtttcgtagcgcatctcatcgccgccggtaatgagaaacgccaggctggccgggaagcgcgcctgtctctcctgcatccagggcgtcagtagcgaccagaacggcgtcggcagcgaaatgtgcgtcggctgccagcccatcagcagatcaaggaagacggcaaagtcacggcgtacttcccggtcatcgcttgtcagcagcgtgccgcccgcgcacagcgtgccgtacacttcttccacgctggcgtcgaaggtcagcatgttgaattgcagcatgcggctgttgcgatcaagggtatagagcggaatggcgctggcgataaaggtcgccagcgcagagctttgtacacagacgcctttcggttcgccggtggagccggaggtgaaaataatatacgcatccacctcgtccagcgccgtcaggtcgggctgccagagcggtaacccggcgctgtccagacgcaggcggtgtttacgatacagcagcttgcctgcgggttcggaggtatcgccaatgatcatccggcagccgcaacgcgtcagagcggcgtcaagccgaccgctgcgcagatcttcacaggccagcggaatgtagcagacgcccagcgacaggcaggccagcatagcgatgatggcatggtggcgtgtcgacagacagagcgccacccgatctccggtcttaagcccgtaggtggtcagatcctgggcgcagagatagaccgcctgccacagttcgccataggtgagcgtcagcgtcggggtttccagcgcgatacgccaggggtcatcagcggcatgctggcggatgaggctcagcacgtgaggggccacgggcagatcctgctccggctgaagcgcaagcgcgggaaggctgcgccttaccttttccagtgccagccgctcgcctgcctgacgcagataatgcacgcagctttgcgcgatacgttgcagctgtggcgcgctgaacagcgtcccgttgccgatgaaattcagttcaatatcgttatccgacgcattcaccatcagcgacaccggcacgtcatcgtcttccgcttcgtagatccactctacgctgacggggagatcgccaaattgcagggtttcctccggcacatagttgaagtgcaggctggctccccgggcggtcggcgcgtcggcgctgcggatttccagggcaatatcgtctgccagctgttgcaggctcgcgcgggtatctatgttgagcgacagcgtgcgcggctccatcatcaggccgaaagtctcgcgccagcgtgccgctttgcggttatgggtaaaaatgccgatatccagcgtggattgctggcaaacatcggcaaaggtggcggcaaacgcggccagcagcaggtttgcctgcgcctggtgtgggcgtgcgggcgaaagggcctgcgtcagttgccggaaatggcgcagcgcgtcaccgctgattttctcctgcaccagcaggttatgcccgctacggcagtgcgcggcggcaatgccatggaagctcagcggcgcaggcggctgtggcatcagtgcctgagacgcgctgaacgccccgggcagctgcggataatgacactccggcagaacggcatcgggcgcgtgatagcggcgggacaccgccgtaaacatcacccgcgcggcgtggtgatcgtaaatcagatggtggcagcggaagaaccagacaaactgctgctccgccagctggaacagccacgagcccgccagcggcgccagcggcgaccagggctgcttattcagacgggcgatctccgcctgcacatccgcatcgctgttgcgtaaatcgataaactggtgagggatcccgcacatctcgtcgtgccacagcgtgatgtcacggccctgctgctgataaacggtgcgcagtgcggtgaagtgacgcgtgacgtcacgcaccgcctgcgccatacgtccggcatccagcggcgcgttgatgctgtagctttccccccagttgtaggtcagtacggcaggattgcgcgccatggcgttaagcatgggctgctgctggcgggttgggttgagtcgtttcagcggtgccggacgcagatgcagcggttcgatagccggaagcggctcttgtgccggaacggcgatcagcctgctcagcgcctgcgccgcgcgtttgaccagcacatcgacatcatgctgcgccgcccattgcgcgttcatatccacatgcagcaccaggccatcgcgacgggcatcggtgcgcagggagaacaccacggacgcaccgtgcagaccgccgcccgcccagtcattcagccccgtcagttcttcctcatcctggcgggaggtggcgggcagaatggtgaacaccacgtcactgttgatcggcgcgccggcaatctgattaagctcgctcatggagatctgccggttgcggaacaggcggaacagcaccttctggcaccgggcgatccattcctgtaacgagcagggttgcggcacggaaaataacgtcggcagcagggtaacaaagtttcccagcgcttccggatccagtcccggtttatcacacactggcagccaggcgaggaagtcagtttcatcgctgaccacatgccacagccagctcatcacgctgtaataaagcgtattgagctgattttccggcacgcccgcgtgtcgcgccagctgcgcctgatcgcagggaataaaaaagttgcggcggatgatgcgagtggacgacagcgccggtttactgaacggcaataacgtaggcagggtttgctgccagtagcgggtgaccgcaggcggtgtgatttgcggcccgcactgctccagataatcgcagcgcatctccggaagcgcaccggcatcgtccacgcgtttgcggctggcgctgtagtccagcgccatggttttcaggcggcacagcgacagtccatcgacaatggcatgatgaatgcggaaggtggcgaccaatcgatcgccacagtaaaacaggcgggcgtcgtacagcggcgcgtcaaacagctctgcgggttcatattgccaggcttccagcatcccggcgatggtgtgggcgtcgcagacagtgggcgcggtgtcccactgcggcatcaggccgtccacatactggcgaataccctcgtcggtgcgggtaaagcgcacacgcaggatcgctttatcatgccacaggcgcgtcagcgcatccgtcacccgctgccagtcgtgaccggcagggaaagacaccgctgaaaccatctgaaagcgttcgctgtgcccgtggatcgcctggctcatgacgatttcagtttgctgtcggtataaagggaaggttatacgcgctgtcacttttgccctttctcccagttcgcgatgtgcttgtgggcggcggccagcttatcggcgtccattctggtctgttcaggatggaagcccggcaggaaccagggcagaaaatctttgatgatggtgacgtacaggcccttccagccatacagcttccacagcgtgccgggaatgctcgccagggtaagttcaccgcgggctttcatcgcgccggtgctgagttttaacagcagcagggcgaagatgaggaaagacgccagcgaccagacaattcggtgtggatagctgccgccggttttcatataaatatcgaaaggcacgctgcggtgctccacttcttcaatggcgtgccagtaccacagggctttcatttcatcgctcgccccctcaagccagcggggattgccgatcacctgtttgccgccgatggacgtcaggtgctccagcgcacaggtgactgcgagctggttacgcggcttaaggctgcgcagccaggtgaagcagcgacccagcaggcgttcgtttttttccacgaagcgctccggcaggcccagcgaacgattatatttattgtgccagcgcgtgtgctctgcttcctgatagtaaaaacggcgggcaatctcctgcgcctcttccatatcgggatgggctttcagcgtctgttttaccgagttgataaacaggcgttcagcttccggaaacatcaatgacagcgcgtcgagatttgccgcaagcgaggcgtcgcgttttaaccagtaaggatgctcttcatccggcgtgaatgaaaagtccatatggcgtagcgtaagttctgaagttaaattccctttcatcgtcattccttaatcagtagtggttatcaggcctttgcagtggaggaggtgcggccatgtttacggtgcgccgtcgcccaggtgtggctggccatcgcacaggccagcgaaagttcgcccgccagcacagtggcggcgacaatttccgccagtttgttggcttttcctgcgccctgacagcccagcagggcaagacccgcctgagcatagggctggttcacgccgccgccgacggtgccgacgatcagcgacgggatggtgatggcgactcgcagatcgccgtccgtcgtctggcgacagtccatgatcatgctgctggattccgccacgcaggcggcgtcctgtccgagggcgataaacagggcggcgataccgttggcgctgtggcaaccgttgctggtggcacccgccagccagccgcctttggtcgccagccagtacagctccataaactgttccggcgtggttttcatcaccttgtaaagctcgttcgcgggcacaacgatctcggcagatacccggcgtccacggccgctgatcatattgagggcggagtgctttttatcggtgtcgaaattcccggacagcaaatagcggtagggccacgggcagtggtcgaggagccataaacagagcttctcggtcacgatagtcaccatgttttgcccggcagcgtcgccggtggtgtagttaaagcgcacaaacaccgtgcgatccagcggctgcacgtcaagggaacgcagttttgcaaagcgcgaatgctcgctcacctgctgctgtagcgccggaagttgcgacggcaaccagtgggcaaaggcggtggcatcgatcatgctgtcgaagcaaaagaccggcgagcgctgcatgttctcgccgctgatcaccgtttttaccggattgtcggcgttgaacagcttcatcccccggtgatagctggcgaccattgagccttccgtggtggccagcggtacataaaatccgccgctggcgtactggccctgcacatgtaacggcccggcgatgcccaccggaacggacgccgtgccgatagcgttctcaatattgccttttaaggtttcggcattgagtgactcatcaaacagcggcgccagcgacacgccggtgtgctgttccagaaactgatgacgttcatgaatatcggcaggcagaaagtgttgcttgctgaagcggcgcggcaggggcgcggcggcggcaatggcctggcgtttgcgcatcagcttgccgttgccgttacgcggcagcgcagtgacgatatgaaagcagtgcggcagcttgtagtaactgagctgtgtggcgagccactggcgcaggacgcccacatcaaaggtggcggggtcttcaggcaccaggctggcaacaatgcgctgagtgatctctttgtcgtcctcgcccgttaccatgcactctttgacagcgccggatcgcagtatggcgttttcgatttccgtcggatcgagagtgaagccgcgggtaatgataagattgtcgattcgccccagatgacgaaaatacccgtcgctgttttgctcggcgcggtcgcccgtgatcagccagcctgcaaaggggccgcttttggcaagcgctctgtccgcgatgagaccgcgtactgccagataccccggcatacctgccggcagatgctggcctgactcatccagcaccgccacttcatagcccggcagcgctttgcccgtccagccggggcgggcgtcttcttcgcgggtggagataaaaatatgcagcgcttcggtgcatcccagcgcatcggttaacaccagcccggtggcttcacgccactggagggcaagatcttccgacagggtttcacccgcagaaatgcatttgcgcagcgttgatgtcgaccatccggctttcagtaaacggcgataggcggtaggcgcggtaaacagcaccgttgcctgaaaacgcgcgataatctctggcagcgttttaggcgacacttcccgaagtaataccgaactggcgcccaccgtcattggcgcaaagataagcgagcctaaaccataattaaaggagagcggcgcggtgcagacaataatgtcggcaggctgaggttttaatatattaacaacatagctttcgcagttggctttaatatccccatgactgtgaagcgttattttaggtttgccggtactgcccgaggtaaaagcaatgagggcaatgtcgctggcatggctttctggccagcaaaaagatgcagggactgcctcgagcagggagtcggagataaattcattattttccttttctgaatcaatgctaatcattctggaaaatagcggatggtgctcatcggggatatatttttcccgcaggctttcatcaataataatgagcgcaggggaggccagttcaataatattatcgaattccaccttgcttgatgccgggttcagggtggtgatgacgccgcccgcccgtactaccgccagccagcacagcgtctgggcaatactgcatggggcaagcaacgctactctgttgccgggcttaaagttatgtttaatcaacaaattcgccgcaatgagatctaccgttttcttaacatcacggtacgtccagttattgttaagcgttctgaaacaaagattatccgggtgcggcgtctgatttattaaccaggctgatatattaagtttttctgcttcctgcgaaagaaaagatgaagaactattggcaacgtccattgttgtctctgtaatatataaatgatgtgaatatgtttcttgtgaaaaatccttgagggacaggaatgtgcgtaatttcctattgcacttgtaactaagtgtataggtaacagaataacagtgtcaatgggggactgaaaattgaaatgtctgcggcaattaaagaccgagttgtgaaacgattttatcaattaaatgaaagagtttcctaatgcccgaaatataataaaaaatagcgattaatattatatccaccaggataaagcctaagccaggcggctaataagatacgctcttttttaacgggtatgctcgctgagaaaatcaataaaggcgcggatgcgggtacttaccgcccgatcgctgtaatagacggcgctgaaaggcatatccaccggcaggcgcttcgcaggcaacacttctaccagctcgccgctggcaatttccttatcgatcatataatccgacaggcaggcgatgccgttgccgccgagacacagctgtttcagggtttccccgctgttcgatgaaatgccgcaggtgatctcataaagctgtccatccgggcaggcgacaggccaggtattcagcgaaaccggctcggtaaaaccaaggcaggtatgcttctcgagatcctcaacggtttcaggtgtgccatagcgtgccagatagtccggcgaggcgatcatgcggcggtagctgctgaacagcgggcgggcgcgcaggctggagtcggtgagcttacccacgcggatcgccacatccactttacgctcaatcaggttgatgaatgtttcggacgagaccagcgacagcgtcatttccggatagcgttcgcggaagggtttgatgagcggcattaagtaatgcagcaccaccggtgtggcggcatcgatgcgcaacaggccgcggggcattaatctggcttccattacttcattttccgccgccgccatctcctgcaaaataagctgtaccctgcggaaatagcgctcgccttcttcggtcaggctgagctggcgggtggtgcggttgagcaggctgacgcccagcttcatctccagctttttcaccgcccggctgacggcggagttagcctggcctaattgttcggctgcccggctgaagctgccgctttccaccaccgccacaaaaattgccatctcttccgatgtcgccttcattattgcccctgtcgcaaaattattacgctattttaatgataactgacacttatgcatcatagttttacgggggcgcaggcggagggcctggtcccattaatgatgttttacccgaatagcgttgaaagtgtgcgctaaaatccctataacagaaaggctactctgcttccggggcggctcacagcgacagaggtttgaaaccaaaagtgcgaaagaatacctatgctatgcgctatattgccggtcaacctgctgagcgaattttgccgccaggttcattcgcgagcattggtcaggcactgccacctggcgcgcccttaagcagtgacgataagatccgcgtgctggtgtggaacatctttaaacagcagcgggcggaatggctctctgtgctgcaaaacttcggtaaagacgcccacctggtcttgctgcaggaggcgcaaaccacccctgaactggtgagattcgccaccaccaactatctggctgccgatcaggttcccgcttttgtgctgccgcaacacccctccggcgtgatgacgctctcctccgcgcatccggtctattgctgcccgctgcgcgagcgcgaacccatcctgcggctggcgaaatcggcgttggtcacggtatatcccttgccggattcacggctgctgatggtggtgaacgtccatgcggtgaatttcagtctcggcgtcgatgtttacagtaaacagctgctgccaattggcgatcagatcgcgcaacataacggcccggtgatcatggccggagattttaatgcctggagccgccagcgtatgaacgcgctgtaccgtttctccagagagatgtcgatgcgccaggtgcgctttactgacgacaaccgccgtcgcgccttcggtcgtccgcttgattttgtcttctatcgtggtctgaacgtggatcaagcctccgtgctggtgacccgcgcctccgatcacaacccgctactcgtcgaattcagtcccggcaaacctgataaataaaggcgtgtcaggtctgcccctgggcaggcctgcaaccatggagctgcccttcatttaactcacagaaggatgacaccatgaccacgcaatcccatcacgatcacgtcgaaaaacagtttggctctcaggccagcgcctatttaaccagcgctgtacatgcctctggccgcgatttacagcagctgcggacgcggctggccgaacatgccggctcgcagcttctggatctgggatgcggtgcgggacacgcgagttttaccgccgctggcgttgtggcgcaggtgacggcttatgatttatcggcacaaatgctggaggtggtggcgaaggcggcgcgggaaaaaggactgaacaatattgatacgcagcagggctatgcagaagcgttgccttttgccgatgcctcttttgagttggtgatcagccgctattccgcgcatcactggcatgatgtcggccaggcgctgcgtgaagtgaaacgcgtactgaaaccgggcgggacgctgattattatggacgtgatgtcgccgggccatccggtacggaacatctggctgcaaacggtggaggcgctgcgcgacacgtcgcatgtgcagaattattcatcaggtgaatggctgacgatgatcgctgaggccggactgatttgccggacgctgaccaccgatcgtctggtgctggagtttgcgtcctgggtggcgcgcatgcgtacaccgcagccgctgtgcgaggccatacgcttataccagcaaagcgcatcccatgaggtgcaacgttatttcgaattgcaggacgacggctcctttaccagcgacatcattatggtcgaggcgcagaaagcgcaataaaagcgggagaaataaaaaaggcaccggggaagcggtgccttttttcatcatcaggagtcaggtgtcgcgctgttcttcacaaacagcgtcagctgatcgccaggtttcaggttatcggtactgtcgttccagcgcatcacatctttgatgttcacgccgtgacgtttagcaatactcgacagcgaatcgcctttgcgaacgcgataggtaatgctatcgctgttgttcgccagggtctgcgcgctgctgcccgcaccgacggtcaggttctggccgaccttcaggcttgcaccccgcagattattccattgctggagatctttggatgtcacgccgagacgtgacgcaatgccagaaagcgtatcccctgaacgtactttatagcttcggctggtcagcggtttattatccgcgagcagcgtcggctgtacggcagcgatttcgccggaagccagtgattcacgcagctgttctgcatgtttctgcggcaccatcacatactgagggccgctcgaaccgagcgtcgagcctttaacgcctgcgttaaaggttttcagcttgttcacgggtattcccgccatttcagccagctggttaatctcaaccgggctgttcaacctgacgcgcgccagcgcacgactttcatctgtagaaggcagacgaacgccataacgcttgctgttcttgagaatatcgctcaaagccagcatttttggcacgtaaatcctggtttcctgtggcagtgaaagagaccaaaagtccgtgggtttaccccgggctttattcgctttcattgccttcagtacacgaccttcaccgctgttataggccgcgactgttaataaccagtcgccgtcaaacatacggttcagacgctgcatcatgtcgagcgcggccgttgtggacgccactacatcacgacgcgcatcgtaattgcgtgtctgttttaaaccataattgcgccccgtgctcggaatgatttgccaaatgcctgcggcattggcaccagacgtcgcgtgtgggtcaaaagcgctctccactatgggtagtagtaccagttccatgggcatgttacgtttcttaacttgccctgctatccagtacatatacggctctgcccgtaaagttacatcgtggagatagctcttattgttcaaatacttctgtttctgttcgcgaatccggccattctccggaattcccatctttagctcgtcgccaatgagagcccacaagtcttgatcctgcgcgaaggatgtcccatcgtccatccagcgtgcttgactcgtaaactttcctgcttccccttgaccagctgcagaaaggctctgtgcgtgctgttgaacgttgccatcttgattagcctggcaacccaccagcaggacagaggcgagtaatatcgcttttgccttcatgtgtgtgtcaatagttgcttaaaagacgaccgatcataacggcgatgtttgcagaagacaagcataaccgtcagaagtcatctttctttgcccgcaaccaggcaaaacgctgctcaggctgttgcaaatttgtttctttatttatttgatcaattaaaacagggtcttgcgtacgtaaaaataaatttatatggcgttcatttttcagaaaaacgggtaatgtcttttctttttttgcgcgtaagtctttaactttattgtagtaatcatttatgagcgaatcgtgcggtaggatgctgcgggcaaacttcatattggctaacgtgtattcatgtgcgcaacaaacgagcgtttcgtccggaagggcggcaattttgacaaaggactggtacatctgctccggcgtgccttcgaacagtctgccgcacccgccagaaaacatcgtgtcgccggaaaaaagataagggaaactgaagaaacagatatgtcctaaagtgtgacctggcgtggaaaacaccgcgaactccatacccaaaacggtgattttatcgccctcggttacaatttctgtcgtgcctttaccctgggtttccgccggaccgtagaccggaatatcgggatactgttgcagtaacgtcttcatgccgccgacatgatcattgtgatgatgcgtcaggaaaatagcggcgggctgccactggttttctttaattgcatccagcaccggcgcggcttcgcccggatcgacaatcagacagcgtccttcgtcgttgctgagcacccagatgtagttgtcctggaaggcgggaatactgttaagattcataattacctctcaaagcgtagcggaaggttgtgatgaaggcggcaaggatacctcaaacatttgtggcacccgaacactggagtgactttcccgcaggcgaacattatcgtgccgcgctggaactgcaactcaagccatggctggcgaaaatctatggatttcacctgcttaagattggcaatctcagcgcagaaatcaatgtcgaaacttgcgctatctcgcatcaggtcaatgtagcgcctcagggcgacgccttacaggtgagggcggatccgctgcatttgccgtttgccgataaatctatcgacgcctgtttactggcacacacccacaactggtgtggcgatccgcacggcttattgcgggaagcggaccgtgtgctgattgatgatggctggctggtgatcagcggctttaatccggtaagcctgcttgggctgcgcaaactcgtgccgatacgccgacagtcggcaatctaccgcagccgcatgtttaccatgatgcgccagctggactggctatcgctgctcaactttgaagtgctgcactacagccgctttcacgtcttaccctggcgcaggcagggcggaaaaatgttgagcacccatttgcctgcccttggctgtatgcagctgattgtggcccgcaaacgcaccatcccgctgacgctcaatcccatgaaacagagtaagagccggcaacgcgtccggcaggcagtgggtgcgacgcgtcagtttcgtaaaccctgatcaggcgtctggctgataaccgatgtcgtcctgagtgggattcatggccgccgcgcgcgccagctcatcgcagcgttcgttctccggatgtccggcgtggcctttcacccactcccagcggatctcatgctgaccaagggcggtgtccaggcgcttccataaatcgacattttttaccggttttttttcggcggttttccagccgcgttttttccagttatggatccactgcgtgatcccctggcggacgtactggctgtcggtgctcagcaccacttcgcagtgctctttcagcgcttcgagggagacaatagcggccatcagctccatccggttattggtggtcagccgatagccttcgctgaaggttctttcatggccgcgatagcgtaatattgcaccataaccacccggacccgggttaccgaggcaagatccatcggtgaaaatttctacctgtttaagcatctctggtagacttcctgtaattaaaaacggcaagtaaaacgataagtctgacataaatgaccgacatgagcactgcaattacacgacagatcgtcctcgataccgaaaccaccggtatgaaccagcttggcgttcattacgaagggcataaaatcattgagatcggcgcggttgaggtcatcaaccgccgtctgaccggcaataacttccacgtttatctgaaaccggatcggctggtggatcctgaagcttttggcgtacacggtattgccgacgagtttttgctggataaaccgacgtttgccgacattgccgatgagtttttagattatatccgcggcgcggagctggtgatccataacgcctcgtttgatatcggctttatggattatgaattcagcaagctgaatcgcgggatcccgaaaacggaaaccttctgcaagatcaccgacagcctggcgctggcgcgtaaaatgtttcccggtaagcgaaacagcctggatgcgctctgctcgcgttatgaaatagacaacagcaaacgtacgctgcacggggcgttactcgactcccaaatcctcgccgacgttttcctgctgatgaccggcgggcaaaccagcatggcgttttccatggaaggggataatcagcaacagcaggatgaaaccgggattcagcgcgttatccgccaggcgagcaatctgcgcgtggtttttgccagtgatgaagaagtgatggagcatgaaaagcggctcgatctggtgcaaaagaaaggcggaagctgtctgtggcgcgcctgatatccgtcgaaaagcgctaaaaatcagcatgtgggcgatttttgcagcaactgattcaaaactgaagaaaaagcgttgacgccctgcatggtaaaccgtaatattcgcctcgttcccacgggaacagtggagcggtagttcagtcggttagaatacctgcctgtcacgcagggggtcgcgggttcgagtcccgtccgttccgccactattcaaaagccctgaatcagcaatgattcagggctttgtcgtttctgaaaccatcgttgtattttgccctctcatgacagaaagagggcagcacggatttactccagcgtaaaaggatccgcatcctgccaggcggggaacttctcgcggtactccttcagcgccgtcagggacagttccgcctcgatgcgtgtcgccatatgcggctcagcggtcgctaagatctcaccctgcggactgacaatacggctgtcgccccgataatgatgcccgttgccgtcagtgccgacgcggttacagcccaccacgtacgccaggttctcaatcgcgcgcgccaccagcaacgactgccagtgcagcgaacgcggcgcaggccagttggcgacatacagtgccagatcataatcgttgcgattgcgcgaccataccgggaaacgcaggtcgtaacacaccagcggcagaatgcgccagccgcgccactcaaacaccacacgctcatttccggcttcataatgatgatgctcgtcggccatacggaacaggtggcgtttgtcataatgatgcagcgtaccgtccggctccaccagcaaaaagcggtttaccggcccacgctcgctttgcagcgccgcgctccccgccaccagcgcattggtctgccgggccttgtcatgcatccaggtgaccacctcatcctgcggcagcgattgctgcgcggcttccatcgcaaagccggtggtgaacatctccggcaggacgatcacatcgcgcccggtgagggtttccagttgtctgtcaaaatgacgcagattggccggaccatccatccagaccagcggttgttgcagtaacgtaattttcaaaccaggcacattgtgtctcccgaagatccgtattttcacactgtagcacggcgttcagagaatgtgttggcaataaaaaaccccgcacggggcggggtttgacagtgcgctttaacgtcaggcggcttcgattttacggatattctccggcggtgatgactgctttaccggctgtgtcgccagcgcttccggctcaaagtcatcgacgttgatgctgcgtaagcggctctcttcggcttttgtcaggatcgcggcttcttcagcggtaatgatgcctttcgccagcgcatcacgcgccagttcatccagacgggtaaacggcagattacggcccgcttccttacagatgcgctggtggacagggtccgcggccatcacgtccagcagcgcctcttccagcagaccaatcgggttgtactcgctcggcgtcagatactgaccgcgaccaatacgcgaccgggtggcgctcggcgtttgcaggatcttcgccactttatgatccagtttgtccgacggagcaaggtagtggcggccagtcgggaagatcacggctctcattaatccggcgaccgcgcggttcgggaagttagccagcagatcgtcaatcgcctgttcagctttataaatcgcatcctgcacgccccagtgcaccagcggcagatccgcttcgtgacgcccttcatcgtcataacgtttcagggtcgcagaggcgaggaacacctggcttaatacatcgcccagacgcgcggagatacgttcgcggcgtttcagactgccacccagcaccgccatggaaatatcggacagcagggcgaggttagcgctcaggcgattaaggtgctgataataacgttttgtcgcatcatgggccggcgaacggctggtcaggccgcgcgtcaggccgagccagaagctgcgcaccatgttgctgccgacgtgcccgatatgtttgaacagcagtttatcaaaggcattcaaatcatttttctgcgcggcgttcatctcatccagcacatacggatggcagcggatcgcgccctgaccgaaaatcatcatcgtacgggtcaggatattcgccccttccacggtaatggcgataggggagccctgataggcgcgcgccaggaagttgccttcgcccagcataatgcctttaccgcctgcgatatccatggcgtcaatgattgactgctgaccgcgatgggtacagtggtatttcacaatggctgacagcacggccggtttttcaccgagcataatgccgtaggtgatgagcgatgctgccgcgtccatcacataggcgttaccgccaatacgtgccagcggctcttcaataccttccattttgccgatcgctactttgaactggcgacggatatgggcataagcgccgatgcccatcgccaccgatttcagaccaccggtagagttggacggcagcgtgataccgcgacccaccgacagacattccaccagcatacgccagccctgaccggccattttcggaccgccgataatgtaatcaataggcacgaaaatatcgtcgccgcgggtcgggccgttctggaacggcacgttcagcgggaagtgacggcggccaatttccacgcccggcgtgttggtggggattaacgcacaggtaatgcccagatccacttcaccgccgagcagtttttccggatccgagagtttaaacgccagacccagtacggtggcgataggggcgagggtaatgtagcgtttgttccaggtcaggcgcataccgagcacctgctccccctgccagtcacccatacagacgataccggtatccgggatcgcgcccgcatctgaacccgcttccgggctggtcagggcaaagcaggggatctcctgcccgcgcgccaggcgcggcaaatagtgatttttttgctcatcggtaccgtagtgctgcaacaactcccccggacctaatgagttaggcacgccgacggtgatcgccagaataccggaaacgccggacagtttttgcagcacgcgggactgcgcataggcggagaattccaggccgccgtactcttttttgatgatcatcgcaaagaaacggtgctctttcaggaacgcccacagttccggcggcaaatccgccatctcatgggtgatctggaagtcgttcgccatgcggcaggcttcttccaccggcccgtcaataaacgcctgctcttcagcggtcagacgaggctgcggatagttatgcagctttttccagtcaggattaccctggaacagatcgccttcccaccaggtggtacctgcatcaatcgcctctttttccgtgcgcgacatcggcggcatcactttgcggaagctgcggaaggccggtgccgacatcatggacttgcgcatggatggcacattgaacggcaccagtatgatcgccagcggcaacagcacccagatggaccataaccccgtcaggcccagcaaggcggtccacgccagcagaataacgctacttaataccagactgacacggtgataaaacagcacgccgagcagcgccacggttgcgaggatactcaaaatcatcatagaaaattgctccctgtcttgtaggaggtctgaccacttgtgatgttatggttgtagtggatgtcattttatttagcaatgtgtttacaagataattacaacctggttcacattgttagggcagggaagcgcacgaaaaccgaaaaggcccggtgatatgtcaggcttatacttctcgcccgaaacgctatccggtacactgcgacgagttaacctcatccatttttaaggataccctcatgtaccaggatctgattcgtaacgaactgaacgaagcggcggaaacgctggccaattttctgaaagatgaagccaatatccacgccattcagcgcgcggcggtactgctggcagacagtttcaaagcgggcggtaaggtactttcctgcggtaatggcggttcacattgcgatgccatgcattttgccgaggagctgaccggtcgttatcgtgaaaaccgtcctggctatccggcaatcgctatttctgatgtcagccatatttcctgcgtcagcaatgatttcggttacgattatgttttctcgcgttacgtggaagccgtgggccgtgaaggcgacgtgctgctggggatctccacctccggtaattccggcaatgtgatcaaagctattgccgctgcgcgtgaaaagggcatgaaggtgatcaccctgaccggtaaagacggcggcaaaatggccggttctgcggatattgaaatccgggtgccgcatttcggttatgctgatcgtattcaggaaatccatatcaaagtgatccatatcctgatccagttaatcgaaaaagagatggttaaagcataactctcatcgggggcagacgcccccgaagcgtggtggaggtgttgtatgtgcgaactgctcgggatgagcgccaatgtgcctaccgatatttgcttcagctttaccgggcttgtacagcgcggaggcggcaccgggccgcataaagacggctggggtattaccttttacgaaggcaaaggctgtcgcacgttcaaagatccacagcccagctataactcgccgatagcaaagctggtacaggattatcccatcaaatcctgctccgttatcgcccatattcgccaggcaaaccgtggcgaagtggcgctggaaaacacccatcctttcacccgtgaactctggggtcgcaactggacctacgcccacaatggccagctgaccggctataaatcgctggaaaccggcaacttccgcccggtaggggaaaccgacagcgaaaaagccttttgctggttgctgcataaattaactgcgcgctatccgcgtacgccaggcaatatggcggcggtgttcaaatacatcgggacgctggcggaagagttgcgtgagaagggcgtgtttaacatgctgctgtcggacgggcgctacgtgatggcctactgctcgactaatctgttctggatcacaaggcgcgcgccctttggcgtggcgacgctgctggatcaggacgtggagatcgacttccagaaagaaaccacaccgaatgatgtggttactgttatcgccactcagccgttaaccggcaatgaaacctggcacaaaatcatgccaggtgagtgggtcttattttgcctcggggagcgtgtagtttgacgccagctgaggctgcactgcgcctttagcaatcggcttgctcaccacataacgcccgtccaccaccgacacaacaggcggctgatgggtgctggcgaaatagtcatatcccggcttcagctgcttccagaaatcggcatagtaagagtatttatgacgcgccatattggcgtcggtcatgcggaacgggtaaatgctcacctgcacgctttgctgaccaaaaatcagcgcgccggtcacaaactggaagatctcatcaatgccggaatcggtcatcgcatagcagccgacagagacacaggcgccatggatcatcaggtatttgccttcataaccgtgagcacggtcgtaggcgttcgggaaaccgatattgatggctttatagaagcggctgtccggcttcagctggctgcgctgaacgttataaaagccttccggacttttgaaatcgccctgacgctgtttcggccccagtccgcctgaatagttacagatcttataactatcaagaagctgatactgctcgcccattttgacgtagagatcaagggtgcgttcttctttgaagatctggatgtaaaccggcgaccccattaactgctgcttgtactctttgctgaccggcgtggttgaactgttgctgctaagcagcccggcaaacgagacgcacgggatcaaaagcatcgcaagaaataatgcgattttgcgcatactgctggttccttgataaaacgtaattcacattgccaggacggcaaaagggatccgaaatcagactaatctgtgtcaggagcgctcacattagcaccccggtagtttttcgcaagtccggataagcgcgtttacactatgtttaattgcgccattgccgttgattatcccattgctcacaaaatcattacaactgcttctcataaacggcagtaaggctgtatacttatccagtatgggtgagggtctgcgatgcgtaaaataatacacgttgatatggactgctttttcgcagcagtggaaatgcgcgacaaccccgcgctgcgtgatattcccctcgccatcggcggcagccgggaaagacgcggcgtgatcagcacagccaactatccggcgcgcaaatttggcgtgcgcagcgccatgcccacggcgatggccctgaagctctgcccgcatctcactctgttacccggtcgttttgatgcctataaagaagcttccgcgcatatccgggagatttttgcccgttacacttcgcacgttgaacccctttcccttgatgaagcctatctggatgtcaccgacagcgtgcactgtcagggctcggccacgctgatggcccggcagatccgccaggccatttttgatgaacttcagctcactgcctcggctggcattgcgccggtaaagtttctggcgaaaattgcctccgatcttaacaagcccaacggtcagtacgtcatcaccccgaacgaggtgtcgcagtttctgcgcacgttacccttatcgaaaattcccggcgtcggcaaagtgtcggcggcgaagctggaaaagctgggattgcgcacctgcgaagacgtacagcgcgccgatctcgctatgctgctcaagcgctttggcaaatttggccgcgtgctgtgggagcgcagccaggggatcgacgagcgggagatcaccagcgagcggttacgcaaatcggtcggcgtggagcgcacgctggcagacgatattcatgagtggtcagaatgcgaagcgcaaattgattttctttatgacgagctagaacggcggctggcaaaggttaaaccggatctgcgcattgcccgtcagggggtgaagttaaaattcaatgattttcagctcaccacccaggagcacgtctggccgcgcttaaacaaagccgatttgctcgccatcgccagaaaaacctgggatgaacggcggggagggcggggcgtcaggctggtggggctgcacgttacgctgctcgatccacagctggagcggcaactggtgctggggctttaattgggggaaacgtgccgggtggcgctgcgcttacccggcctacagtgttcatgcaggcccggcaatcccgtacaacattgcacgggcgagctgttgtaggcccggcaagcgaagcgccgccgggcgtttatcacaaagcttacgacttagccgggatcgccttcagcagttcagtgagcagcgtccagtactggcccacgctttcaatatgcacctgctcatccggcgagtgaggcccggttatggtaggcccgatagaaaccatatccatatccggatatggttttttgaacagaccacattccagacccgcatggatcacctgaatgttcggcgttttatcaaacagacgctgataggtttcgcgtaccagcgccatcaccggtgaactggcgtccggctgccagcctgggtagctgcctttggcggaggttttcgcgccagccagcgtcccgagggattccagcatgctgaccacatactctttaccgctgtcgatcagcgaacggatcagacagatgatctctgcgctgtcgtcctgcatggtcaccacgccaacgttcagcgaggtttccaccacgccttttgccacgtcggaattgcggatcacgccgttcggggtggcattcagcaactgcacgaacgcatcgcgagactgactggtcagcgccgctttatccgtggtggtcgcttccagaaccacgttcaggttcttctctttcgcttccagctcgtttttcagaatgtcgaggtaagtgctcgccagggttttcagctcatcagctttgtcagcagacacggctacggtggcgaaagcttcacgcggaatggcgttacgcagcgtaccgccgttgaaatccaccagacgcagatccagcgctttcgcgtgaccggccaggaagcgggccagcagtttgttggcgttgcccaggccgaggtgaatatcgccgccggagtgaccgcctttcaggcctttcagcgtcagcttaaaggtctggaaacccgccgggatggcttcacgggacagcggcagggtggagataaaatcaatcccgcccgcgcagcccatgtagatctcaccctcttcttcagagtcggtgttgatcagaatgtctgcctgtagccagttggcctgcaaaccaaaggcgccgtccataccggcttcttcggtcatggtcagcagcacttccagcgggccgtgcgccacgctgtcgtctgccagcacagccagcgcagaggccatgccaataccgttatccgcgcccagcgtggtgccgcgtgcttttacccattcgccatcaatataaggctggatgggatctttggtgaagtcatgcacggtgtcgttgtttttctgcggcaccatatcgaggtgcgcctgaaggacgaccgccttacggttttccataccggcagtagccggtttgcggatcaggatgttaccgacgctgtcgcgctcagcaaacaggcctttctcctgcgcccagcccataatgtgcgcggccagttgttcttcatgataagacggatgcggaatggaacagattttggcaaaaatatcccacagcggctgtggagataattgagacagttcagacacgataagtctccttgacatagacctgtaaaagaaatgtacaggttgcagggttagcaaataaacaccatgtgcaatgcttgcgcgataggctggcagaataccactttattggcggcctggtactgtggcgcacgtaaaaagcagcgcaggtgccccgtaacactggtttttagtgcgtcggatctctataatctcgcgcaacccattttcccctcgaacactttttaagccgttttaaaataggctgggacacttcacatgagcgaaaaatacgtcgtcacctgggacatgttgcaaattcacgcccgcaaactggccgcgcgcctgatgccgtcagagcagtggaaaggcatcattgccgttagtcgtggtggtctggtgccgggcgcactgctggcacgtgaattaggtattcgccatgtagataccgtatgcatctccagctacgaccatgacaaccagcgtgagctgaccgtgctgaaacgcgcggaaggcgatggcgaaggtttcattgtgatcgacgatctggtggataccggcggtaccgcggttgctattcgtgaaatgtatccaaaagcgcattttgttactatttttgcaaaaccggctggtcgtccgctggtagatgattatgtaattgatattccgcaggatacctggattgaacaaccctgggatatgggcgtagccttcgtgccgccgatctctggccgttaatccccgcatctattatgccttttcagcgcccggttatgccgggcgttgttcattttagcgcccggcaggttacaatagtcattagtgacgtattcatggaggctgcgcgcaatgacccaggctaatcttagcgaaaccctgtttaaaccccgcttcaaacaccctgagacgtcgacattagtccgccgttttcagcatggcacgcaaccggcggtgcagtcggcgctggatggcagaaacattccgtgctggtatcgcatgaacaaccgtctgatgtggatctggcgcggcgtcgatccgcgtgagctgctggacgtgcaggcgcgcatcgtgatgagtgaagccgaacgcaccgacaacgccctttacgacaccgtggtgggctatcgcaacggcaactggatatatgagtgggccacccaggcgatggtctggcagcaaaaagccagccaggaagaagacgccgcacttagcggccgtcactggcttcatgcctctaccctctacagtattgccgcctacccccatctgaagggggacgatctggcggagcaggcgcaggcgctggcgaaccgtgcctatgaagaagcggcgcgacggctgccgggctctctgcgcgagctggagatccccattgccggcggcgcgcccttaacggcgtttctgcacatgccgaaaggcgacggccccttcccgacggtgctgatgtgcggcgggctggatagcctgcaaagcgactactacaccctttatgagcgctatttcgcgccgcagggcatcgccatgctgacgctggatatgccttcgattggcttctcatcaaaatggaagctgacccaggactccagcatcctccaccagcacgtgctgaaagcgctgccggatattccatggattgaccatacgcgcgtcgccgcctttggcttccgctttggcgcgaacgtcgccgtgcggctggcctatctggaatcgccgcgcctgaaagcggtggcctgcctggggccgatggtgcatgcgctcctgaccgacagcgcccgtctgagcacgataccggaaatgtatcttgacgtgctggcgagccgtctggggatgcacgatgcctcggacgaagcgctgcgcgtggagctgaatcgctattcgctgaaaacgcaggggctgctcggacgccgttgcccgacgccgatgctgtccggcttctggaagaacgatccctttagcccggaagaagagtcgcgtttaatcacctcgtcatctgccgatggcaagctgctggagatcccgcagaaaccgctgtatcgcaatttcgaccgtgcgctgcgggaaattaccgactggattaatcataaattgcgttaatgcattgctaatttatgccggtttggtaaaacagtggctacacataaggagattgcaatgacgttaccgagtggacacccgagaagccgacttattaagaaattcaccgcacttggcccctatatccgggaagaacagtgcgaagataatcggttctttttcgactgcctggctgtttgcgttaacgttaagccagcgccggaaagccgcgaattctggggctggtggatgataatggaagcccaggagaagcgctttacctacagctatcagttcggcatgtttgataaagaagggcactggcagcccgtcgcgatcaaagacaaagaagtgcaggagcgtctggaacatacgctgcgcgattttcatggtcgtgcccgcgatatgctctccacccttgagctgaagcttgaacctgctgatgacttcaaaaaagagccggtgaagctctcggcctgatttatcgctaaacctcacgcataaaaaaacgcccttcatcgctgaagggcgttttcttttctgtcatcagaactgataggtcacgccgaccgctaccacgtcgtcgctgctcagacccagctgattgtcgtcatcgatctggttgattttgtagtcaaccatcgccgacatgtttttgttgaagtagtaggtcacgcccacatcaatgtatttaaccagatcttcatcgccgatcccgccttcgatgtctttacctttggactgcacgtagcccagagatggacgcaggccgaagtcgaactggtattgcgccacggcttcaaagttttccgctttgttagcgaaaccacccgagatcggggtcatgttgtgagacaccgcgtacatggcggccaggtaaacgttgttggcatcatacttgatgctggtgccccaggcgtcggctttgtcgccctgaccacgtgcctgcaactgttgcagatctgtacggtccgagctggcataagcgccggtgatagtgaccgggctgccgccgaaatcataggccagagaggtgccccagccgtcgccgttctgtttgttcgccgcgcgggtgccttcgtttttaccctgatactgtaaggtcatgtccaggccttccacagcgccgaacaggtcggtgttgcggtaggtcgccacgccagtagtacgcttggtcataaagttgtcggttttacccagagagtcgccgccaaattcagggaacatatccgtcgccgcctgcacgtcgtacatcacgccgaggttacgaccataatccagagagccaaaatctttgattttcagacctgcgaaggccagacgggttttctgcgcgtcagatgcgccttcgattttgttaccggcaaattcggcttcccagcgaccaaaaccggtcagctgatcgttaatctgcgtttcgcccttaaagcccagacgcacataagtggtatcaccgtcactgccagcatcgtcgctgaagtaatgcatggctttaactttgccatagaggtccagcttgttgccgttcttgttataaacttctgccgcctgtaccgatgcggaagcgacaatgctcatcaccactaatgccagagtactctttttcattttgattcctgatttgaaagacacgctaatattcgctgggcttatagccccgtgaaaaaacatgaggggttttaacgctctggaatgaaggttttatgacaaagtcggattaatttgaaaaaaatggatttatttgctactgccataaaagtgtcaaattctgccgttaggcttgctgatcccgcgcaataaaaaacgggctttttacgcaggttattggcaagcgcgctgactcctgttaaaacgtcctttcccatcttttttcttatttgtttaacggcagagaatcatgagtgacagccagacgctggtggtaaaactgggcaccagtgttttaacgggcggatcgcgccgcctgaatcgcgcccacattgtggaattagtccgccagtgcgcacagctgcatgccgccgggcatcgcattgtgattgtgacgtccggggcgattgctgccgggcgcgagcatttaggctatccggaactgccggcgaccatcgcctctaaacaactgctggcggcggtggggcaaagccgtctcatccagctgtgggaacaacttttttccatctacggcattcatgtcggacagatgctgctgacccgcgccgatatggaagatcgcgaacgtttccttaacgcccgcgacaccctgcgcgcgctgctggacaacaacatcgtgccggtgatcaacgaaaacgacgccgtcgctaccgctgaaattaaagtgggcgataacgataatctctcggcgctggccgcgatcctcggcggtgcggataaattattgctgctgacggatcaacaagggctgtttaccgccgatccacgcagtaatccgcaggcggagctgatcaaagatgtttacggtattgacgacgccctgcgcgccattgccggagacagcgtttccggcctcggcaccggcgggatgggaaccaaacttcaggccgctgatgtggcctgccgcgccggtatcgacaccattattgccgcgggcagccgtcccggcgtgattggcgatgtggtggaggggatctctgtggggacgctgttccacgcccagacctcaccgctggaaaaccgtaaacgctggatctttggcgcgccgcccgccggtgaaatcaccgtggatgagggcgcgaccgaggcgatcctgcaacggggcagctccctgctgccgaaaggcatcaaagaggtgaacggcaacttttcgcgtggggaagtgatccgcatccgtaaccaggaagggcgcgacattgcccatggggtaacccgttacaacagcgatgcgctgcgtcgtatcgctggccaccactcgcagcaaattgatgcgattctgggttatgaatatggcccggtcgccgtccatcgtgacgatatgatcacccgctaaggagcagacgtatgctggaacaaatgggcatcgctgcgaaagcagcgtcgtacaaactggcgcagctatccgcccgcgaaaaaaatcgcgtgctggaaaaaatggccgattatctggaagcgcagacggagacgatcctgctggcgaacgccgaagatgtggcagaagcacggcgcaacggcctgagcgaagccatgcttgaccgcctggcgcttaatcccgcgcgcctgaaagccatcgctgccgatgtccgccaggtgtgcaagctggccgatccggtggggcaggtgattgacggcggtctgctcgacagcggtctgcgtcttgagcgtcgccgcgtgccgcttggcgtcattggcgtgatctatgaagcgcgtcctaacgtcaccgtggatgtcgcctccctgtgcctgaaaaccggtaacgccgccattctgcgcggcggcaaagagacctggcgcaccaatgccgcaaccgtgaaggtcattcagcaggcgctggaagagtgcggtctgcccgccggcgccgtccaggcgatcgaaagcccggatcgtgcgctggtgaacgagatgctgcgcatggacaaatatatcgacatgctgatcccccgcggtggcgcaggcttgcataaactctgccgtgaacagtccaccatcccggtgatcaccggcgggatcggcgtgtgccatatttacgtggacgacaccgccgaaattgacccggcgctgaagatcatcgttaacgccaaaacccagcgccccagcacctgtaacaccgtggagacgctgctggtgaaccagcatatcgcggatacttttctgcccgcgctcagcaggcaaatggcggaaagcggcgtaacgctgcatgcggacgacgccgcgctggcacagttacaggatggcccggcgcaggtggaagcggtgaaagcggaacaatacgacgatgagtttttgtccctcgatctgaacgtgaaaatcgtcgcggatctggatgacgctattgcgcatattcgcgagcacggcacccagcattcagacgcgatcctcacccgtacgctgcgtaacgcaaaccgttttatcaatgaggtggattcgtcagcggtctacgtgaacgcttcaacgcgcttcaccgatggcgcacagtttggtctgggggcagaagttgccgtcagcacgcaaaagctgcacgcccgcggcccgatgggtcttgaagccctgaccacctacaaatggatcggctttggcgacgataccattcgtgcttaaatgaaacggggtgatgcaaaagtagccggttgattagaaaggttattgacgcatcgccctgttagttttaaccttctacaccgtcattcacgcccgtgaatacctctcagggccgatatagctcagttggtagagcagcgcattcgtaatgcgaaggtcgtaggttcgactcctattatcggcaccattctaacgtctccccaagtctactaaagttcactaaaaccccttataatctgcgctttacagccccttttagtgtttctacgtctactaaagttccctgaaatctacggtcgtttgggggggagttatgggggtatttgctgttcggtctagaggtggtacccccaagtgaaactaaacgcccggcaggtggatgccgctaaacctaaagataagccttacaagctggctgatggtggtggtctgtatctcctgatcaaacctaatggcggcaaatactggcggctcaaatatcgtgtagccagcaaagagaagctgttagcgctgggtgtttatcctgaagtcacattggccgatgctcgggcaaaacgtgaagaagcgaaaaggggtatcgctggaggtatcgatcctatggaagcgaaacgggaggagaagattgcccgtgaaattcagttaaacaacaccttcaaagatattgcccttgaatgacacagcagcaaactaaaaaaatggtctgctggttatgcttcagacatcctcgaagccttcaataaagatgtgttcccatacattggcaaaaaaccaatagccgaaatcaaaccgcttgaactgttgaatgtgctgcggcgcattgaggggcgcggcgctaccgaaaaggcaagaaaatttaggcagcgctgtggggaagttttccgttacgcaatagtcaccggtcgagctgagtataaccccgccccggatctcaccagcgcgatgcaagggcatgagtccaatcattatcctttcctcacaccgaaagagttgcctgatttcttcaaggcgttgtcaggatatacaggaagcgcgttagtagttttggccgctcgtctgctgattatcaccggcttgcgtaccggagaactccgtggggcattttgggatgaaatcaatatcagtaaggcagtctgggaaataccagcctcacgcatgaaaatgcgtcgccctcatgtggtgcccgttgtccaggcaagctcttacgcttattggccagctccaagagctaacaagcaattgtcagcctgttatggtttgttatgccttactagggaaaactaggaggaaagtgtcaaccactaccgcttcagaaaacttcagatacacgaactcgtgaaggggaggtgttaagcacaccctctttgcaaccatcctcaagcctctttcagatcgatgttccagtttacccggaagttagcgttcagattgagttgtcaaaacttgtcacccaccggcacagccagtggggatttttggctgtagccgctctaagttacagtttcttccaacagtaagctgattcaaaattgtttcgaactaatcgtgggaatatcatcctttaaaaggaactttggaagtagtgatatcaactttattgtatttgtatacatcgagcataatttcaattccattgattagttcttctatgttttgtcctgggccaatcatgatttttttcaatggaagttttccaccgtgcggaccatgtttattcattttaagttcaatgtaaggtatgattcctttgtttccaacgcgaatcttcacatcttgattcttattttgcgtgtatattacaaagcgatattcaagttcttcttcgaaatgttttactttaaagaacgggggaagtagttgggcaagggttattgcatggtaaagttcatccaaatcacttttagtaatgtcttcaataactttttcgttattaaagaattcaactatgccatcaattgcttcaattgttgaattctcttcagtatagatgacatttctgtcataaattactttgtcactagtgtctattgcttcaaaaagctcgttggaatcgaattccagacataccttttgggcttgtccataaccacgccacatgcttaataaatctggttttaaacaaaacgatatattgtaagcatgttttgatgtaacttccttaaagaattgcactgtctttttaactaattcaatatgctcattttttatttttccgtgaatattgtctaaggcattgatgatacagttgataccatgtttgatttcttgagagtcgtttaggaatgcatagttcgtggcccataaggaattattttcaagtattccttttaagccatttaaatctgtatagtggtaaattttcattttcaatggattgtgatttgcgtgattttattaaaattaattttcattaattgtccaatatggaactaaatcttttaattaccataaggaatgttattacagtagtgaagaaagaagagtaagctataaagcttaaaaagtaagcaggaatggcaaagtgtattttcccaagtgagtatgcatcatccgggaagaatgatattatcactgatgatatgacaagtataacagatgttaggattgcatatgccacgttgtggcaaagttgctcatatactgttctatttatctcaagagttggtaaatttgttttggatttattattctcaataatatcggtaattttgaaagcggttttttgtttttgatcatatatcattatcactgcactcataagcaaagctgtggtaatggctccgaaatttacaaatatagctgcgattgatggtttcattgtaccataaaaataacaaactaaaaaggaagttatcgcgggcaagaaaaaatggataaatatatcttgtgctagagtgtttcctttttgatctgacatagttttataatgtttcaacagaacttgccatatatttatcttgttcatatgattactcccatgttcccgctgtgaatttctaaaagtaaatcattggtgatgactttgacagtgtcatcaagggctgtcaagtcaggtattccagttgtagggtctattttaatatcattgtcatcaagttctactgaaatgccttttttaaggattgagtcataactaaagacgatcgtcctattacctagtagcaacgaaaccttcacctcatcacatttatcttcgacaatttcgatgacattacttaattttttatctctcaagtcacgaaaactacccatcattccttcattatatttgatgactaagtcagttttcacattcgttttattgctaccgaacgaatcggctatgtcagttggtggtttataacctacagctttaatttgtttaacttcagagtcaagtatatgttgcggaatgcttctgtgacaaagaggattgaccctggcctcaagttgatatttggtgataaaatgctcaaccagaaaatcagtaaatgctgatttagctgaaatattatcactagtatgaaatgcaataattccttcctcaagagcatttggaagataaataagaatgtagcgttcacgcaaaataacatcatcaacttttgtggtataatgcgtttgagataattgtgtatcctttatttcatgagtttcaccatatttcccaaccttaatgaaaccatgaacaagacctttatttgaatcgaaggttagtttgttatgttgttctaaagaaatctttgtctttgttgcactatcttccatgggagtgattttgtaatttgtaaggaattcttcaattatttcaaacgctgttttattgttactcaaaccaagattacctaaggctttactatatctgctaccttttttaactaaaattctaaaagaataaaaactcacattatgcataatatttccctttatatgatatatctttatttagtttcgggtgaatatctttgatgcaggctaccgccagagtatgaacacccaactttagaagtgatgattaaggttgagcatacacgaaaaaaggagaccgtaaagttcatggtcacggttttgagaagattacaataggattaagagggtttagttgcatgcggtcattaagaacgcatagtcatctggtaagagctaacgtgctggttgttttttgatcaagttagagtgagaaaactaaaattgggggtactattgggggtatcatatgattttttattgatattaatcttttgtatcaataggttattgtttatgtattgttcctattatcgcaccaatcatcacgcgggttcacgcggtattgaccagttcagcaaaagcgccttgtgccatatttgtaccattccccgccagaaatgagtcaaattgcatcgcatgttgcgtcaggtgattcggtgccaggtgcgcataacctggtacaaatagataggctttatgaatgtaattcataaagcctgcttcggatcttacaaaggatgagtcggtcgttaagcatgcgacaggtctattaacctttgcgccgcctgtaagtctgccagggtatcgatatcgtgggtgataccgtaatccgacaggaaaatatctttaacctctccccgttgtcgtgcgcgtctcactatttcttttgctcccatatttccggaaagggcgcttaattcagcacggtatttgtgccagaatccgaccggatgacccggattacgctggtagtgaggcaccacaatcgaattttcttcgagctccgcggcgacgcgttgcaatgatgaaggctgaattaagggaaggtcggctggcagaattagccatcccggagcctctggcgtggcgtgaatgccaagagaaatagactcgcccatgccgcgcgtgccaccttcagggcagaccagatgccatttcagcttcgcgttttcgacggcttccagcacatgttctaaaaccggcttgccgttaagctgtgcggctagtttatgggtgctaccccctgaagtaagaaagcgctccccacgcccggctgcgaggatcaggacgacgggggcaggcatgaatcctccttctgatggagacgtacagaggcgatctctgccagcacggagagtgccagagtatgcgcatcccgggcttttgggaatatcccgacaggcgctctgattcgctctgtctcctccttacaccaccccagctcgtggagcttttgcagacgcaaagtgtgcgttcgaaaactgcccaacgcgccgagataaaagggttttgcctcgcgcgcggcctgcagtactggcagctcccggttgagatcatggcatagcaaaactaccgccgtgtcagtatctatcttagcgctggctgaggccggaaaacggtcaaagatatggctgtcatagccagttgccgccgcaaggcaggcggttgcctgtgcttcaagagaacttccgtaaatcatcagccttacgcaaggcctgaaccctacctcaaagccattgagattccagcccgttcgggtttgcgcgggcaggcacaccagcgattgtgcttgcggatcgtagcgcagccccgccggttttctttgttccagacggttcagcacggcaagaaggggccgtggtgagcgcagtttatggagcgtcagagtgatcccgccaccgcagggcagaataatgtcgaaccatggcgaaccctctccgtagcgaatgtcgcgatcgcggcctgagaccatcacctccagtgcttcaaaagcagtggcggcttccacgcaaccgccggagacaaaaccgcagtagcggccatcttcgcgcaccaccatctgcgccccgagtggtcgcgccgcgccgccgcgtatctcaaccagcgtcactaacaccgccgctttaccggccatcagcgcttccaccgcaaaacgcagaatggtcacggggtcatcggtaagaaacgccagttccggcttatgcaagcgctcgtctatatcaaaaagcgagtatgacattgctcctccttaaaccacatccggcagcttatcgagcagcttatccagggtgatggggtaatcccgtacccggacaccagtggcgttgtaaaccgcattggcgatagccgcgcccacgccgcacaggccgagctcacccacgcctttggctttcatcggggaggaaatggggtcggtatcatccaggaaaatgacctcctgtaacggaatatccgcatggaccggcacctcatatcccgccatatcgtgattaacgaagtatcccagacgagtatccacggccagctcctccatcagtgccgcgcccatacccatggtcattgcgccaatgacctgactgcgggcggttttaggattcagaatgcgccctgcggcacacaccgcaagcatgcgatgaacacggatctcgcccgttgcgctgtgcacaccgacttcaacaaaatgtccggcaaaggtcgactgctggtacttctcgctgagcgtcccgaattcaatactctcttctgctgtcagcctgccgccagacgtagcctcacgcagcgcagcgctgcgcgtaccgctgataattttgccgtcggtaaactgcgactgctcaggatcaaacccgacggctgaggcaatcatctcacgaagcttcacgcaggcggcgtacacgccggaggtggaggtattcgcgccccattgcccgccagaccccgcagaaaccgggaaactggaatcaccgaggtgaacagtaacctgctccagcggtacaccaagcatttccgccgccgtctgggccagaatggtgtagctaccggtgccaatgtcggtcatgtccgtttccacgataacggtgccgttttgctcgaggtgaacccgcgcgccggatttttcgagcagattattgcgaaagcccgccgcgacgccgacaccgatcagccactcaccatcgcgcacctgcccgggtgtggcattgcgctgcttccagccaaatttatccgccccggtgcgtaagcactcgataagctgacggcgcgagaagcggcgtgtcggattggcgggatcaacctgagtgtcattcagaatgcgaaactcgacaggatcgatgcctgctttttccgccagttcatctatcgcgatttcgagtgccattaatccgggggcttcgccgggtgcacgcatggcgttcccttccggcaaatcgagcgtggcgagccgcaggccggtatgacgattcgcccccgcgtagagaaattcgctttgctgcaccgccgtttccggcgtgccgccgggcagattgccagaccagctttcatgggagatagcggtgatttttccgctttggtcggcaccgatacgcaggtgctgaagggtcgcgggacggtgagtggtgttattgggaatgacggggcgggggagcatcactttaaccgggcgttttaccgcacgggcggcgagggccgccagcagcgcatcgcttctcaggaacagcttgccgccaaacccaccgccgatgtacggggagataattcgcacattctccacgggcactttcagcgttttcgccagatcggtgcggcaccagtcaatcatctggtttgaggtccatactatgaccttattgccctcccagatggccatcgaggcgtgcggctccatcgccatatggctctgatccggggtggtgtaggtggcatcaattctcaccgctgcggaggagaacgcgccgtcaaagtcaccgacgttcttgtcaggcgtatcttccggtggctgactgacagtcggtttctcatccgcaagagaataagcccctctttcgcggcgatagtgcccctgtaccagcgaggccgccgcccgcgcctgttcgaatgtttctgccaccaccagagcaatggcctgatggtaatgctcaatcgtggggccgcccagcagtctggcggtgtttttgtcccctttgccgagtgccccggcgttatcggcggtgatgactgccagcacgcctggcgctttttgcgcggcgtctatatcaagggcggtaagccggcctttagcaatggcggaaccgacgatatagccataggcggcgttgggcgctatttcgtgccattcgtaggcgtaacgtgccgtaccggtcgttttcagcgcgccatcgatgcggtcatgaggacgaccgataaccttcaactgatcaatcgggttttccccggcaggtttatcaaatttcatgcctgagccctcgcttctgtcattacggaggcaagcgttcgcttcgccagcaggagtttgaaggtgttttcagcggtgggatgtgcgctggcaaacagcgtgtcatacacggcctgcgccccgaggggcatttgcgcgtccgcagcctcaacgcgccagggcttatgcgccactccgcccagcgcgacgcgtccactgccgtctggctggatgattgccgcgactgacaccagagcaaaagcgtaggaggcgcgatcgcgcaccttgcggtagaaatgtgccccgccgacaggcggtggcaacgttaccgcgacgataagctcgccgggtagcagagcggtttcaatatgaggtgttttctccggcggccgataaaaatcagccagcgcgatactgcgcgcctttccatccggtgtgatggtttccaccaccgcatccagcaaccgcatcgcgaccgccatatcgctcggatgagtggcaatgcaggcttcgcttatgcccactacggcgtgctgacggctaaagccttcaagcgccgagcagccgctgccgggcaggcgtttattgcagggctgattggtatcgtaaaagtaggggcagcgcgtgcgctgaagcagattacctgcggtggtagcctggttacgtaactggccggaagcgccagcgagaagggcgcgggagagtacggcataatgctgccgcacgtgctggtgggctgccaaatcggtgttccgcactaatgcgccgatgcgcaggccgcccgcgtcggttgcctcaatcttatccagccccagcccgtttacatcgataagatgggtaggtgtttcaatttccagcttcatcaggtccagcagattggtgccacccgcgataaattttgcgccgggaacacgctgagcgctgagcgccgcctcagccggggtattcactcgttcataggtaaatgccttcatgattttacctcccccgcagcgtcttcgatggcagcaaggatgttggcgtacgcgccacagcgacagaggttgccgctcatacgttcacggatctcatcggctgtcatttcaggcggggaaaccaggtcgcgggtgacgtggcttggaatgccgtccttaatctctttcagcactgccaccgatgagcaaatttgcccggaggtgcagtagccgcactgaaagccatcatgccggatgaaggccacctgcatgggatgaagatggtctggcgaacccagaccttcaatggtggtgatctccgacccctgatgcatgactgcaagcgtcaggcaggcattcagcctgcgaccgttgaccagtacggtacaggctccgcactgtccgtgatcgcaacctttcttggtgccggtcaaatgcagattttcccgcagcgcgtccagcagcgtggtccgggtatccacctccagctgctcgcttttaccgttcacttttaatatgaggggcattatttcaggggccggagttgcagccggaacgctggctgcaagcgttgaatgaggataaacgacagctgttgccgccgtcgcggcactgactttgattaggtcgcgacgggtcagactcaaatcgtgcggttcatgattgccaacccgattatcttcggggtattcgccgtggttgctcatgccaggcctccggtatgcaaaaggggaaataagagtgcgttgcgagaatgctgttcgtttttttaaacgttaagcatagtcggcgagagcaaaaagaatattcttaaaacgcgaatgccgttatgtgtggcctgcatagcagaaacgcatcatcagccttaaaaaagctatttttgtacaacaaagttacgccgtctgtgtcgggataataagtagccattaaatcgctttgtatggaacctttcccgacaggaatgtggatatgttaaaaaatactcagacacgtgcgtttcatgttatggcaaaaccgtctggttctgtctgtaatcttaattgcagttactgcttttatcttgaaaaggaagtttactatcaacaacataatataatgagcgataacgttcttgagacgtatgtgcgaagttatattgaatcgacgtatcctgaagatgaagtcgcctttacctggcagggcggagagcctgcgttagccgggcttgaattttatcaaaaagcggtctcgctacaggataaatacggggccggtcggaaaatatctaacagttttcagaccaacgggattttactaaacgatgcgtggtgtcagtttttttctgataacgattttttgattggcctttcgctggatggtccggcagcgatccacgataagtatcgtcttactaaaagcggtaaacccacccatcatcgggttatgcgggcgctcgccctgctgcaaaagtacaaggtaaaatacaacgtactgacatgcgtaaatcgccatagcgctcagtacccgctggagatttatcattttttgcgtgacgccggggtagagtttattcagtttatcccggtcgtggaacgactggcggatgatgacgccctgcaagccgggctaaaattacatgctcccggcggggatggaagccgcgtgacgccctggacggtattgcctgccgattatggtcattttcttgttaacgtattcgaagagtggcgtaagcgggatgtcggcagcatttttgtcatgaatatcgaatgggcgtttgcccgctttatcaatgcccccggcgcggtgtgccaccatcagcccacttgcgggcgctcggttattgttgagcacaacggcgatatttatacctgcgaccactatgtctatccgcaacaccggttaggcaatattatgggggcaaccctggcggagatgatcgattcagcgggccaggtaaaatttggtactgataaatataactcgctgccacgccagtgccgtcaatgcagggtgttacaggcctgtcagggggggtgcccgaagcatcgctttatgcgcagcaaagaaggcgaacccggactcaattatttatgcgagggctttcagctttattttaatcatttgccgcgctggttaaaggcgatgaccgatcttatcgccagtggtcggccagtgagcgatataatgcatgcggatctcattcacattaacagcgcatcaaagaaatgaaaataaaaaacggccataccagatggccgttttgcgcaaagcttacaaatgaatctgtactgaaggcgggtacttattgaggatgttgttatagtttttgatttcttcctgcaggattatcccgacaggaatatggcgaatgccaatactctcatcttcctgtggattggtatacagattaaagatcattgatcccgctgtcttactgatagatcctgtaaaccctccctgatagcctttactggtgaaagcataaggttgctggatcagcgtatggtatttaaattcatcaacccgtacggcggaaagctgaccgtttaagaagtaatgctcagcccgacgattagattgccctgtatttccaacaaaccaggatgcctgattaaccccatcgataaaggtacttttgggaaccagtttcgcaagttcagcgcccgattttcccgccagggcaaggctggtggggaagatatcagtcagatcaaataagccatctgatttgcggggctgtatcatgcctttccagtaaacaaaagtgggaacacggacgccgccttcccatgtcgatccttttgatccgcggaagggtgtccgaccatagggggcgacttcggcttccgggccattatcagaagtaaagacaatcagtgtattatccagttggttggtttcttccagtgacttgtagagtcggttaaagacatcgttcatttcaaccatacagtcgctaaatgacgtttttgccggagaacgaccggcgtagtacgcattcgggtaattatcgaaatggcagccgcgggtgccgtagtaaagaaagaaaggcttatcgctcttctgcatcgtacggataaaatctgcaccatactgcgaccagcgttgatctaaatcttccatatatttgggagtgatctccgcaacttcattaaatgttccgctacgcgtcgcatgaatatcgctcttattaaacggcagattttttatatattcctggcgggaggggctaagggctatctctgggttaacattggcgtcccgccattctgtatacatatctgaaacggagaggaagccacggaaatcatcgaagccaacgttctgaggttgagactctttattttctcctatatgccatttaccaatagcctgagtgacatagccttgatcgtgtagcagctggggtaatgtggtgaagccttgtaatcctcctttctgaccgtacatagggggcaccagaatgccatggtgggctgagtattgcccggtcatgatagaggctcttgtcggcgatgagctgggctgcgaataagcggatgttaaaataagcccctgttccgcgaccctgtctatatccggcgtcgggttacctactgccacgccgccaccattaaaaccgacatccatccagcctacatcatccatgataaaaaccagaatattaggttttttacccgttttcttttctaattctgcaagtttttgtgccgtttccttttcctgcccggcgttatagatcaccggcatcatattatcggccagagtagtggttttagtgaccatatactgcccgggcgtgtcatagcctttataggcctcagtcggttgaccattcgcggcattaaccataaacgggatagcaagtgtaatagccgacgcgactgttttcatcataaataacttattcatagggtactccatgttaaaggcgattaaataaaagctcgacaggcttttttattaacggccgaaggtaatgttcaatcctgtaaagagagtaaattgcggctcatattccccattatgtgccacggtccactgaggttcgataaaggtattgattatgttactgcctgatttccatgcccgaccaataccaaagccaacgggcagatagtaatcatcgttttgcacgttataagtcattatccctgacgagcgcagataccatccttggggaagattatggaaaacaaaaggttgtaatgtgagagtctcaacgttggtccgatctttatcacccgcgaaacttttctgccattgcaataatccaccaaacagaccgctgccggaatcctgtacgacaacagcggaaaagcctgccagccatttaccggagcctgtttcgtcctgtgaggctgaatccaatgttaataaggggccgacaccgagtttaacgcctttttgcttaagcaaaagaatgtcaaaaatattaatatcgccgatgccggtattatatccgccggaaatttgcggtcgtgtgacaaccggtactgacattctgaaaatttggggcacagggatcaatcccggcgctatggggatcgtcccgcgcaggaagaaatcatcagtatgttgttcgctgccatagagttcaggggtgtaataattatgaaaagccagggcgaaagccggatgcagcgggttattagattgattcgcaacactggcactctcaccccatgcataacaggataatgccagcagactccctgcccagaaaagcctggagtgatgagtaaaagcgatcattttttcgcgtccttttaccaggcgtactgtaagcggaacgtccagccatcgacgtcagcagaatattcccgatgctcaacaatattgctgtatgccaccatgccgccaaactgcggggataactgaaatcctatcgatgtaccgagcatgacgttgttattccggtcgtcctgcactaccccattgattttcgtttcaccgccaccggcccaggaactatccagagagatccataattccggggagagggtataactcacatgcccttcagcagcataggatggtcgttgtgacagtgtgttattacctgaataatcgtcattgtcggtgtaaaacgtcgcccaggtattcagttccagccagacagggcctatcggataaccggacgctaactccggtttaaacacccagcgattagcgccagcatttaagacgttattactgtcatactgaccatccggcaccgtaagccagaatgcaccggttaaaaagggctctggcgtccattttcgaaactcacttttggataaagacgggccgccaaagatgttatgcgcaaatacaatctgggtatcgccggggttttcattgataaaacttccggggaagcgggcgttgtccggcgtggccgacagccgggtataaggctgaacaatctgtatagccgacgtgcgcccgtcaatcgcaaaggtatagccataacggaagagaaaggtgtcagcatcaatattgatgccgggagcatcaacgttcattggcgcataatagccaaacacaatattgagatcgttcggtaagttcatccagtcacgggcattgtcagcagacgcgcccgcggatacgcataaaaaaaggatgcaggcataagaaagcctgttacagcattttctcgcctggtgtatgcaatgcgttatgttcataagcaatccctgtagacacatgatgtgcacaggaacataaacgcaataaaatcgtacaggtggatattataaaaacagaaataacctaacgctgaacgtcactttctcataacgcatggataattcaagctttttttttgtgcgggatatttttattgtttcagtatcaggtaaaccaacaaaaaattacaagcggaaataaaattatcaactggtaatataagtaatcatttcattattaattttccgcagattaagcaaggatcatcaagtaataattaaatcgctttttaataaaactgtctgactgcggggtgtaacaggttcgcctgatgatgttacttctcaccggcgaacctgcggcttcaccagccggtcacaacattccgtacagcagcgccgagacggtcagcacaccacccgttaacacaatcagcggcgtaaccccgcgcaggggacgcagtgcatcgcgggtataaatcagaaagaccgggatcaggaacaggaagatagcaatcattggcccgcagacggtttcaataagattgatcacattcgggttcacatagaccacggcaaacgacacggcgaacatcagcagaaacgcgattgttttgcctttgctctcggttacgccggttgtttcagtaaccagatcggcgaaggtttcggcaaccggcaggcaaatccctaaaaaggattttgtcatgccgataatggcgatcagcggagcagcataaaaaagtaatcctgagcgtccttctccttccattaccgataagacgttaaggttctgcgctttcgcggcgacaaaggtgttatggggaatgctcaggatacaactcaatacaaagaatataatgctgaagaagatcagcgtataggcaaggcgcacaacccgcaccgctttattttcgccgccgttatgcttttcgcgataatgcgccgccaggggggaaatcaacggcgtggagcaaaaagcgaaagtgatcagcggcagcgtaagccagaggttttttatcgtctcaccggttgccacattattggtggcgctcagcgccgcagtgaaatgatccagctgccagtgagggatctggattgccgcgataatcaccaccgtcagggcaaagggcagcgcgagagtgcttaaaatgctgaccactttctcacgtcctttactcaacaccataaacagacccgcgacgataataaatgccagccatgcgcggctcattatcgtaatatgaagatgatcgttcaggagattatccagcgcgtttaccagcgataccgcgtaaaccagcgtgacaggaaaatgcgccagacaaaaataaacccgtaccgccttttgtcctttcgcgccgaagaaagtgccaaacatcggcagggatttatctgccgtctggtgatcgcgcataaacacgcggcaaatcagcacgtgcggtactatcgacagcgggaaggcgagaagcagaagcataaagaacaccagcggcccacgcgtacctatttctacgggcagaaacaacgtccccgcgccaacggtggcaccgtaaacaccgagcatccagatggtatctctgaatttccatcgaggtcgggaagtggcaatgttttctacaatttgcgtagtcatagtgtcatctttcattaaaggttattcagaatgagcttaagcgtggctgatgtatatatgggtggccagcagtaaatggaaattttagttaacaaccaaaggcaattgttaaattattcctttggaagctaggatccattctgaaaaaacgcttcaatttaaataatcacctgctatttaattatcatattcgcagggcgatggaaagggaatttgtctggcatcaattgcgggacgccgtatgtactaaaaaatcggctgaatgttacagttttaaataattctgcaacattcactggtgcattacactaacaatgttttttagcggttaattatcgcgggtgcgatgtaaacgaagttaactaaagttaaactgataatatgttaagcagcattaatacttgatccaatgtcggctgtgcgttattttttgttgccgggtgcatccaatgtgccgtcattccttattaataacgatttaattttatgaaaaagacgcttttaactttggctattttattgcctgtgggaaacgcgtatgcgcatgataattgtgctgcgctggataactggcagtcggaatgcagcgccgcagagcaggcggtagaggataaaataaaccagacgcaacaaaatggtatagacagctggttaaacgatattaacaacgaagcggatcgccttggcgtccattttgacagccccgaagaggttaattactggaacgagcatcattacattacgtggggcgacaccagcgtatccgatgatttacttgctcagttgcatgatagtattacggggcatcacgacaccagtaatcccgataataacggcagcgataataacggcgataacaataataataacgccgataacaataataaccccgacaataccgacaaccctaatactgacccggcggataacggcgatacctcactggcttcggtgatcggttacgcggatgccgtttccgatcacgccgaagccgccgcagaagggcacgccgatgacgccgccgccgcagctgaaaagcacgccgacgctcatgcggacagcgccgcagctcacgccagagcgcaggctaacacctataccgatgaacagtttgccgctgcggaagcctacgccagagtgctggcggaatcctccgcgcgttatgttgatcagggcgtgcaggatgcaaaacgctataccgatcgcgtcgctaaaggtttgcaaaagcaaattgatcgcaataacaaagcgattaaacgcctcggtgccagcgcgcaggccaccgctaacctccattacaacgccaaccgcaatggctatgccgtatcagtaggtgattatcgcggcgaaaccgcgctggcgggcggtttgcagttcagagcgggtaatcacagtgccgttacggtgcagggcagttatgacgctgaagcctttggcggcagcgtcggtttacatggagactggtaacagatgtcaccttacatgaagctttttctttatctgcttatcgttggctggggattgtttgagggcgtacgaaataaccctgataaataacctccctggaatttactcacccgcataatgttcatggcgggccatcagtatcctcatcagtgagatgaggatactgacctcatttgcagtgctgcctgatgtcaatcactatccacaatcacccaacataaaatctgcgaaactagacatttgtcgacttttcatcttaaagtcgggattctgctgtcagacaacgctggtgttcagttaacaaatggttaaataatattttgccgggtgtaaatgaccgacctaaaacctccatggtcggcgtacatccggtgtttgcagtcgctacgacacacctctttgggagaatttatgcattcctctgttaataaaaacgaaagccggactttcttcgggcatccttatccacttggctcgctgttcttcacggaaatgtgggaacgattctccttttacggcattcgcccgctgctgattttgtttatggctgccaccgtttacgatggcggtatggggctggcacgtgaaaatgcctcggccattgtggggatctttgccggtagtatgtatcttgccgcgctgccgggcggctggctggccgacaactggcttggccagcagagggcggtgtggtacggctcaattttgattgctctgggccacctctccatcgcgctgtcggccatgatgggcaacagcatgttttttattggcctgatgtttatcgtccttggctccgggctgttcaaaacctgtatttcggtgatggtcggtacgctgtataaaaagggcgatgcgcgtcgtgatggcggcttctcgctgttttatatgggcatcaacatgggatcctttatcgcgccgctgatttctggttggctgattaaatcccacggctggcactggggctttggcattggtggcatcggcatgctggtggcgctggttatcttccgcctgtttgccgtaccggccatgaaacgctacgacagcgaagtgggtcttgattccacctggaacaacccggtggcgaagaaaaacggcgtcggcggctggctgctcggcctggcggcaggcgtggcgattgtcgtggcgcttatcgcgcagggcgtgattgtgattaacccggtcgctgtcgccagcgtgctggtatacgtcattgccgcctcggtagccctctactttatctggctgtttgtctttgccgggcttaaccgtaaagagcgcgccagactgctggtgtgctttatcctgctggtttccgccgccttcttctggtcggctttcgaacagaaaccgacgtcatttaacctgttcgctaatgactataccaatcgtatgatcggtgattttgagatccctgcggtgtggttccagtccattaatgcgctgttcattatcattctggcgccggtgttcagctgggcatggccgatgctggcgcgtaaaaatgtgcgcatgagcagtatgaccaaatttgtgatcggcattttgtgcgctgcgggcggctttgggctgatgatgctggcggcgcagaacgtgctggcgaacggcggggcaggcgtatcgccattctggctggtgggcagcatcctgatgctgaccctcggcgagctgtgcttaagcccgattggtctggcgaccatgacgctgctggcgccggaaagaatgcgtggtcagatgatggggctgtggttctgcgccagtgcgctgggcaacctggcggcgggtctgattggcggtcatgtgaaggcggatcagctggatatgctgccggatctgttcgcgcgctgctctattgcgctgttgatttgcgcggcggtgctgaccctgcttatcgttccggtgcgtcgtatgctggaaaatgcccaggtgaaaactgaagcaaaaccggttgctgatgcctgagtgatataacaacgctatggcaggtgtaagcctgccttagcgtcttgccgtatcaggcatagcgaccaaagacatgataaagacccgtcaggttattgactgcaaatttatgataaatgttgcgacgatggtggctcaccgttttgccgctgacgtccagataacgtgagatttccttattatttcgccctgaaataatgtagggcaataaatcactttcccgcttcgtcaggttcttctctttttcaatatgatacagccgcctgtttttggtgacgataatatgctgattgccggaggcaaaatccttcaggcacgcctttaatttgcggatggcactgacgcaatcaattgagtaatcggaaacggtattgataagaatattttcaatggtgttttcgaagcagctttcacgcgtaataaatataaaataactatctggatacttattcttaacaaccagcagatcgatgagttgctgaatgtctgactgcccataatccaccactatcgcttttgtttgactaagtattttcttggtgaatgtattaatggtatcgctgtacatcacccgtgaaaaggatttgcactcggtaagtagttgacgggaaagctcatgaaacccttcacgaaagaagctgcatgacgttattacagcgatcattatccataacctttattaaaaatattcatggtggcaataattacctgtgacggcaataaaaggcaattaagaaataggatttggattataagaaaactcttaccaaaaaagaagcatatcgtgcggcgacattatttttattacgatggtgcttaataactgtataaaaaacagatggctatatttttctttaagataaatcgtattagggcagcaactgtctgaatggatcgcgaactttcctctgatatgtttggagtcgtaacaaaatgtgaactcattaattaaagtacaggcccgctgtcggtaacgggaacgccgtaaacaaatcgcggcgcattaccttaaataaggctgaatacttaaggagtatggtatggagaagaatttccgcatcacccgcattgccagaagtgtagggctggtattaggtggcagtcttatcgttcctcacctcagcgctgcaaatacctgtgtcccttttagcgccggaacctgcgggcttaaggagttgcaggtcactaccagccttaatccaaaaccgacagcctggtattttaccagcccaacccaggatgccgccattaacggcgatgcggccgcgaaaagcatctatttcgccagcggtacctcgtcacgtggcgataatgacattcaaaacctgttggttgatggcgcgaaattagataacgcttatattaacgccagtaaaaaaggcaccgccagtattacgctggcgaataacgcgtccgtggactggctggaggctggcggcggcaccacgcatttacagataaaagtcgatcgctccaccgtgaacggcgcgcaggcggacgtggactacgataagaacggcaaaacccctgccagtaaaaactatgccagaggatcggcgctctacctcagtaccaccgataacggtaatcaaaaaatcgatattgttaacggcagcgtgctgaacggcagagtgttaaccggcggtggcggtattcatgaaataaatatcgaagagagccagttgaataagggcggcgtggtgatctccggtagccgcaataacaataccatcgcgttgaaaaatagccgtattgataccgccggcgcggtggtgccaacggataaagcgctgcacattaccagcttcgccaccacggaaatccagaacgacattgcgctggaaaacagccagcttaacggcagcatttcggtcaccaacccgaaaaccggtttaaataccctgacgctgaacggcagtaccgtgacgaaaaccactaatgccaatggcgatgcgattatcgtgaacggcggcacctccacccgtctggcggcggcgtccagcacaattaatggcaatatcgcgctgaccagcagcgatcgtgtgcaggttgatctgcaaaacgctcagcttaacggcaatatgacgctcggcaacgccagcggtattgatgtaaaactcagtaataatgcgcatatcaccggcgatgtgatcctcgcgggtgacactgtgcagagcgcgaacgtgctgctcgacaatgccgttatcgacggtcacctctacggcagcgtcaacagcgccctgacgctggcccgctcgatgacccgtctggatggcagtaaattcagcaatatcagtaagctgaatattatcggccagaccgcgatacagggcggctttaccgacggtaacgtcggccaggcgttgcaggtgaacggcggcaaagtgaccgcccccgtcgatctgagcctgggaaaactgacgttcagtgcggcgcagattatggcggatacgctctccctgcgcgatggcgcctcgcttgagctgactaacaagagcctgctgcaaacccggtcagcacagctttttaatcaggacgccagcactgataccactggcggatttaacgctaccggatcgcgcatccgcattaatgacagcaccctggtgttaaccgacagcacctatcagctcggctacgtgaagtcgataaaccagctgctggaaggccacaccaatggcgcgctggtgatgaccggacaactggtcaacggcgatacggccgtgggcaccgtcactatcgccgacgccgcggttgccggggcggtactttcagaggtgcaggtcacggcggataaaaaccatctggtgataggcgcgtccggcgcgccgctgccggaggatgccatcggcgtggaaaacagtttcggcgccgcgcagctggtgctggaaggcacgcaggatgcagaggttgaaatcaccggcggccagtcgctgacgctgaccggggcgatgggcggcgcgctgattggcgtcgccggggcgcctgaggcaaatgtgaatatcaacgtcagcaacggcgcgctgaacctcggcgccagggccaccggtaacaccagcggcacgctgcatggcaatatcagcgtgggcagcgacagccagatgaacgtggtcgccggacaccacagcgtgacctccggcaacagcgaagcggccattgtcagcagcggtacggtgaatatctatcagaacgctatttttgacgccgacctggcgttgcaggatgaggcgcaactgaacgttcagggggcgcttaatgcggagcatctgatcgcagggcaggacgccatgatcacagtcggcaatctcaccgccgcgggatcgctggtgatcggcgatgcggatctgcagggcgcgcggatgtttatcgacccggcgtggaagagcggcgcaaccctgaaagacgcctcgcaggtggtgatggccggtcgcgaggtgaatggtcgcctgaccaccgggcagaatgccctgctggtgctgggggacacgtccagcgcagctgcgctgcaacacttcgccgacagcgggcttcgctggggcaaagagagtattaccgcggcactggcgattggcgcaccgcaaacgctggcggcaggaacgggcggtctgcgtattgatggctcgctgaccagcgcatcggcttcccgtgacgccacggtgaaccacgctgaatttggcgaacattcgctgctgatggtgaacgcttccgccgccgcagggcacggggcgctgaacgccactgacggcacgttaaaagtggcagactcggccgcgctttatatcgccgacgccagagccaataaaacctataccattgcgaacggtttcagtgacatccagcgggaagggcagggctggcagggggcgaacctggtggtgaacaagctgcttgacgccaccacacaggaaaataacggcgcggtaacggtcaccacctccgccaaagcgtcgcaggtggtcctgccgggcgtggcgatcggtaatgcgctcaacagcatgatcagcagcgggtcgaactcgctggccagtccgcacgccagtattcgcctgctgtcgaccgccattgaagatcccaaagtgcacaacagcgaggtgatcaaaaccctcaacagcgtggcgcaactggctattgcgggcggggtgcagagcagcacgctggcgaccgggatggccgctgccggggcgattcaggacaggctgtcggtcaccggtaacgggctgcaagcggataaggatgccagcgtctgggtgcaggcgctgtatggcaaccagcgcaaccgcgatttgcacgcctcgcgcatgacctacggctatgacaccgacttcaccggcctgatagtgggcagcgatatggcttatgacagcgcgctgggggcgatgcgcagcggcggcgcggttcatgccggtaacggtgaaaccgactccaccggtgacttcaacgccaccagtaatgacttcagcttctggggcgtcgcgctgtatcagaactgggcgagtcagggcgcgaacgtcactgcggacatcggctacagcgaaaaccgtaacgaccttgaacagcgtattccggcatggacaaatctggatggcaaagtgaagggctcggtggattcgcatttgttcaccgtcggcatcactggtgaatatcggattaacacgccgctggtggagattgtcccgcacgcgggcgctcgcttcaaccaactgaccacccgcgggttcgatactaacggcagccgtcgcgacagcctgttcataacggatcaaacgcgtcaggatatctggcagttcccggcgggtgtgaagtttactaaagccttcgcgctggatgcgggctgggatctgcgcgcccgggctgatgtcggagtgattgctgtcgcaggcgacacgcgcacgcagagcagagtctccgcacctgggatccaggcttctgacgtgattgccgccgatgtggtcgacaacaccgcgttcaacggacaactgggcgtgaagctgcacaaaggcaacatggccttcggtgttggctacaacatcacggcgtctgaacacagcaccggtcagacgataggcgcaacctataaactttccttctgataacatgaggatcgcgggcgtcaggcccgcgatttttttagcttaaatcatgcagggctttatcgagcggcggcgtaagcgttatctccggaaactccaccgccagcccgcgccgttcaggcgtacagcacatcacgcccactttcgccgggccacgcggaaaccagcctaaacgcagcagcggccagtgctggccatcggtggaatactgtagccgcagactgtcgcctttacgcgttagccgcagccagaaaatgcgcggatcgcccggaaaaatccccgtcgcccagtctgaattctcccgcgtcagcacgctgccgatagccggcgcgccatcgttatactcaatgccggcttttaaccagtagtgctcgtcgatcatcagcatgatccccgcctggtcgtacagcgtgttgaaatcggcgcatacctttacctggaaggtaaagtcatcggcgacctctgttgcgaaaatatgcccggaaaagcgctcaaagccataccaggttttttgccagaagtctgtcttttcgtcggtaataacctgtaatttaccgttttcgtaatgccactgtgcgggttcattgatccagttaaaatttactgacatgcagcctccagcgtcgtcaggatgaagtctcagtgtagaatctttcatacaaaacagcctatggcgtacgcaccatttcatactgggcaatcaccatttccttaaagcccgccccttcaaacaatgaagaaaaagcggacggaacggcgacgggcgttccaatcccaggatattgcgcgttgattttttgcaatagctggcgggcaaggccctgacggcggtgcgcgggatccacgaaaagatagcgcagctgcggcgtggctgtcagcgtggcgatcaccccccaggcgtgctcgccatctttcaccacccgacacggcagcgacgggaagcagagcggatcgagctgccagggcgtattttcagccgggccgcgataaatcgcgcacagcaggccatccagcgagtcgtctgccagttcagtcctgggttcgacaagcttgccctgatagccgcacagttcgcgcgcgacgcaaaatcccagcgattgatacagcgcaatggcaggcctgttctcgcggatcacctcaagcgacagagaggtgacctctgttagcccggcaaataacacgctcagcatcggtttggtcagccctttaccgcgccagccaggctggatcgcaaaggccgccagccgcgcgcggttgccccgccgcgtaataagcgcgatcgccacaggctcgttatccgcaaaccagacgcaggaatctgcaaagctcagcccctcggcaataaagcgggcggcaaagtgctctggcgttagcgtaaaaggaacaaaataatcctgaaaacagcgcccgagaatatccgtcagctcagtgatgctgagcgcgtaagcgggtacggcggtaaaaggcatcgcatctctccatgaacaaatgagtcacttattctacagggtaacgccgacggttactgttgggttgacggcaaaaggcagctacactcagtttgcagataacattgcgcatgttgcgcgcttttgccagaggatatgacaatgcaccacacgatgaaaaacgatcctgaagatacgtcaaaagaagaaacccagggttccggcctgttgcagcaaaaaatgctcgcctcccgctcgatcattatttccggtgagatcaaccagacgctggccgaaaaagtagtgacgcagctgatcctgttgcaaagcatcaacaatgatccgattaagctttatatcaacagccagggcggtcatgttgaagcgggcgataccatccacgactttatcaaattcattcgtccggaagtgcatgtcattggtaccggctgggtcgccagcgccgggatcaccatttacctggcagcgaaaaaagagcaccgctattctctgccaaatacccgttttatgatccatcagccgttaggcggcgtgcgtggtcaggcaacggatattgaaattgaagcgcgtgaaattattcgcatgcaggaaagggttaacaagctgattgccgacgcgaccgggcagccgctggaaaaagtgaaaaaagattcagaccgtaactactggatgtcaccggagcaggcgctggattacggcgtcgtcggtaaattaattcagcactatgacgatttaaacctcgactaagcctgtattgcgcgcataaaaaaagctccctcgggagcttttttgtctggcggcgccaggacaggctcgctgacttattttgtcagttcagcggtcatgtgcacgttattactgacgttagcttcagtaattttataggatgcgccagctttctctgcttttgcggcaatctgcgcttcagcggcgtccagcgtggaggcagaagcggtaacggattgtgcgaaagcgccgaaagacatcagggacagagcggctacagcggccagggttttaacgtttttcatgataattccttaaacagtatattcggtaagagcgttaactttttgttcagggatcgccagttactggagatcgcctgcggtcaggttttcaggatcgaaagcgtgactgtattccaggtggttccgatgcgcggtgttatcgatattcgaaccggcttcaggacgcggtgtagagttattggctgccattgcgccaaaggagacggtggcggccaggataaaagcagtaactacgctgatgtttttcattttttgtaccttctttcatcaagggtcgttatcggcgacttatttataaattaccgcagtaccgtgcagcgtattcgggccggtaatagaagtgatgcggtaagacttcgcgcccatttcatcggctttctgtgccagttctgcttccagtgatgcgatgttagtgcccgcgttagctgagatatgccccactttctgctgaccggcgggagtcgcatcaacctgcaccgcagcgacgcttgcgaaagagagtgaactcaggatggcgacggcgaacagagctttaacgtttttcataatcagtaccttcagtattcggtgtaatgagtgtcgtaagtaattacttaacgatcgatagacaaatgatagatgtgatctgcatcacacgtcaaccttattttttaatgaccgttaatataattattaaacccatataaatcatttagatacatggaaaaattttttgtataaaacctgctggtcatcgctgccgacttgtttttataatgattactatataaatcactgaaagcagggggccgaatgaccatgcagatgacaagttgtacgaagaaaggcaggggacgacccaaagtgtttgaccgtgaggccacgctggatcgggcgatggaattattctggcagcacggctacgaagcgacctcgcttgccgatctggtagaggcgacaggcgcgaaggcgccgacgttatatgcagaatttactaataaagagggactgttccgggcggtactggaccgctatgtcagtacctttgccgccaggcacaaagcgcagttgttctgcgatgagaaacccgtggagcaggccgtgcgtgactatctcaccgcgctggcccgttgctttaccagcacagataccccggcaggttgttttctgatcaatacttccgccacggtatcggcatcttcagagcaaatcgcctgtgctgtgcgtacccgtcatgcgcaggaagaaaagatgctgctggcgtttttaacgcaacggcaggaaaagggtgaactgcccgcccacaccgatttgtcagcattgaccgcttttataagctgcctgatccaggggatgtcggtcagcgcccgtgaaggggcgtcgcctgaagatctgatgcaaattatcgatacgacgctggcgttgtggccgacgttagtttcgtcttaagtcattaaaatgattggttttactgataaatggcgatatggccggaaatgtgaccggatacgataataaaaaattttcagataattctgctaaaaaagcacaattttaaggcggtctggtataaaccatctataatctctattcatacctttgagggtgaaaatgtgaacaatggtttttaccggatccggtacaaaggtatcgtgcagctcgcattctatacgaatgaagaagtagaaaaccttgacaccggtacgcagacaatgggtttctggcgctttgttgagggctttgaaatcgacaacaatgacgagattggtgtactgggtgggccttatgacgcctttggaaactcgctgacgagcattgtattaagcaatgaacctgtttatacgggtggcattttcggcagcggcgaacaaacggaacaaatataatctcagataggccgatcggacgatcggcctttctttttactgcttaaaagcagcagatgaaattacgcctgctgttcagcaaggatcgtcagtttctcatctgtggctttttcttcttccagggtttcacccagtaaacgggcagcttctttataacccagtttcaccgccagtgcgcgaagcgtaccgtaagtggcgatctcatagtgctcgaccttttgcgcagcgccaatcaaaccagcgtcacgtaccgggcccgcttccacagaatcgatgatttcctgggcttcctcgaccagaccttctaacgcatggcatttcattcgcttaatgcgtacaccctcagttgcttccaccagttgatcaagacgctcaatctgaccttgcgtctcttcaaggtgttgtttaaacgcggcgaccagtttctcatcggtggctgcgcgagccattttcggcagggcacgcgtaatttgcttctcagcgctgtaaacgtctgataaatcgtgaatgaataaatcttctaaagtcttaatggtcattttgtattccttaaataatcattggagaaacaatccgcaaattatgcgggattacgcgatggtcagatttcagtttagacgatcctcaaaatttgcaatgaaaataaaaatttagattatgggatgattcctggtgaaaatcaggcgggggataattacgtcacctgtataaactatgtgaaagtaatacttctttattaattgccgggccgggaaataccagaacagcggcatgataagttggcaagtaagaattttcctttaatccagtacggaaaacgatacacttcaacatacgttgtaatgaagtcgttgaggaaagaacgatgctttcgaatatccacacccgtaccgggcagccgtcgctgttccgggcaggtgtccaggcctgtttccctacgctccccggttactggagtatcggtatcgcggcaggcgcgatagggacgttatccggcttttctgttgtgcaaatcacgctgctggcagggtgtctttacgcggggtccgcgcatttccttttttactccttatgggccgccggggcagaaaccgcctccatcgtgctgagcgtgctgctcgtcaacctgcgttatctgttgatgagttcctctgtcagcctctttttccagcacagcaccacgtatcagaaaattgtcagcggcctgctgttgaccgatgaaacctttggcgtggccgtacagtatggtagtgaagcaggtgaaattccctttaaatggatgcttggcctgaacctcacggcctggattaactggatcatctcctgcgtactgggagcctggctggcgtcgtcgctgcctgccgcactgatggaaggcctgagctttagcctggtatcgatgtttatcgggctgatcctgatgacctggtttgccagtaaacgacaacgtctggaaacgctgactatcgtcaccgcgatggtcataaccctgttatttcactcatggtcgaacaccagcctggttgttatttttgccgcttcagcggcagctactctggccacactggtgttgatcaaaatggaaaaaaggggcaaataacatggacagaaatattattctggcaattgcgctggtgtcgattgttactgctgccatgcgcgtcatgccgttattgttattatcccgtatgcgtttatccttcacgctgcaacaatggctggcttttattccctccggaattatgactgccatcgtggtgactgagctgctccagaaaccagcgatgaccgcctccgggctcagcgtatcgctgctggcggcgattgtcgcaaccctggtcggcgcgcttacccgcagcttattcgccaccgtgattagcggtatggtcgctttttccgtgctgcaattaatgagctggctataattttttacctgttacttttagtcacagcttttctggcgcaggggataacctctcctgcgccatggacggcggccagatcgcgccataataaatgaaatttgcgctaagcgcgttttgtaatgtaaaagccacaataattaaaagtgaatagccctatttaaccgttttaatttcgatgatataaatattccgagcatgtcacatccccaattcaggtagtgcgaatttgcctaaatgagataactacgcatccgccagcacgtaaaaatgaaatatgcttaaccgctgttggtttctggatgtaatagaaacaataatctacatgcaattcgcgaggcctgaatgattattctcattaccctcagtcagaggctgtgcctgtgttaatgatcgctgttcgctttcgggagcaacgccagtaaaaatgatgactgatgataaaaaaacctttaatcccagggatgtagacctgaaacacctgaacgatctgcttaatcataattccgactggatttgggaagtggatgcgcagggacgttatacctggtcgtcggaggtggtcaccagtctgctgggatacacaccggacgaagtgattggttgtacgccctttgattttatgccgccgggtgaggccgagcgggtggccggtgcgtttctggctattgtgcagcagcagatccccttttccgggctggttaaccgcaataagcgggcggacggggaagtgatcgtgctggaaaccagcggcattccgctgttcgacgagaagggcgaactgcgtggctatcggggtgtggatcgcaatatctccaccctgggcgaacgcgtcctgcaactggaaaccatctacgataccacgccggtggcgctgtgcatgatcgaccgcaacgggcagatggtgatgtccaacaaagccatggcgcggctgttaaaccgcaccagcaatgaaataaacggcaaacctgttgttgagctgatgccggcctgctggcagcacttcgagcgggattttacgctggcggatagcggcgctgagctcgccgggcgcgaaacccactgggaagggcgtaccttctcattgcatccggtgccggtacatgatgcggcgggtaacgttgtcgggctgtccgtcacctgggtggatgtgaccgaacggtatcaggccgaacaaaaactggcggatgccaatcaggtattacagcagcacgcccagcatgactatctcaccgggctgtttaaccgtcgctttatggacgagtgcctgaaccgtgaaattatccgcgcctgtgaaaagggctattttctgtcggtttgtctggcggatattgattatttcaaacgctttaacgacagtcagggccaccaggcaggggatgcctgcctgcgggatgtcgctaacgcgctgaccgccgtgcgtcaccggcccgatgataacgtcagccgttacggcggcgaagagtttctggtcattttaccctgcaccgatcgcgaggaagcgcaggccattgccgaggggctgcgtgaaagtattgaggcgctgcggatcccgaatgccgcaagcccgaccggttttttaactatcagcatcggcgtcgccacgctcaatggcagcaaaacgctgccgcaggacaaaccgctgcctattattgccagtggcttaattcgccgcgcggataacgcgctgtatgccgcgaaaaatcagggcagaaaccgggtggttatttcccgggagccggaaggccattagccctgcacgttatactgatgttgttaaccgttttttaggatctggagcatgatttctaccctgatttaccggagtcgcctgacaagcagctttgacccttcaaagctgggcgaactggtatgcgtctcccggacccgtaacgccgctatgggtatctctggcatcctgctgtttgacggtagccattttttgcaggtgctggaaggcccgctggagaaggttaaccagctgtacgaaagcattaacgccgatccacgccacgactccgtggtcgaactgatgcgcgactatgcgccaaaacgccatttccagactaacggcatggcgctgtatgatttacgcaccggcaatccgcgcgccatcctgcgctcggtgatcagcgccggggcgctgaatttcagactcgccagcgatgcccgggtgtacaagtttattaagtcctttatgcgcgggcgctggcgcgatatcaatccacggctgtcagagcccgctaactgggaatttgttgcggaaaatttgaccttcacgcaaccgcaggcgatgctgtttgccgatcagccctgccagtttgccatccagccgattgtcgagccgctgcgcgggcaaattagctcctttgaagcgctgatccgcagtcccaccggcggttcgcctcatgattattttgcctccataccgccggggaaaattcacgaggctgatttgctgtccaaggagtatgcttttgcgcttgcgaaaaaaatcggcattggcagcaataaactttccattaacctgttgccgatgtcgctggtcaaaatccctgacgcggtaaatatcctgctcgatcaaattacccgcaacggcctggtgccggaacaggtgatcgtcgaggtgacggaagatgaagtgatttccggctacgacgccttcgcctttgccattatgcaactgcgctcggcggggattggccttgcaatcgacgatttcggtgcgggctttgcggggctgtcattattaaccaaattccagcccggcgagctgaaaatcgatcgcagcattattaccgatattcacctgcacggcccgcagcaggcgatcctcaatgccatcataaaatgctgtgccgagctggagatcgacgtggtggcggagggcgtcgaaaaggttgaagagtggtgctggctggaggccgcaggcattaaacatttccagggatatttatttgcgcgtccgggtctcaaccgtgtaccgccaatccgctggccggtaaaaatcaaaaactgacgccgctttttccatcctgttgatttatctgcgccttaaccctaaagatccgcccgataatgccgttatgctttgcagggttatatttaatgtctggcaaggatccgcattatggaaaataaacaccaactgctggctacgcgtcttggggaaattctcgggcgttttaataatggcgagacgctgtacgtaaaccaactggcggaagagtatggcgtgcatccgcgcaccattaagcgcgatattctcgaacgcctgagttttctggatattgagccacaggcggaacgcggcggttacaaaattgcgcccggactgctgggacgcttcgatgccaacagcatcgatctctttgcgcggctggcgggcgtcagcgaactgtttccgggctttaataagcgcatgctgtcatccatgcattcggccaccgccagtcagaccatcacggtacacgggcatcgctatattgacagcgaacttcaggccgttcacttttcccgtttacagcgcgccattgacgagcactgctgcgtcaacttccgctacctgcgtcgtaacgaggagcgccgttatgcggtggagccttatcagctcaccaatctgaacggcatctggtacctggcggcgcgtcatgaaaaccgcatgaaaaacttcaccttaaccaagatcaccgcgctggattgtacctttgaaacctttgagccggatggagaactactggcaaaaatgcgtcaggaaccgagcgtgtggggcgtggaagataagttcagcgtgacgctcagcgtggcgccggaggtggcggagtatttccagcgccgggatctgctcaacgagcaggtgatcgaacagcacaccgccgatggcggcctgatcgtcaccactcaggtggcgcataaaaaagagatcctgccggtggtgcagtactggatcccgcacctgaagatcctcgcacctgcatcactgcaaagcgaaatggaagcggagatcaaaagctggctgacggcgtaaacgcgtttcaggtcagcggcacgcgcggcttcaccaggccgtgcagcgccggattatcgctttcatcctttagttttacgccggtcagacggcgtaaaaacgcctgctccagcagccatgccagcttaaacgccgccgcgtcgtggcacagcccttccggacggatattggaaatgcagttgcgctccgactccagccgcgtgcggcccggtttccacgtcaggtaaacgcccaggctgtccggcgacgacaggccggggcgctcgccaatcaaaatcgccaccgccttgctgttcagcgtttcgccgatgtcatcccccagcgcgacccgtgactgatgcgccagcaccacaggcgcgagggacaatcctagcgtgtgcagatacggcagcagggcggcgatcagcggcaccgcctggcgatgcaccgcatgggacgagagcccgtcgccaatcaccagcagcagatcgtgtgcggcaacgggatgatcacgcagtgcgtcacggctttcctcactcaatttgcggcccagatccgggcgatttaaataaatatgccgatccgccgccgcgctgtgaacggtcagggtttgcaggccgagcgccgctaattcgttttccagcgagcggctgtcaaagggctggtggatggcgtcgcgcgcctgcgcatgggcgagaccaaaattcagtacctcgcgggttggcaggctggccccgctgcggccgagggcgatacgcgcatcggtaaattcccgcaacagtgaccaggcatcgggatttttcatactgtcgctccctgcggcagaatgctgagcaacgggtgactggcaccggttaagcgcagctggccgctattgtcgatgatctgcatgcgggtcagccattcgccgaactccggggcatgtttcaggccgagcagacgccgggcgtagagcgcatcgtgaaaggaggtgctctgataattgagcatgatgtcatccgcgcccggcacgccaatcaggaaggtcagcccggcgttgcacagcagcgtcagcagggtatccatatcatcctgatccgcctcggcatggttggtgtagcagacgtcgcagccaatcggcagtcccatcagtttgccgcagaagtgatcttccagcccggcgcggatgatctgtttgccgtcatagagatattccgggccaataaagcccaccacggtattcaccagcaggggatcaaaatgccgcgccaccgcgtaggcccgcgcttcgcaggtttgctgatcgacgccgtgatgcgctcccgccgacaggcaactgccctggccggtttcaaaatacatcaggttactgccgagcgtaccccgtccaagactcagcgccgcctcctgcgcctcgcgcagcaacgccagattgatgccaaaaccgctgttcgccgcttcggtgcctgccaccgactgaaataccagatcgacaggcgcgccgcgttcgatcagttgcagcgtgttggtgacgtgcgtcagcacgcaggactgggtggggatcgcaaagcggtcaatgatatccgccatcatatgattcagtcgctccagcaccggcaggctgtcgctggcgggattaattcccactaccgcgtcacccgcgccgtacagcaggccgtcgagcatactggcggcattgccttttaaatcgtccgtggggtgattcggttgcaggcgcacgctaaggtgccccggcagaccgatggtgttgcgaaaacgagtgatcacccggcatttactggcggcgaggatcagatcctggttgcgcataattttgctgacggccgccgccatttccggcgtgatggcgcgggcgacgcggcttaatgtctgcgtgtcggtactgtcctccagtagccagtcgcgaaaatctcccaccgtcaggtgactgatgtcgcgaaatgcttcctggtcatgggtatcgataatcagccgggtgacttcgtcctgctcgtaggggataagcggatccgcaaggatgttacgcagcggcacctccgccagcgccatttttgccgccatgcgctcttccgcagactctgcgctgacacccgccagcacatccccggagcgcgccggggacgctttcgccagcagatctttcaggctggcgaagcggtaggtccggtgcgccagagtggttttatacatggtgtctcctcaggagagcgcccgcaattgcggatccagcgccgcctgctcgcgggccgacgcggttttgcgaaaccacagataacccgcgagcatcatggcggcaaaaatcagcgccagcagcgggttataccagaccatcgccaccagacagagcaccgccattgcgagcgcgaaggctggcgcatacgggaacagcggcgcgcgaaatggccggatcagccggggttcgctgcggcgcagtttgaacagcgcggccatggaagtgatatacataacaatagcgccaaataccgacatcgtcacaatgcaggcggtaagcggcataccgctgatggtgatgagcgaatcggagaagatcgccgcgatccccaccacgccgcccgcgaggatcgccagatgaggcgtgcgggtgcggcggttaagggtggcgagccgcgccggtaagtaacccgccctggccagagagtagatctggcgggaatagcccatgatgatgccgtgaaatgacgccaccaggccaaacagcccgagccacaccagcatgtgcagccagccactgctgctgccgaccaccgctttcatcgcctgcggcagcggatcgttaatgttcgacagggcgcgccagtcgccgacgccgccggcaaatatcatcacgccgactgccagcacggtgagcgtcagaataccgccgcccagcgcgcggggaatggtgcgctggggatctttggcttcttcggccgccatggatgcgccttcgatggcgaggaaaaaccagatggcaaaggggattgcggcaaacatccccggcagcgccaggctgctgaagctttccgcgccagcccagccgtgggcggtaaagttgtcccatgagaagccaggcgcaaccacgcccataaacaccagcagttcgaaaatcgccagcagggtgacgatcagctcaaaggtggcggcgatgccgacgcccataatgttcagcgtcataaagatgacgtaagcgccgcaggccacccattttggatcgagcgacgggaactgaacgttgaggtaggcgccaatcgccatggcgatcgccggtggcgcaaacacgaattctatcagcgtggcgaatccggcaataaacccgccggtcggcccgaaggcgcgatacgcatacgcaaaaggcccaccggcatgaggaatggcggtggtaagctccgtaaagctaaaaataaaggcgcagtacatggcggcgatcagcagggcgacaatcaaaaacccgagcgtgcccgcctgcgaccagccgtagctccagccgaaatattcccctgaaatcaccagtccaacagcaatgccccacagacggaagctgccgagcgttctttttaaggtggttgtttctgtgttcatcgtgaagtgcctcgccattaaacccagtcggaaaaggcgttgcaaaggcgatgccagaaataaacctcatcattttcatgtggatagcgtaaaggtgaacacccactgcaccgtcatgaacgttatgacggtgcagtttgctccggcgtagtgaaagggcgattaaaatatccaggtgagatcaagcgccgcattgacgccagtatagttttccagcggcatatcgtaccactgcttgccgagggtaatgcccagcacccagtgcgcattcagaggctgtacgcggcgcaggctgacgctttgcgtggtgccggtgtagctctccggcgcccagtcatagttataggcaccgctgccccaggcaaaccacatctgggtgctgcctttgccagcggcgtcgttgagtttcagcgacaccacatgactgtagctgtccccggcgccgtgtgagtcgtaccaggtataacgccagttggtgatggtcggccccgcgtaatacgttaaccctgcggaccaggcgtccacatcgacgccgccataataccgggcagtgcgatagcctcccgtgaccagcagtggtttaagcactttgagcgttacatcctgctggagatcctggcgggcgaaaacgggcgtatcttctgccagcgcgatgctgctgcgggtggacagcctgtcattccagcgatgccagagggacgcgcggccccgcacgctgtgatagcgctcaccggccgcgtattcccgctccccttcgctgagattaaccaccagcgcgcccttatccagcgtatttttgatttcagcaaacagcatattccgcgaaccatgggagccggaatagtcgttaaaatcatagccggcggtcaggctggtgagctccgcgtgcaacggcgcgcacatcagggttgccgttattgccagcgcaattcgcctcatctgtcatctccttatgaatgatttcctgtttcaggctgtagcggccggatggcagatttttctccaccagaatacgcggccccagcagggtatccggcgcgattatgcgtcccggcaaaatgatcacctggatgcccagccgcgcaccccggccaatccaggcgccgagcttttcacagccggtgtcgatccgctctcctgctatatcgacgctgacggttttgccatcaagccggtggttgctggtgcgtacctgcgcccccagataggcgtcctgcccgatcgccgagtcggcaataaaacattgcggcccaatggcgacgttcttttcaatgaccgcgtttttgatttcagtggcgaagcccaccctgacattgttgctcagcacgctgccgggacgaataaaggcgtagttgccgatcaggcaatgagcgcctatcaccgcgggcccctggatcaccgcgccgtggcaaatttttgtgccctggccgatgcggacttcccccgcgctttcgtcgatcagcgccgtcggggcaatctccacaggagcggttgccgaaggctcaagcctgagatagctgatcatcagcggcgacaggtttgccggttgaagcgggcggcgtttccaccacggcagcataacgggtgggtttgtcgcgctgaggttcacgtccagtgaaaaaggcaataattccataaaccatccatatggcgtaggccagtaatacgtaaaacacagagagaggtgccagcggaattaatagccagcagcgatgataccaggcgctgaaggtgccgatcacacagacgatccccacccagatcagcgggaagacagactccacaatccctatgggcccgtgcgtaatgatgctccacgtccagaccatcgcgtaggtcatgacgccgtaaatcaccaccagcaccatgggcaggattgaaaatatgccgaagcggcttaagatcagcgatttatgcaaacgcatgcagacggcgtaacccacaatccagcgtcgccagcgtttccactcatcccgaaaggtattgcactcctgggggtaaaccacgcagcgattggcctggcggatgcaataaccgttggcgatcagcgtccaggagagatcgagatcttcaactttggtgcgatcggaaaagccatatttacgcagtacccgggtacggaacatgccgcaggccccgctgatgatgaagggcgcgccgccgagaaactgctgtaaggtgcgtttcatgacgatcatcggcagctttaccgtggcgcgaatatggggaagaatgcctgcaccctgaaggtgggttgatgggataccgccaacggcatccgcgccgctgtcaatttccgccagcatgtagccgatcccgtcctgatcgtagggcacccaggtgtcggcatcgctcagaaaaacctgatcgcaggtggcgtattgcagaccattcatcagcgcgccgcctttaccggtatttttttgcgtcacggctataaaacggtcgccccatttttttttcacctgcgccattacggcttctgtattatcggttgagccatcattgacgcaaatgaccgtgcggaaataaggattacgcagcagattatccagtgactgggcgaggcaggggccttcgttataggcgggaataatggcatccacttcaccatatcgccggctgggttttttatttaagcgcagcaggatccagcaaaggatagtgatactcatcataataaaaatgatagttttcattttttctcacaaaatcattttttgcacaacgaaaccttcgcacaaattcatgcctgcctgtaaaccacgaaattgagccagcgctcttatggactcaggctgcatataatcgcgatgtttctggctttgatgaaatttaagggcggcaattttattcgtcagcgccttctcatcaaactcttcaaaggcttgcggaataaaagacagacgacagcttggcgtttcataacacaatatttgcggtatggtgcgacaggcgaccatcgaggcctgataggttgcgcggtggtcctgatggcggtctttgtcgtgcatggtgtaagtacgcacaaacctgataccagcgtcttcctgtgcttttatcacttcaccgatgctgttgataatggcatccagataatgatcggtgcgggtatcctgataatgaaacggaaataaatcctgacagcccagcgtgttcagcgccagccgggattcatcatgacggcttattcccgcagggcaaccggcattacccgcagtaagaataatagcggtaatgtgaaagccttttgcagcaagattagccagggtcgcaccgcagccaagttcaatatcatccgggtgcgcgccaattgccagaataccaggtttacggttttgtataaaatgatcagaaataccgacgtgcattttactatccacaatagtcatcctttattgtagtttttttgttgtttttataatggtgcgggtgcgcgggctattgtgtttctgaacgtagtaaaatgtcctttgtcgatagtttgcatcttataaacaacaggcatgattttatcttgaataaaattagaagttgagaacgttaacgatattaatttggggtagggtaagtgtcaatcattatgttttagtgcatcttttaacaagatttattaattgtctggtaaatatatccctgcgctctttttcacaatttttaggattctatttagataaaaatgatgcgctattcacgaaaaagggattgttttattaagtgaatggcatcaaccctctcttaagccaaagtatgagggaaaattaattttgtaaacattcaccggtgaaatgaaaaaaatgtcacaccattaaccgaaaaatggcgtctttcccggcgggaagacgctgcaggtttaacggtgcaccccaatgtagcgctcgtagcgattggttttaagataggtgagatccaccagcaccagcccgtccacgcagtggttaaaatcgggatcgctgccgaaatcaataaactgcacgccgcccggctcgcacagctcggaatactgtttgtacagcgggggaatgccgcagcccagattgccgagcagggatttcaggcgcgtaagatcggaggtgtaatcttcgccggtaaactgtgccagcacatccggcagactggcaggataagggcggcgcgaggcggcgaaggggtgcgcaggcgggaaccacaggcggtaaaaggccaccagcaaatcccgcgcggcgggaggcagaccgccggaaatggaaaccggtccaaacagatagcgatactgcggaaaacgcgccagatacgccccgataccggaccataaatagtccagaccccggcgtccccagtagcgcggctgaataaaactgcgccccagttcgatgccctgttgcagaatatcggccattttgtcgtcgtaatggaacaggctgtggctgtaaagcccttcgatgccctgtgcgttaagggcgctggcagcaggcttaaaacggtatgcgccaaccacttccagatccgcttcatcccacaggatcagatgcagatagtcatcatcgtagcgatccgtgtcacggcgtttaccgctgccttcgcccaccgcgcgaaaggcgatctcacgcaggcggcccagttcgcgcaggatcggcgcatcttcttcgccgttgcgctgccataaatagatggtttttccgtccgcggtttgccccaggcattcggctttgcccagcgcccgcttcagggtgagacgatcttccggacgggcaatggcgcactcggttcgcaagatgccgggctggtttttgcttaaatgcatcaggtgctgacggcatttttcggccatctcccgcgaggcgctttgcggactgtaccagctatcccagggaatgcgctggccgatgttgatcggcaggctgctgttgcgacggcggaacatctgttgcattagcagcagcaacggcagcgtgcgggaaatcagcgtactggcgtaaaacagcgcgctgttgtgggcacggatatgcaccggcagcagcggagcgcggaatttcgccgccattttgacaaaacccgcctgccagctgcgatcgcgtatgccgctgcgggtcaggcgcgacacttcccccgccggaaagaagatcagcacgccgccatcctgtaactgattttccatctgttgcagcgaggcttttcgcgtgcgcccgcccagattatcgaccggaataaacaacgagctcagcggctccagatggctcagcatgcgattggtgaccacttttacatcgcggcgcacgcgggagacggcatacagcagggccaggccgtcaagcgtaccggtagggtggttggcgacgatcaccagcgggccatgttcggggatttgttcaaggtcgtgagcggaaatggtgcagcggatctgtaagtgttcaagcacctgctcgaccatctccagccctttcagatgacgatgccgggcggcgaattgctgaaactcttcttcatagaacagacgtcgcaacgcatttttttgccagggcgccggtctggcctgcggccagaggtcgtcgagtacattatcgaggctaaacatgttggctcctcctcccgtcctgatgcagacagtagaagggcatgatgacgtttacatttcagcggtatgaataaataaaatcgttaagcgggaatataaaaggcataaaaaaggcgggatacccccgccctgttgattagaggatcttgcgttccgccagatccagcgcgaagtaactgaagatcagatctgcgccggcgcgtttgatcgcgcccaggctttcgaggatcactttatcttcatcaatcgcgcccgcctgagcggcgaatttgatcatcgcgtactcgccacttacctggtatgcgccaagcggcagctgcgtgcgttcacgaatatcgcgcagaatgtccagataggcgccagccggtttcaccatcaggcagtctgcgccctgggcttcgtcgagcagggattcgcggatcgcttcacgacggttcatggggttcatctgataggttttacgatcgcctttcagcgcggtaccggcggcttcgcgaaacgggccgtaaaacgaagaggcgaatttggtggagtaggacatgatggcggtatcgttgaagccagccgcatcaagcgcctgacgtatcgcctgtacctgaccatccatcgcggcggacggggcgataaaatcagcgccggcggccgcggcgactaccgcctgcttgccaagattgatgagggttgcgtcgttatcgacaccgtgctcgcaaagcacaccgcagtggccgtgggaggtgtattcacaaaaacaggtgtcggacatcacgatcatttccggcacggcatcttttgcgatccgcgacatacgcgccaccagaccgtcttctttccaggcatcgctgccggtggcatcagtgtggtgtgatatgccgaaggtcatcaccgagcggatcccggccttcgcaatgcgttcaatttcgcgggcgagaaacttctccggtatgcgcatcacgcccggcatggcatcgatggccttgtagtcggcaagttcttcttcaacaaaaattggtaacaccaggtcgttaaggctcagtgttgtctcttcaaacatggcgcggagtgcgggtgatttgcgcagacggcgcgggcgggtgattaagtcggtcatgatttgcctgatgttggtgggacaccatggcattttacctcaatttgaccgtgatgtttcaccaaactggccttacagaccgccgtggcagactggcgtaacgtgaactcgtaatatatttactgcactataaattcgcattcatatatttatttgctaactacgtttttcatttttataaataattataggtttgctaaatgacgatttttaaataatcaccgatatcaatgtatatctggattttaatcttaaaaaatcgtcccctgatgaaaataagctggtataaccagttgttttgacaggataattcacatgttggctgtcgtgcctgattattatgtctggattcgtactttatgagcggattagttgaactttcctaaccctccaccgcataattcccggggtggcaatattattgctgttctatttttacgagctaacgaattaaatccctgaggagggatgacaaatgcactcctggaaaaagaaactcgttgtatctcaactagcattagcctgcactttggcaatcgcttctcaggcaaatgctgcaacctataatacctggggctatcacgacaatacttatactgtactggactggggtaacatggatgctccaggttctgatggcaactatgtcacttacagtggttttatttatcataacaacaccaacgctgattatgatcaatccttcaacggtgataccgttaatggcaccatttcaacttattatttaaatcatgactatgtgtcaggttcagataatacggtaaacatcgcaaactcaaatattcatggttccattacctcagaattgccgtttggttattatggtataacccctgcctccaccgacccggacacgggcgactacctgcctcgcacctatgaagggtattctttcaacgacggcacgaccatcgttgatactaactggtacgatggcgatatatttacactgaacgtcgccaattctaccattgacgatgactctgaagcgctttactttacagacatttatctggatggtacgacagggaaatccacgaacgagtctttctatacctcccgcggcgtagccgttaatctggatgtagaaagcaatattaatatgtctgataactcacgcgttgcaggtattgcgttgagccagggggataccaccaatacgaattacggctccgaatatcaccagtgggataacactatcagcgtgaccaattccacagtgacttccggttcgcaaagtccgctggaatcgtatgaggacgataatttcggcgagtttggtggtcatttcggaaactctgaagagccgagtgattacgcaggcaacggcggtgcaaatgacgtagccctgtctttcacagacaacgcggcttcacattactcaatgaagaacaacgtctatttcaatcattctactctgctgggcgatgttgaatttaccagtaactggaatgatgacggcgagtttttctattcaacgggtcatgattctaatggtgacggcattctggacactaacggtggctgggttgacgacgcacagaatgttgatgagctgaacattactctggacaacggcagcaagtgggtaggttcagcaaacatttatgctgacgatattgcgccagcgacaatgtatgatgtggcgactaatagtcttactccgggcgctatcgttgaagccaacgactggggacgcgttgtcagcaatcaggtattccagagcggcgtgtttaatgtaaccttaaataacggttctgaatgggataccgttaatggttctgtcattgatagcctggcagtaaataatagctctcaggtaaacgtaactgactctggtttaacttcagataccatcgtattaaccaacggttcatcaatgaacattggtgaagatggacaggtaaacaccgatcacctgacgattaataccttcagtaccgttgcgctgaatgatgacgtcactcactatggtgattactctctgtacgccaataccatcaccgtaacaaacggcggcgcattagatgttaatgtcgatcagtatgacaacggcgtcttcagcaccgataaactggaactgaccagcggtaacgttgcggataaccatggtgatgtggtgtccggtgtgttcaatatccacagcagcgattatgtactgaatgcggatctggtcaacgaccgtacctgggataaaacgcaggctaactacggttacggtactatcgccatgaattctgatggtcacctgaccgttaacggtaacggcgatatcaataatggcgatgaactggataacagctccattgacaacgtcattgctgcgaccggtaactataaagtgcgtatcgataacgccaccggtgccggttctgttgccgaatacaaagataaagaacttatctacattaacgaccagaacagtaacgctaccttctccgctgccaacaaagccgacctgggggcttacacctatcaggctgagcagaacggcaataccgttatcctcaagcagaaagagctgaccgattacgccaacatggcgctgagcattccgtctgccaataccaatatctggaaccttgagcaggacacgttaggcgctcgcctgaccaatggccgccatggtctgaccgataacggcggggcatgggtaagctactttggcggcagctacaacggcgataacggcaccattgcttacgatcaggatgccagcggtatcatggtgggtgttgactccctggttgaaggaaacaacgctaaatggaccatcggtgctgcggcgggcttcgcaaaaggcgacatcagcgacagaacgggtcaggttgatcaggacagtcagtctgcctggttgtattcttccgctcgctttgccaacgatgtcttcctggatggttcattaagttacaaccgtttcaataatgacctgtcagccactatgagcaacggccagtatgttgatggtgattcttcaacagacgcctggggcttcggtctgaaaatgggttatgactttaagttcgataacaccggttatctgacgccttatgccagcatcaatggtctgttccagtcgggcgatgactatcagctgagcaacgacatgcgtatggacggtcagtcttatgacagcctgcgttatgaactgggcttcgatgcgggttacaccttcaattacggtgccgaccaggcgctgaccccgtacttcaaactggcgtgggtgtatgacgacgccgacaacagtgcagaaattaataacgacgacatcgacaatggtgttgaaggttcagcggttcgtgttggactgggtacccagtttagctttaccaaaaacttcagcgcttacagcgatgcaacctacctgggcggcggcgacgttgagcaggattggggcgcgaatgttggtgtgaaatatacctggtaagaacagtatcgtttttgttcacctgttgtgtaataaagcccgccaggcaactggcgggtttatcagcaaggaaagacagtaaaaatgatcaacagccaaccggtagacgagtttcatcgtctgaatcatcggttaatgccttcaggaacgccctttgaatatgcccagggcagcgttatcgttccggaagagagtaatgaactgcgtacttacgttttccttgaaggggcaatttctttagaacgtcagaataatcggttgctgcttggcgtcgtggccgcaccggggatttttgggctcggtatcggcgcaatgccgacgcaggaacactatcatctgcatgttgaaacatcctgtcgcggctatcatcttcctgccagtaccacgttacaacttctggataaacatcagctttggcgggacgccttctactggatgacctggcaaaaccgggcgctggaagcgcgcgaccagcaactgattggcaccagctcctatgcgcaaatacgtgcaacgctactgacgatggcgaaatgggatgatgctttgcgcgcccgtataggcgttatgacctatatccagcggcgcacgctgatttcacgttcggtcattgcagaggtgctggcggcactgaggcagggtgattatattcgcatggagaagggcaagctggtctgcattaaccgcctgcccctggattactgaacgtgcgcagcggctcaggatgccgggatcacttccggcttatggccactcagctcactgaccaggtcgtttacgccgtcgctcatatttacaaaacgcgtcagcggtgaacgggtgaccacaacaaaaacgccgacattgtttttcggcaccatcgccatataggtaataaaaccgccgccaccgccggttttttgaatgatcccaggacggccatttttaggcgacatgtacacccagccaagaccgagcgcatcagccttgccggggacgtccattccgatcactcgcgtaagctgcgtgcgctgatagatcagcgtctgcatccgatcggcctgattattacgcgcataaaaatcggaggagaggaactgctgcatccagcgcatcatatcgcccggcgtcgagtacacgccgccgctgcctatggccgccagagtgttattgcagggactcgcgcctttctccgccaccatcaaccgcttgcactgatccggcgacggcgtaaaagtggtgtctttcatacccagcggacgggtaatttgctcttcgaaaagctgcggataaggtttgcctgctgcggtggacaacgcatccgccagcagatcaaaagccaggtttgaataggctgcctgcgctcccggcgcggttttcagcttagcggtagaaagccagttccagcgctgctcgcgtgttggccagacaaataccggacgatgcgccgcgccgcccggctgttcgcgcggtaacgcgctggtatgggtggcaaggttaaccagcgtaataggcgtgccgttataagtcggaacacgtgcgcctggcggggcatacttgctcaggggatcgttaagtttaaccacgccctgatccagcagtttcaccagcatctcgctggtcatcagcttggaaatcgaagcgatgcggatcacggaatcaagctgcggatggacgttgctgcccggtcgggtttcaccaaaacttcgaaacacccgctggttaccatcgatcaccaccatcgccatgccggtggcgccgctaccgtaataaatatggtttgcgtagcgatcgacaacatcagaggcaaattccggatcgagcgagggttgcgcggcattggccgacgagaagctcagcacgcccagcatcacggataaaagcagacaacgtttcaacaaagtatccatcaaagaattaagaagattatgcgtatttatactatttagctgcccgatgcaaagcccggaaaagggcattattcgcggttaaaacgtaacgatgcgtaaacagacgggttttcttgccctttaatgtctgcttctgtgacgccagccttatggtaacctcctaaacttcggcaattttctcaggggcaaagcgatgtcagccaaacgggtagtcatgattgtggatatgcagaacggtgttttcgccactccgcgcttgcagcgtgagcagtgcgtcatgcgtattaaccaactgacacaagccgcagacagggtgatttttatccagcactgcgaagagggtggtctggaagccggcagcgaaggcttcgcattattacccgaacttgttcagccagaacgggcgaactatgtgacgaaaaccgcctgcgatgctttttataaaaccgaactggcgcagctgctggaagataacggcattagcgaatttgtgatttgcggctgtgcgacagattactgcgtcgataccacgatcaaagccggggccagccgcggttacgcgatcacagtggcagaggatgctcacaccacagcgaatcgcgccgcggtcgacgcggcgtcgctgattgctcaccacaatgaggtctggcgcacgctgatcatgcccggcaatccggtgcaggtgaaatccacagaaacaattcttggcgagtggcaggcgaactaagccaccgccggttggtctgaaaggcggatttcatccgttaagcacgttgttcgctataaaaatgagaagcttcaggagcagatatgtttaagtcttttttcccaaagccgggaccattctttttgtcggcatttatttgggcgctgattgccgtaattttctggcaggcaggcgggggcgactggctacaacacattgccggtgcgtctgatgacgtcccgattggcgctgcgcgcttctggtcgggcggctatctggtcttttacgcttactacgccctctgcgtggggatttttgcgctgttctggtataaagccgcgccgcatcgctggcagaactggtcgattctgggcacggcactgatcatcttcgtcacctggtttatggtgcaggtgagcgtggcgattaacgcctggtacgcgcctttttacgatctgatccagaccgcgctcagcgcgccgcacaaagttaccctgggccagttctatcgcgaaatcggcgtcttcctgggtatcgcgctgatcgcggtgctggtggcggtgctgaataacttcttcgtcagccactatgtgttccgctggcgcacggcgatgaacgaatattacatggcgcactggcagcgtttacgccatatcgaaggggccgcgcagcgtgtgcaggaagacaccatgcgcttctccagcacgctggaagacatgggcgtcagtttcctcaacgccattatgaagctgatcgctttcctgccgattctggtgacgctgtcggcgcacgtgccggagctccccattatcgggcatatcccctatggtctggtggtggcggctatcctctggtcgctggtgggcaccggcctgctggcggtggtgggtatcaaattgccggggctggagtttaaaaatcagcgcgtggaagcggcctaccgtaaagagctggtgtatggcgaggacgatccggagcgtgccgatccgcctaccgtacgcgagctgtttgccgcggtgcgccgtaactatttccgcctctattttcactatatgtacttcaatatcgcgcgtattttttacctgcaaatcgataacgttttcggccttttcctgctgttcccgtcgattgttgccggtaccatcacgctcggactgatgacgcagatcaccaacgtatttgaccaggtgcgcagctccttccagtatctgatcaactcctggacaacgctggtggaactaatgtctatctacaagcgtttgcgtaccttcgagcgcaccctcgataacgaggaaaccccggacgttgtcaccacactgagctgatacagggaaagagtatgtctttgatcgcaccacgttttatcccgattctggccggtcttatcctcgccggatgtagcacagagcgtgcgacgccgctaaaagagggggagaaggcggttgatgtggcaggcgtggtgcgggcgaaaatgcccgccagcgtgaaagatcgcgacgcatgggcgaaggacctggcaaccacctttgaaagccagtcgctggcaccgacgctggaaaatatctgctcggtgctggcggtggcgcagcaggagtctaactatcaggccgatcccccggtgccggggctgagcaaaatcgcctggcaggagatcgacaagcgcgccgcgcggctgcacattccctcgtttgttgtgcacaccgcgctgaaaatcaactccaccacaggcaaaagctacagcgagcgtcttgataacgtgaagaccgaaaagcagctcagcgcgattttcgacgatcttattgaccgcgtgccgctgggtcagacgctctttggttcgctgaatccggtgcacaccggcgggccgatgcaggtgagcatcgactttgctgaaaagcatgccagcggttacccgtggaagatggacggctcagtgcgccaggaagtgttcacccgccgcggcggtctgtggttcgggacttatcacctgcttaactatcccgccagttactccgcgccgctttaccgtttcgccgattttaatgccggatggtacgccagccgcaatgccgcgttccagaatgcggtcagcaaagccagcggcgtgaagctggcgctggatggcgatctgatccgttacgatacgcgcgaaccgggtaaaaccgagctggcagtgcgtaagcttgcgggaaaactggatatgagcgagcgtgaaattcgtcagcaactggagaagggcgacagtctggcgtttgaaaagaccgcgctctatcgtgaagtgtatcgtttagcagagcagaaaagcgggaaagcgcagccgaaagagatgttgcccggcattcagctggaaagcccgaaaatcacccgcaacctgacgaccgcctggtttgctaagcgtgtggacgatcgtcgggcgcgctgcatgggacagaaataaaaggcttagtcgtaacgccgccagcgcagcagcagggcaatgacgccaagaatggcgctaccgatgaggaaggggaccagaccaaaaatggtccctacgcccagccccatttcaacgtgcggccggtttacatcctgcatctgcatcagatgttcaaacacgccaggcgcatgcaccagcaggtttaacagttgcgcaccggcccagaagcagagcagtacaaatacggcatacgcaatgttacccggggtggaggcgtcacgcttttttcctttccgatccgaaaagggtttcgacaaagtaaagtctgccatatcgacctccgctactcatgatgaacgtcggctaaaagccggtgatactgagtttattttgacaggacatcgtgattgtcaatatcagattggtgacaaattgcaccgtaacgcggggaagaataatcaatttttgctgacactcacatttttgtaacatatatatttattcattaacatttaagattttccgcatgccgcacagacgtgcaggcgcaaatatgcgaggatatttttttagcctgcggagttgttatgaaactgcctgagaaaattcgccgtgactggcattattatgcgtttgccattggtttgatcttcattcttaacggcgtggtgggactactgggatttgaggcgcagggctggcagacgtatgccgtcgggctggtgacctgggtgatcagcttctggctggcggggctgattattcgccgccgccccgcagaagacgagacggcggcgaaaacgccggattaattcatggtgcttttcagcgcgctgtcggcctgatggcgcgctaacgccagatcgatcagacggctaatcagctccgtataaccgataccgcttgcctgccacagcttgggatacatactgatattggtgaatcctggcagcgtgttgatttcattaataattacgtcattatcagccgtgagaaacacgtccacgcgcgccatcccggcgcagcccagcgtctgatatgcctgtaccgcaatattacggatcgcgtcattgaccgccggatcgatatccgccgggaccaccacccgcgcgccgttatcatcaatgtacttggtatcgtaagcgtaaaactcactgttaagcacgatttcgccgcaggtgctggcttcaggctcgtcgttacccagcacggcgcattcgatttcgcgaccgacaatgcctttttccaccacgactttatgatcgaattcgaaggccagacgcaccgccgcctcatactgcgcttcagtggtcactttactgacgccaacggacgacccctggtttgccggtttaacaaacagcggcaggccgagcgtcgaggtcatctcagcgaaagaatagcgctggcggtttgcccgcgtcagggtgataaagggggcgatattcagtccggcatcgcgcagcaagcgcttggtgacgtctttatccatacaggcggcggatccgagcacgtctgagccgacaaacggcaggttagccatgcgcagcataccctgcaaagaaccgtcttcccccagcgtgccgtgcacaatcgggaaaatcacgtcaatgtgcggcagcggctcgccattgtcggcgttaatcagcggctgttccgcctggcctgggatctgcgccaggcgggttgcggaaggattgagcgcaatgcgcgccggatcatgggcattcagcaggtaattttctgcatcattaacgtgccactgtccctgcttatcaatacccagtaacaccacctcgaagcggtttttgtccatcgcttccacgatgtttttcgccgactgcaatgagacttcatgctccgccgatttaccgccaaacaccacgcctacccgcaacttcttcatcaccacatccactcattaacgtcatgaaagtctctaccttaccacgtcaaaacggcggattcccggccttctgatataatgtttcttcagcctgaaaggagaacgcgtgaaaggaaaaagcctgattgttgtcgcggttcttttgggggcgggcgtgatggcgtatcgccatctgccctcctggtataacccctttacgccgctgcgcttaagcgatccgcccggcgtcattacccagtttaagctgcgacgcttgccgcctgagcagtgcgccgccttgctggcagaggccaatcagcaggggctgatcaccacgcggtcggtcgccaaaaccaccggcagctgtccgctcaccaacgcggtgcgggtgcgcgattttggcccggtaaagctcagcagcagttttctggcctcatgtccgcttgcgttaagctcggcgctgtttgtcgatcaacaggcgcgtcctttgacgcagcagtttatgggtagcgcgctggtgcgcatcgaccatttcggcagctatgcctgccgtaatatttatcaccgcgagaacgcgcgcctgagcgaacacgccacggcggatgcgctggatatcagcgggtttcgtctcgcctccggtcagcaagtcagcgtactgcgtggctggaaagtggataaaacccagccctggcttcaggcgatgctcagtgccagctgcgactattacggcaacgggctgggcccggagtacaatgcggcccacgcaaatcattttcaccttggcatgcgcggctacggcctgtgccgctaatgggtgatctacacaagaaagacaacctgttatggaagcctggaaagtaaatcttatctccgtctggttcggctgttttttcaccggcctggcgatcagtcagatcctgccttttctgccgctatatgtggcgcagctcggcgtcacttcacatgaagcgctgtcaatgtggtcggggctgaccttcagcattacctttctggtgtcggccattgtttcgccgatgtggggcagcctcgcggatcgcaagggccgcaagctgatgctgctgcgcgcctcgctgggcatggccatcgccattctgttgcaggcctttgccactaacgtctggcagctcctgttgctgcgcggcatcatggggctgacctccggctacattcccaacgcgatggcgctggtcgcctcgcaggtgccccgcgagcgcagcggctgggcgctcagcaccctgtccacggcgcaaatcagcggcgtgatcggcggcccgttgatgggcggctttctggcggatcatgttggtctgcgggcggtatttttcattaccgctatcctgctggtggtcagttttctggtcacgctgttcctgatcaaagaaggcgtacggccgaaaatcagcaaagcgcagcgtttgtccggcaaagcggtatttgcctcgctgccttatccgcggctggtgatcagcctgttcgtcacgaccatggtcatccagttgtgtaatggatccgtggggccggtgctggcgctgtttattcagtcgctgtcgccggacagcactaatattgcctttcttagcggtatgatcgccgccattccgggcgtatcggcgctgatctccgcgccccggctcggtaagcttggcgatcgcatcggtaccgcccgcattctgatggcgacgctcatctgcgccgtcgggctgttcttcgctatgtcttttgtcacctcaccgctgcaattaggcatcctgcgttttctgcttggctttgtggatggcgccatgctgccggcagtgcagacgttgctgctaaaatactccagcgatcaggtcaccggacgcattttcggctacaaccagtcgtttatgtatctgggcaacgtcgccggtccgctgatgggcgcgaccgtctccgcgatggccggattccgctgggtgttcgccgctacagccgtagtggttttgcttaacgtctggcaactggcggcagaactcaggcgcacccgccttcgcattgataaaaaataagtaagcagacttaaactattatttaacggagcttaatgctccgtcagtctgttgttttgcctgcacactttggccagcattgctgtatttacagcccggcaaagccaaaataattcgcggtcataaaaaagcattaatcatttgaaaaaaataatacctgaagctactttgcaattatcagatctggtgctaacgtcagcgaaaatcacataaggaaatagcgctatgaaaaacctcatcgcagagttgttggttaagcttgctgaaaaggaggaagagtctaaggagctggtcgcgcaggtcgaggcgctggaaattgtggtgacggcactgctgcgccacatggccgcgccggaacagaatgcgctgatccagagtatcgaaggcgcgctggaagcggcccgcccggatgccgaggtctcggaaaaggattctgaactgttgcagcaatacgtaaaaaagcttctcaggcatccccgcagttaaattactgaatgggaatgccagcgatcgcgctttttatttcttttattgccctgcctgtctttgctggcagaaaatagtctacaacccccctccgttcatttgccgcctgattgcgcaaatgaacggagggtggtttttttttcgtaacgcgccatgcttaaagagaaacttgttctgaggatggtgatatgaaaataacattcctggtaaccctgctgtttggcatgctttttatgatggcagtcagcgcggctgaaaaagatctgacgccgcaacagcaacgtatgaccatttgtaatcaacaggccaccgcgtagacgttgaaaggcgacgcccgcaaaagttatatgagcgattgcctgaaaaatactaaagtagagccgggccagaaaagtctttccccccagcagcaaaaaatgcgcgaatgtaattctcaggcgacccagcaatcgctgaaaggcgaggatcgcagtaagtttatgagcgcctgccttaaaaaataacgctgatacaaacgggtgacgctgcgcggcggctcacccgaaatttcatacttacccgtcgggtcacctgcctataatttttggaaatgtttcagaatgttcccaaaaattatgaatgataacaatttttatacttctgcgccgtcgcgtcctgacggcgacagcttgcacagtcaggacgaactttaccgggccgggcagcagtttgtccgccgcgccaggatgccgcgcgtggcgggtgtgggtggcctctatttcccgctggcaggcgttatggtgacgcagtccctccccgggggctggtggatggcgttgctgtgctgggcgtttatctggccgcattttgcctggcaaagggcagtgcgtgccagcgagccgaagcgtgcggaactggccaacctgaagacggatgccattcttgccggtatgtggatcgccattattggcgtgaacgtcatgcctactgcggcgctggtgatgatgatcggcgtgaatttaatgggcgcaggtggaccgaaattatgcggcatggggttagttctgctgctggtaacctgtctggtcacgctgcaaatcaccggtattgccgtggtgctgaccagtacgccgctggaagggtggttgtcgatcccctttctggtgatctatccgatgctgttcgcgtgggggagttacaaaacggcgaaccggctcgccgcgcagaaacgtcgtctgaaggtgatgagcacccgcgatggcatgaccggcgtttacaaccgccgctactgggagatcctgctgcgtaacgaatacgataattgtcgccgccaccagttggcttccacggtactgcttatcgacctcgaccatttcaaaatcatcaatgacacctgcggccatgacattggcgatgaagccatcattgctctgacgcaccatctgcaaatgagtctgcgcggcggcgatgtgattgggcgctttggcggcgatgaattcgcggtgatcatgaacggcaccagcccggaaagcgccgctgccgccatgagtcgcgtccatgccaggcttgcgaccttccgcctgacctccgctccgcacgtcaccctgcacatcagcgtgggcgttgcgcccttaaccgccgatatgctgcactaccgcgaatggctaaaggccgctgatatggcgctgtacaaagccaaaaacgccggacgcaaccgtaccgaaatcgccgcctgaactcaggctttgctgagcttctctgatttttccatgcatttgttcatcgcttcgatcaccgccgagcggaaaccgcgatcttccagcaccctgaccgcctcgatagtggtgccgccaggtgagcacaccatgtctttcagttcacccggatgtttaccggtttccagcaccatttttgccgagcccatcaccgcctgcgccgcaaacttataggcctgggcgcgcggcataccgccgagcaccgctgcatcggccatggcttcgataaacataaacacataggccggggcggagccgctgacgccgacgaccggatggatcatcggttcggcgatcacttccgcttcaccgaagcagcggaaaatattcaccacatccgcaatatcttccggcgtcaccagcgcgttaggggtgatcgaggtcatgccggcattcaccagcgcaggggtgttaggcatggtacgcacgattttgcgatcgtggccgagggcacgcgccagctgatccagcgtcacgcctgcggcgatagagacaatcagcgtatctttattaaggctggaagtgatttcactcagcactttgatcatgacgttaggtttcaccgcgccaaacacaatatcggcgacctgcgccacttcctgcgcgctggcggcggcattgatgccgtattgatcgtgcagcgcagcgactttatcaggggagggggtgtacacccaaatctggcccggcagtacctggccgctggcgatcaaaccgccgaggatcgctttacccatgttgccgcagccgataaaaccaatttttttgtccatcacgtcactccctggttttttattgattgggtttatagcttaacgtggatccgcgcacagggctaaagcttccttgtagtctttgcgggcagagacgattcaggcgagaataaggcgtaatcgtttatcaggagtcaatatggtgatttgggtggatgccgatgcgtgtccgaacgtaatcaaagaagtattatttcgcgccgctgagcgcacgcaaaccccgctgacgctggtggcgaatcagtcgctgcgcgtgccgccgtcacgctttatccgtaccctgcgggtggaggcgggcttcgacgtggcagataacgaaatcgtgcggctgtgcaatcccggcgatctggtgatcaccgctgacattccgctggcggcggaagtgatcgctaaaggcggtgcagcgctgaacccgcgcggcgaacgctataccgaagccaccattcgtgaacgcctgacgatgcgtgattttatggataccctgcgcgccagcggcgtacagaccggcgggccggattcgctctctcagcgcgatcgtcagcactttgccgccgaactggataaatggctgctggaggttaagcgccgccgggaaagcaatcagggcagctgaaagcttgtcaacggacgacgcattcagtaaggtgggcgtgccattttatctttacactttaaagtgcatttttctcgctaaaatcaatgttaccgctgttttaaatttctctgtaattatttatttacacttgctggcagcagataatcatttttgtttcatcatatctcgttctgcaatgggcggaaccagggggatcaccaggtcatgacgttacccatctttctaactggcgcacgcggttgcggaaaaaccaccatcggcgttcagctcgcccgggtccgcgactgccagtttgtcgataccgatcgcgtattacaggatcaggcgcaaatgaccgtcgccagtatcgttgaaaaagagggctggtcaggatttcgcgcacgggaaaccgccaccctgcaaagcgtcaccgcgccatcgacagtgatcgccaccggtggcgggattatcctcagcgaatttaaccgtcagtttatgcgcgaacagggcatagtgatttatctctgcgccccggtggacgtactggcgcagcgccttgaagccacgccgaaagccacccagcgtccgacgctgaccggtaaacccatcagcgaagaagtgagcgatattctggccgagcgcgatgcgctttatcgcgaggcggcgcactatgtggttgatggcgctcaggatccggaaagcgtcgtggaagaaatccagacggtattattactggcgcgcgcaagctaaacctgatgcgctacctttggctatactccaggtacgactgataaaaactgataaaaaaggaagtgctatgccgacaagaccgccgtacccaagagaagcgcgtatcgtgaccgttgaaaaaggaaaccaggaagaaaccgtgacctggtatcaattacgatccgatcaccctaagcccgattcgctgatcagcgagcataataccgagcaggaagcgctggatgccaagcgccgctacgaagatcctgataaatcctgatccctttcccccgcgccgcgggggaaattttataaacctttcgggaaataacagacgtttatgtaagcgtttacaaaaatagtcacgctccggtcatatctgctgctacgcttttttctgcgacgatcattgccggttttactcccgccctctggcgtgagcaattgtcagtcctgaataactgaagtgaagaaggcggaaagaaccatgagtgcgactctggccatcctcaccattggtgtggtgcccctcaatgctgtgctgccgctcttaactgagcacattgctgaagatcagatcacccacgttagtttgatgggcaagatggatcctgaagatgcccttgaagattacgccgccgcgccgggcgaggacgagatccgcgcactgctgaacaatggcgaggtggtaaaagtctcgcgccagaaggtgaagcgcgatctgcaaagcgtcatcgaactgctcgataagcagggctatgatgtcatcctgctaatgtataacgataaaatcgaagggctgaaatcccgcaacgctattttgctggagccgcaacgcattattccgccgctggtcgcctccattattgatggtcatcaggtgggcgtgctggtgccgatggcagagatgcttggcgaacagcagcaaaaatggcaggcgctttcaaacgagccgctgtacgccattgccagtccacaggacactatcggctcgcagctggtggacgcaggtagaacgctcatcgatcagggcgctgacgtgctgatgctcgactgcctcggttttcaccaggcgcaccgcgatctgctgcaaaaatccctcgacgttcccgttctgctctctaacgtgctggtcgcccgtcttgcctctgagctgctgatgtaacagcgattttacgtgacagccataaagcctggcccctatagtggatttccatacactacacagataagggccagtctatgcttcagagtaatgaatacttttccggtaaagtgaaatccattggttttaccagcagcagcactggccgtgccagcgtcggcgtcatggcggaaggcgaatacaccttcggaaccgcccagccggaagaaatgacggtggtcagcggcgcgttaaacgtgctgctgccgggagaaacggagtggaaaacctatgcggcgggggaagtgttcaatgtgcccggccacagcgaattccatttacaggtggccgagccgagcgcttatctttgccgctatctgtaatgcagcgatctgtcccctcaggcgagggggcagatcgacaggatcagcgctgcgcttcgccgcctaatccttccaccagattctgaattaacgccgccagttccccggtcatcaggataaagtcagcatcaaagcgctgggcataatcctcgcgatcaatgtcttcattctgatcgcgcagctcatcggaaaacttcaggcgtttgatcgagccatcgtcgcacatcataaactgaatacgctgctgccagtcgagcgcaagcttagtgaccagctttccggcttcaatatgcacggcgatttcatcgcagacgagatcctgctttttacagcggatcacgccgccatcttcaaggatcgctttcagttcggcttcatcctgcaactggaatccctgcgccgcgctgccggagcgtacccattcggtcagcgtcagttcaattggattttccagcgtcagcggcaccaccggcagggagccgaggcttttacgcagcagcgccagcgtatcttccgcttttttggcgctggcgcagtccaccatgatcaggccgttaaccgtatcgatccacatcatcgtctggctgaagcggctgaaggcgcgcggcagcagcgaatgcagcacttcatctttcagcgaatctttttcggtcttcttcagcttgcggccctgatcggcttcaagtttggcaattttggcttccagcgcctgtttgatcaccggcgacggcaggatcttttcttctttgcgggcgcaaatgatgatctggccattattggtatgggtcagtgcatcactgtgcgaacccatcggcggcacccaaccggttttcgccatatcctggctaccgcaaggtgtaaaggttagcgcggctaactgtttttccatctcttcagcgcgcaatgaaacatcgcggctaagacggtaaaccatcaaatttttgaaccacagcatgataattttcacggccttgtcgttaaatgcagcgggcatgataacgaattgtcactttcgatgcattgctaatacggggcagggatcctactctgttgatattccgcgaaaaacaaggagatttccgtgcgtataggaattgatttaggtggtacgaaaacagaagtgattgcgctcagcgacagcggcgaacagctgttccgccaccgtctgccgacgccaaaaaacgactacggacagacgattgaaaccgttgccacgctggttgagctggccgaaaaggagaccgggcaaaccggcaccgtcggcatggggatccccggctccatttcgccctataccggggtggtaaaaaacgccaattccacctggcttaacggtcagcccttcgataaagatctcagcaagcggcttaaccgtgaagtacggctggcgaacgacgccaactgcctggcggtatccgaagccgtcgatggcgcagcggcgggggcgcaaaccgtcttcgcggtgatcatcggcaccggctgcggttccggcatcgccctaaatggccatgcgcatattggcggcaacggcaccgcaggcgagtggggccacaacccgctgccgtggatggacgaggacgaactgcgctatcgcgatgaagtgccgtgctactgcggtaaacagggctgtatcgagacctttatttccggcaccggttttgccaccgattaccaccgcttaagcgggcagtcgctgaaaggcaatgagattatccggctggtgggcgagcaggatccgatcgctgaactggcgctgagccgctacgaactgcggctggcgaaatcactggcccatgtgataaacattctggatccggacgtgatcgtgctgggcggcggcatgagcaacgtcgatcgtctgtacaaaaccgtgccaacgctggtgaaaaactgggtattcggcggtgaatgcgaaacgccgatccgcaaagcggtacacggcgattccagcggcgtgcgcggcgcggcctggctgtggccgcaaaattaatcattgcacggcagccgccccatgacctttcaggcggctgtacaacaccagtgagatcatggccgataacgacagcaaggctgccggtaaggccacatattcatacgtcagcccggcggtcagcatcatcccgccgcaaaacgcccctaccgcgctgcccagattaaaggccatttgtccacccgccgctcccagcatttcaccgcctctggcgttttgcagcagcaggatttgcagcggcgcagacagggcaaaaagtccggcgcagctgataaaggccaggctcagggacgcggttttgttccacgcgaagaagaagatcagcgccagcgcaatggcaatcaccagatcggtcgtcatggcgatgcgcagcggcgtaaaccagcgcgacagcttgccgctcagcatattacccagcaccattcccagtcccaccagcatcatgatcgccggcatggtggtttctgcgtagccggagacgaagatcatcagcggtttgatatagctgaaccaggcgaaaaccccggcgttgccgaacagggtggcggcaaaaatcagccagggcgcaggggatttgaggaagcggaactgcgcggagagggtggttttggcctcgtcagcgatatccgggatccacatcaggatcgacaccatcaccgcaatgttaaaggccgcaatcagccagaaggtatagcgccagctgaattcatggctcagccaggtgccaatcggcacgccgatcagattggcaatggtcatgccggagatcatccctgcgacggcggcggtgacgcgtccgggctgcgcgactttggtgagaatgatcgccccgacgccaaaaaacgcgccgtggggaaaaccggacaccagtctgccaatcgccagcattacataggacgaggagagggtgaaaatcacgttgcccgccagacacagcagcgccagaaacaccatgatatgtttcagcgaaaagcggttagagaacagggcgatgatcggcgcgcccagcaccacccccagcgcataccaggagatcatatggcccgcggcgggaatgctgatctgcacatccttcgccagctccgtcagcacgcccataatgccgaactctgccattcccagcccgaacgtcccgagcgccagcgaaacaatcacttttttgatactacccgacacggcaatcatccttaagaaaaacccccgcccggctggacgaggggaaacgccttattctacggcccaggctttatccagcttgctgtaacccagcccgttaattttacgtactttgatctgcaccgggatgcgctctttcatcgcctcgacgtggcttatcacgccgatggttttgccggtggcgttaagggcgtctagcgcatccagcgcggtgtccagcgtttcgctgtccagcgtgccgaacccttcatcaaggaacagcgaatcaatacgcgttttatggctaaccaggtccgacagcgccagcgccagtgccaggctgacgaggaaactctctccgccggacagggtacgggtatcgcgcaccgcgtccgcctgccaggtatccaccacttccagctccagcgcttcgctggccttgcgcttgagcaggtatcgcccgtgcaggcgggtgagctgattattcgccagccacaccagattatcgagcgtcagcccctgggcgaatttacggaatttatcgccttctttcgagccgatcagcgcattgagatacgcccagtcttccacatattccgcattttgctggatgctctgcatcagcgctaactgccgctggcggttttcggcgtcctgtttcagctgctggcggatctcgccctggcgggtggtgttttcccgcagctgctgtgccactgctgaaagctgcgcgaccagcgcgtcgatttcggcgtcgtccgccagcgtcggtggacgggacgccagatgctgcgccagcgcgctttcggcctggctatagagcgtgctttgctgctgatgcgcccgctcaagctgctgctgacgctgctccagcgcctgccgctgcgcatcgtccagcagcgcgcccaggaaagcggcctcgtccgcaaaaggactggcggccagcgccgcgctgaactgtgagcgcgcctgttcctgctgtctgtcgagctggcgtatctgctcctgcaacaggcgcagctggccttccagcgtactggcctcgctgtaaagcgtctgccagttgcccagcgcggcggcgtgttgctgctccggcaggggcggcggcgtggtgccgtcatcggcgagcgttgccagcaggctgtcgaggcggctcagttgttcccgcagctgtggcagtttgtcatgctgctgctgccagcgctgcgactcttcctgccgcgccgccagccaggccgcttcgtcgctcaccgccgggcgcgtcaggcccagctgtgccagcgcggtgtccagcgcatcgcgctgccgggcgatctccgccgccagctgcgcatcccgctgctgctctttatgcagccttgcttccagggttaagcgttcattcagctggcgcagctgctgctcatgctgatcctgctccgccagccagccgctcacgtcgtcctgcggcgtcagcgcgatgttcagcgccgcgcactgctgctgccagcgggcgtgaagcgtggcgctttcctcctgaatcgcggtaagagccgcggcgagtttgtcccggtgctgacgctgggtatccagctggcctttcagggcaaaaccctgttcgcgcaggctttccacctcttttttcagcgccgccagccgctgctgattttcgcccggctgcaatgcctgataggccgccacggcaggatgcgacgtggatccgcacagcgggcagggcgtatccggttgcaggttcgcgcgttccgcttcgaggcgcaggatcagcttttcctgctccaccagcttttccacatcgctttcatgctggcgcttgtctttatattgctgacgaatagccccaagccgcagatcccaggccgcgatctgcgtgtccatctccgccagttcctgctgctgttgcgcctgacgttttgccagcgcagcaaactgcgggtgcagcatcgccagctgttgacgcccgctgcggcccgctaagtgctgttgtaaatgagcgcttacttcttccagattcagattcagcggggaaggcggcagggcggcgagcgcctgttctgttgtacggagtgtattttgcagctccgcccgctgtttttcatcccgctgctgctgggcaaaggtcagacgccagcccgccagttccgcgctccataagcgaaaacgatcgttttcgctgagccactgctgcacctgcgccacatcgtttttcagggtggtagcggtgatattcgccagttgccaggtctgttgcagcccggtgcgcacctgttgtaagcgagtattcacattttcgtgctggccctgcgcgtggcgcaacgcctgctggcgttcctgtaactgctgccagtggggacgtaatttttccgcaggcagggcgcgggtcagcttttccagttccggggcggcggcctgtaatgccgcatgcgcggcggtcagcgcctcctgcgcccgctggcgttcgccgctcagccggtggctttcactcagccactgatgatgtccctgcgcctgctgctgcccggcgagcagctgtttttcttcgtcagtaagtgcctgcaaacctgcgctgagcgtctgtgcctgttcgtcgcttaacagctgcacgccgtcggcctgggcctggagtttttccagctccagtcgcgcggttttatgcttttcgaagaccatcgcggagatctgaccgtagatctcggtaccggtcagctcttccagcagttcagcgcgctctcggggtttggcattcaggaaggccgcaaactgaccctgggagagcagcatcgagcgggtgaaacgaccatagtccagcccggtcagggtggcagtcagatccagcttgtctttcactttatcggcaaggattttgccatcggcgcacagcgccagctccacgcgcggggcctgcaaattgccatccggctgattgcgggcgcggttctggctccaaaaagcgcggtaagccacgcctttgacctcaaactccacttccgccagacattcagcggtatcgcgggtcatcagatcgttttgcgactgggagacgctgctcagacgcggcgtttcgtgatacagcgccagacagatggcgtcgagcagggtggttttgcccgcccccgtcggcccggtgatggcaaacagcccattactggcgaacggctcggcggtgaaatcgattttccattcccctttcagggagttgatatttttcaggcgcagactgaggatcttcatgcgtcgtcttcctccgtcagggcgtcaacggtttgcgcgaacagcgtctgtaaacgcgcgttttgcgcctcgtcgaggctttccagcgccagccgccgctcaaagacttcttccaccttcagttcgctcagggtttcgcgcagttcgcccgccagcagacgttcgcgctgctcccggctgcggcgcaccagcaacacttccaccggcagatccccggtaagcgcctggattttccgttgcgcgtcggccaggtattcgtcggtggtgatttcaatatccagccacaccggcgggctgaccggctggtcgcgccattgctcaagctgttcgccgatagccgccagatcgcctttgatcaccgccagttgctgggtaaccggcaccgtcagcggcgtcacctccgtcagcctgccgtcgctgaaagtcaccagattgacgcttttgggcctgccggtttcatcaaaacttaacgcgatgggggagccgcaataacggatatgttcctgaccgcccaccagctgcgggcgatgaatatggccgagagcaagataatccaccggcgggaagttctgcgccggaaaggcgtccagcgtgccgatataaatgtcacgcaccgcgtcacttttgctggctccgacggtggtcagatggccgctggcaataaccggcagcctctgctccccgcgcagggcgcaggcgtcttcatactgctgctggtaatacgctgtgatgctggtcagcaaaagctgttgtttctgactgccggataacccggcctggcttagcacgatgtcgcgcgggcgtaaaaacggcaccgggcagaacaccgcgcccggcgtgccgtcacggcgtttgagcataaagggcgcgctgcccgcggtggcgaccacggtggtgtttaaaaaggcgagaatttcgcgggattcgttgagcgtggcgacggaatcgtggttacccgccagcaccaccaggtgacagccggtttgctgtagattcaccacaaagcggttatagagttcgcgggcatagctcggcggcgagccggtatcaaaaatgtcgcctgcgacaataatcacatccacctgctgttcttccgcggttttcagcagccagtcaagaaaggcggcatgttcagcggcccggcttttgctgtaaaagttttgacccaggtgccagtcagaggtatgaagaagacgcataacgatcccatggcaaaaaagcgtgaagccgattataaacgttaagcggcgtgaagatagttatcggttttttcacgagtgtcataaaacaacggcttgagtcatcaggcagtcatcattttcataaatctgtcataaatctgacgcataatgccaccgcaacatatactggcgacttaataaatacagggcaaattatggcgagacgcattctggtcgtggaagatgaagctccaattcgtgaaatggtatgctttgtcctcgagcaaaacggcttccagcctgtcgaagcggaagattatgacagcgcggtgaaccagttgaatgaaccctggcccgatctcattttgctcgactggatgctaccgggcggttccggtattcagtttatcaaacatgtgaagcgtgaagccctgacccgtgatattccggtgatgatgcttaccgcccgcggcgaggaagaagatcgcgtacgtggtctggaaaccggggcggatgattacatcaccaagccgttctcgccaaaagagctggtggcgcgtattaaagccgtgatgcgccgcatctcgccgatggcggtggaagaggtgatcgaaatgcaggggttaagcctggatcccacttcccaccgcgtgatgaccggcgaaaatccccttgatatggggcctaccgaatttaagcttttacacttctttatgacccatccggagcgtgtctacagccgtgaacagttgctgaaccatgtgtggggcaccaacgtttacgttgaagatcgcacggttgacgtgcatattcgccgcctgcgtaaagcgctggaacatagcggccacgatcgtatggtacagaccgtccgcggtacgggttatcgtttttcgacccgtttctaacatctgaagggagtgtgacgcgtgctggaacggctgtcatggaaaaggctggtgctggagctggtgctgtgttgcatcccggcgctggtgctcggcgccatatttggttatctgccgtggtttttgctggcggccgtcaccggattactggtctggcatttctggaacttactgcaactctcctggtggctctgggtggacagaagcatgacgccgccgccgggccacggtagctgggagccgctgttatacgggctgcaccagatgcagatgcgtaacaaaaaacgccgtcgcgaactgggcagcctgatcaaacgcttccgcagcggcgcggagtcgctgccggacgccgtggtgcttaccaccgcagaaggcgtgatcttctggtgtaacggtctggcccagcaattgctgggtctgcgctggccggacgataacggccagaacatcctcaacctgctgcgttatcccgaattcacccagtacctgaagcgtcaggaattccttaagccccttaatctggtgctgaataatggccgccatctggaaattcgcgtcatgccctacagcgatcagcaattgctgatggtggcgcgtgatgtcacgcagatgcatcagctggaaggcgcgcgacgtaacttcttcgccaacgtcagccatgaactgcgcacgccattgacggtgttacagggttatctggagatgatgcaggagcagacgctggaaggcgcgccccgtgaaaaagcgctgcatactatgcgcgagcagacctcacgtatggaagggctggtgcgccagctgctgacgctctctaaaattgaagcctcgccggtgcaactgctgaacgaaaccattgatgtgccgatgatgctgcgggtggtggagcgggaagcgcaaaccctcagccagcaaaagcagactattgagttccacatcgacagctcgctgaaagtgctgggcagtgaagatcagctgcgtagcgccatctctaacctggtgtataacgcggtcaaccatacgccccccgccacccatattgtggtgagctggaagcgcgtaccccacggcgcagaattttgcgttgaagataacggaccggggatcgcggccgagcacattccgcgcctgacggagcgtttctaccgggtggataaagcgcgatcccggcagaccggcggcagtgggcttgggctggccatcgttaaacatgcggtcaatcatcacgacagccgcctcaatattaccagcacgccagggcagggcacgcgtttcagttttattctgccggaacgtttgatcgccaaaaacagcgcctgacgccccgactgtcagcttatctttccgcaggccagctaatgctggcctgtttgcgttccggttcacctttttctgaccgattattgtacggctgatgattttttgttcgcatgataagccatgtgtttttcttatacatagcgttttgaactggtaaccatataggtagcagcagatccatctggttttacgatcccgtcttgcctttaaacgttataagcgtttaaattgcgcccctgatactgtcataccgactgtatttgcgtggtaaatcgaaaaactattcttcgccacgtcatgcgggaagcatatcccgctgaaattgagagaaattgccgtcgtattgttccaaaggcactggcgaacatttcatcgtttccaacaccacatccacaggcagcacacgtttatgactcatcgcttaaaaccacgagacatcatggctctgggctttatgactttcgccctctttgtcggcgcaggtaacattatttttccgccaatggtcggtttgcaggcgggtgaacacgtctggacggcggcgttcggctttctgatcaccgccgtaggcctgccggtgctgactgtagtcgcgctggcgaaagtgggcggcggcgtggacagcctcagtatgccgatcggcaaagcggcgggcgtgctgctggccaccgtctgctatctggcggtcgggccgttgtttgcgatcccgcgtaccaccaccgtctcctttgaagtcggtattgccccgctgaccggcgacggcgcgatgccgctgatgatttacagcctcgtctattttgcgctggtgatcctggtatcgctctatccgggcaaactgctggataccgtgggtaacttcctcgcgccgatgaaaatcatcgccctgacggtgctgtccgttgccgcgctcgtctggccggcaggcccgatcagcagcgcgatggatgcctaccagaatgccgcgttctctaacggctttgtgaacggctatctcaccatggatacgctgggcgcgatggtctttggcatcgtcatcgttaacgccgcccgttcgcgcggcgtgacagattcccgtctgctgacccgttacactatctgggctggcctgattgccggtgtgggtctgacgctgctgtatctggcgctgttccgcctcggctctgacagcagcacgctggtagaacagtctgccaacggcgcggctattcttcatgcttacgttcagcacacctttggcggcgcaggcagcctgctactggcggcgctgattttcctcgcctgtctggtgacggcggttggcctgacctgcgcctgtgcggagttcttcgcccagtatctgccgttctcttaccgtacgctggcctttgtgcttggcggcttctcgatgctggtgtctaaccttggcctgagccacctgatccagatttccataccggtgctgaccgccatttatccgccgtgtatcgcactggttgtattaagctttacccgttcatggtggcataattcgtcgcgcatcatcgcgccggcgatgttcatcagcctggcctttggtatccttgacggtatcaaagcttccgccattggcggtgtgttgccagcctggacccagcgtttaccgctggcggagcaggggctggcgtggctgatgccaaccgttgtgatcgtgatactggccgtggtctgggatcgtgccgcagggcgtcaggtgacttcccgcgcacactgatcaagggttgcttgtcataaccacggggcttaccatcccgtggtttttttatttttgttatggcacgggaaacaatggaaagtactaacaagctaaagcgggggttaagcacccgacacatccgctttatggcgctcggttcggcaataggcacgggcctgttctatggttcggcggacgccatcaaaatggccgggccgagcgtgctgctcgcctatattatcggcggcgcggcagcctatatcatcatgcgcgcgctgggcgaaatgtcggtacataacccggcggccagctccttctcacgctatgcccaggaaaacctcggcccgctggcaggctacatcaccggctggacctactgttttgagatcctgattgtcgccatcgctgatgtcacggcgttcggcatctatatgggcgtctggttcccgacggtgccgcactggatctgggtgctgagcgtggtgatgatcatctgcgcggtaaacctgatgagcgtcaaggtgttcggcgagctggagttctggttctcgttctttaaagtcgccaccattatcgtgatgatcgcggcgggctttggcatcatcatctggggcattggcaacggcggcgaaccgaccggcatccacaacctgtggagcaacggcggcttcttcagcaacggctggctcggcatggtgatgtcactgcaaatggtgatgtttgcctacggcggcatcgaaatcatcggcattaccgccggggaagcgaaagatccgcagacctctattccgcgcgccatcaactccgtgccgatgcgtatcctggtgttttatgtcggcacgctctttgtgatcatgtccatctacccgtggaaccaggtgggcaccaacggcagcccgttcgtactgaccttccagcatctgggcatcacctttgccgccagtatcctcaactttgtggtgctgaccgcgtcgctgtcggcgattaacagcgatgtgtttggcgtcggccgtatgctgcacggcatggccgagcagggcagcgcgccgaagatgttcgcgaaaacctcgcgcaacggcattccgtgggtaacggtcgttgtcatgacggtggcgctgctgttcgcggcctggctgaactacatcatgccggagaacgtcttcctggtgatcgcctcgctggcgaccttcgccaccgtgtgggtgtggatcatgattttgctgtcgcagatcgctttccgtcgccgtctgccgccggaagaagtggcggcgctgaagtttaaagtgccgggcggcgtacccacgaccatcgccggtctgctgttcctggtgtttattatcgcgctgattggctggcatccggaaacccgcatttcgctgtacgtgggctttgcgtggatcgcgctgctgcttatcggctggatgtttaagcgccgttacgaccgcaaaaccgcctgatctcctgaacttttgccgggtgagcgtcctgccgcccggcaatgctttttggcttcctcctcccccatgctcctcccccaattatcagcagtatgatgagtgaactttcactatgctgtggcaaggtggcgtcatttttcagcaaggggtaaagcgatgttgaacgcctggcatcttccggtagcgccgtttgtaaaactcaataaagatcagctttttataactttgtggctggcgggcaacgatttgcctgcgcaggttaaactgcgtacggaaaaggacaacgaagagacgtccatcctgatgcatccgctgcgcagtgcaccgtaccccggcgtaaccgcctggcgcgccgccatcgacgtgtccgaagggcaaccgcgccgtcgctacagctttaaactgctgtgggcggatcgccagcgctggtttacgccgcagggcttcagcgatttcccgcccgcacggctggagcagtttgccatcgattgcccggataatggcccgcagtgggtggcggatcaggtgttttatcagatctttcccgatcgctttgcccgcagccagccgcgcacgccggagcaggacaacgtctattaccatcacgccgccgggcaggagatcgtgctgcgcgactgggatgatcctctcaccggcgaggcgggcggatcgaccttttacggcggcgatcttgacggcatcagcgaaaagctgccctatctgaaaaagcttggcgtcacggcgctgtacctcaacccggtgtttgtcgcccccagcgtacacaaatacgataccgaagattatcgccacgtcgacccgcagttcggcggcgatcaggccctgctgcggctgcgcgccaacacccagcgcgaaggcatccgcctggtgctcgacggcgtgtttaaccacagcggtgactcccatgcctggtttgaccggcacaatcgcggcaccaccggtgcctgccataatccggcctccgaatggcgggaatggtacagcttttcagacgacggccacgccctcgactggcttggctatgccagcctgccaaagctggattatcagtcggcctcgctggtggaggagatctataaaggcgaagacagcattgtgcgccactggctgaaagcgccgtggaatatggacggctggcggctggatgtggtgcatatgctgggggaggcgggcggggcgcgcaataacctgctgcacatcagcggcatcagccaggcggcgaaagagacgcagccggaagcctatatcgtcggcgagcattttggcgatgcccggcaatggttgcaggcggacgccgaagacgccgccatgaactaccggggctttactatccctgtgtgggggtttctcgcgaacaccgatatttcctacgatccgcagcacatcgatgccgccacctgcatagcctggatggataactaccgcgccgggctgtcgcatcagcagcagctgcgcatgtttaaccagctcgacagccacgacacctcgcgctttaaaacgttgcttggtaaagacatcgcgcggatgccgctggcggtggtgtggctgttcagctggcctggcgtgccctgtatctattacggcgatgaggtggggctggatggcaacaacgatcccttctgccgtaagccgttcccgtgggacaaagaaaaacaggacgccacactgtttgccctctatcagcagatggcggcgctgcgtaagaaaagccgcgccctgcgtcacggcggctgtcaggtgctgcatgcggaaggcgacgtggtggtctttgtgcgcgttttccggcatgaacgcgtgctggtggcaatcaaccgcggcaaggcctgcgaggtggtgctgacggatttaccgctggtagacgtcccggcctggcagtgcaaagtgggcaccggcaccatcgaggataatgtgctatcgctaccggcgatctccgccacgctgtggcgcaatcgctgaacctgttgcaacatttttatcagcattgaaaagaaatgtaatatcctttcgggagtgatcaccgaaccgaaggtaaaaccatggatgagcttttgctggttgccggtcttgttctctttttcgcgctgattgtcgcccctgcgctggcggtcagagcctggcgaaaaagcagcgatacgcagcgggaactgggcgtattgcgtgaacggctgacggcgctggagcagcagctggcggggcaggcaattgcgcctgcgccgcagccgctgcctgaacggatagcggagcaggaacctgttcctgcgcctgtcattatacctgcggcaccactgcccgctgtcgatccctgggcggcgagcgtgccggagcctgagccggttgccgtcaccccggcggcggtcagcaaacccgtatccgccgaaccgcgcggtggcatgattacctcgctggtgagctggtttatgcgcggcaatccgctggcgaaactcggcattctgctgctgttcttcgggctggcgtttctgttccgctattccgtcgagcgcgatctcttcccgctggaactgcgtctgtgtgtagcggcgcttgcggcggtgctgctgctggcgctcggctggcggttgcgccacaaacagcctgtctatgcgctgattttgcagggcggggccaccggcgtgctctatctgacggtatttggcgcgttcaggctctggcagatgctgccgatggcgctggccttcgccttgctgctgctgatctgtgcggtgagcgtggggctggcggtgttacagcgtgcgctaagtctcgcgatgctcgccagcctcggtggttatcttgcgccgttgctgctctccaccggcggcggcagccacatcgggctgttctctttctacctgctgctctcctgcggcattctggctatcagcgtctggcagcactggcgggtgctgaatctgctcggtctgctttttacctttggcgtcggcggcctgtgggggctgtttagctaccggccggagttctacctcagctgccagctgttcctgatcgcgaatattctgctgtttggcgtcctgagcgttggactgtcgctgcgggcgcagggcggcagtaagcgcattattgacggcgtactgctgttcgcgccgccgttgctgggatttggtatgcagtacgccatcacgcaggatttcgcctatggcccggcgttttccgccctcggctttggcgcgttttatctgctgctggcgtggctggtgctgcggcgtaaacctgaacttgggcgaccgctggtgctggcggcgctggcgctcggcggggcttttgtcacgctggccatcccgctggcgctttccgcccgctggacatcaatggcctgggcgctggaagggcttggcattctgtggcttggggtacagcaacagcaacggcggatgagctacagcggcacaggtttactgttgctggcaatgggcagcgccctgtgggcgatgcaggatctgcttccggcgctgtcgcagttgatgatttttgcggtgctgagcctgacatggatcgccgccgcctggctgtggcgcggactgaatatgcagggcagccacggcctgctggcgggcggtattctcttctggctgctggcgctgcacgggctgtcagcgctcaccttaagccgctttatgaatgagctgccgggcatactggcgctgatcgccctcagcgtccacggctggcgggttgtcggccagcggctgcgctggcgcgcgctcagcgatagcgtctggctgctgtggccgctgatgctggggacgctggtctggcagatcgcagcccagggcgcgatcctcagcgccggctggcagaacctcgcctggtgtcttgcactgccgtccgccttctggctgctgtatcaacagcgtacgccgcccgtgccctggctttcgcagggactgcacctgtcgctgttctggatgatcctcgccgcgctggcggcagagctgtggtggtttaccgatgcgctgccgtgggggatgttcccgtggcaggcggggctggcgatgaccgcggcggccgcagtgatcctgctggtacgcgccgggatcaagcgttcgctgtggccgctgcgcgtctggccgcagtggtacggcaccctggcgctggcgccgccgggcgttttcctgctggtgatgctgctgttgaccaatatcgacgatggcgtggtgatggaacagggctaccggccattgctcaatccgctggaagagggcgcggcctttgccttactggcgctgttcgcgctggcgcggctgtgcgcccgctatttcccggcgcaggggcgtgagatccataaacgtgtgccgctgctgctggcggcgctcgccttctggtggctgaacggcctgctgttgcgcagtctggcctggtatggcgatatcgactggtcggtgagcgcgctctggtcgtcccgcctggtgcagacctgtttcgcgctgttctggatgctggtggcgctgctggtgatgctgcgcgctgcccggcaggcgtcgcggcatgaatggctgggcggtgcggcgctgcttggcgtggtgattgtgaaactgatgctggtggacagcgcgggcggcggcggactggcgcgcgcggtggcctttatcggcgtggcggtgctggtgctcatcgtgggttatttctcgccgctgccgccgcggatacaacagacgcataacgaggaacaaggataatgacaatcatcagacggatacttttttgtgcgttactgggcgcggcgctgccgggctggagccaggacgccgcgccggaaaaaccgcaggattatgcctggggcgcggggctggagacgaccacgccatcgccgctgtatcaggtgaccttaccggagcgcatctataccgacagcgtcgcccccgatctgcgtgacgtgcgggtttttaatcagcagggtaacgccgtgccttttaccctgatcccggcggtgcagaaacagacgccgccgcgcacgctgccgctgcgcctgttcgcccttgatgcggtaccggaaaataatgcctcgtcagaaagcctgtggttgcgctcgcaggacggaatcgaaatccgtctggagggagaagggcggaaaacagcagggaagagttatctgttaaccctgcctgacacgcaaaaagacgactttccgctttcacagctgaagctggcctggagtgccgcgcccgccaactggcaggggcgcgcggatgtgtacttcagcagcgatctgaaaaactggacgctggcgggccgggatatgccgctgatggatcttgcctccggcaacgatcgcctgttgctggacacgctggatttcagcagttcagcctacccgacggaaatgcgttatgtgctggtagtgttcaacgatgccgcgcacgcgcctgcgctgaccggcgcgacagcggttgagcaggtttacagcgatacggcggtgaacatccacctgaatgcggtggcgaaaaccgtctccccggcggtacaggagttttcctggcaacgaccacagccgctggtgtcggtgatgattgaagcccggcacgggcgcgtactgccgctggcgatcgagtaccgcagcggggaaaaggccgcatggcagccgctggcgaaaagcgtgatttatcagctgaacggcaaagcgccggagccgctgaaaaccagcgggctggtgcaggcgatccgcgttacggcggttaatggccaactggaggatggtatcgcccaggtgaccggcgagcgcgccagccagacgctgatctttaatgcgcaaggtaaagggccgtttttactggcctgggggaatggcgctgcacaaccgcaggcgatggaggtggagatgctggtgcctgccgcgctacgtcaggagaatgcgcagctcccggaggcgatggtgcaggatcgcgtagtgctgggcggcgacgcgcggctgacggcggtggatccggcgcagcagcaaagccagtggaagaagatgctggtgtgggcggcgctggtgctgggcgtgctggtgctggtctgggtggggcttgggatctggcgcgaggtacggcagaagtcggtataaaaataaaaatgccgggtggcgctgacgcttacccggcctacgtacgacgatctacggaacaatcgtaggcccggcaagcgcagcgccgccgggcattacgtcatcgaacccccccaggccccgcaagcgcagcgccgccgggcaaaaacggcttacaggctggtgagattttcgctcaggtatttcgccacgccgtccggcgacgcgttcatcccttctttgcctttttcccactgcgccgggcagacttcaccgtgctcttcgtggaattgcagagcgtcaaccatacgcagcatttcgtcgacgttacggcccagcggcagatcgttcaccacctgatgacgcacaataccgttagtgtcgatcaggaaggagccgcgcagcgccacgcccgcgtccgggtgttcaatgccgtaggctttctggatttcacgcttgatgtcggccaccatcgcgtatttcaccgggccaataccgcctttatcgacgggcgtattacgccaggcgttgtgaacaaattcagagtcaaaagaaacgcccaccacttccacgccgcgcttctggaattcttcgtaacgcttgtcaaaagcgatcagttctgacgggcagacgaaggtgaagtccatcggccagaaaaacagcaccgtcgctttgccctggatatgctgtttgaagttaaagttttccacaatttcgccattgccaagcacggcggcggcggtaaagtccggagccggacgagtaaccagtaccatcataattctccagtgtgattgtaggggtaaggccgctatcaagataatcacctgccggtaaagcgcaagcactaaagctgtttgtttttcgcctgcgccatcatgcggggatagaactgaaagaacagcttttccagcgcctgataatgcgtatccagatcctgccacgagtcgcgcagcgcatcgaggcggggccgccgcgtcgccatgccgttcagcacctgctgaataaaatccatctcccggtagcgctcaagccatcgctctgaccacaaatagtcattcagattgacgaagcgcgccggcgaggagggcagaatggtggcgacctgcgcgtgggcatagctcacaaattcgctcagcggcatgtcaggcgacatctgcaaccagtggcgtgacagaaaatggtcccacatcacgtccagcgtaatgggcgcgacccggcgcgtttgcgggcgaaaccactcacgcgcttcgcggacttccggcaaattatcggtcagcacgtcaatgcggcggtgcatgcgaatgccgtcgacaatctcagccggatagctatcctgcgggttgccgcgaacgaaatcgcccagcaaattaccgggaagcgagctttctgcgaggtgcgcaagatgcaggtgtgcgaggaagttcattgtttagttaatccataaagaggcgtagctgttgcagcggaagcaccgtagcactagactatcccgcctgtttttcagtctgagtgtaagccatgcgcgttgccgatttttcctttgaattacccgaatccctgatcgcccattaccctgtgcctgcgcgcagtagttgccgcctgttatcgctggacgggccgacgggcgcgctgacgcatggtactttcaccgatctgctcgacaagctcaaccccggggatctgctggtctttaacaatacccgtgtgatcccggcgcgtctgtttggccgtaaagccagcggcggtaaaatcgaagtgctggttgagcggatgctggatgataaacgtattctggcacatattcgcgcctctaaagcgccgaagccgggtgcggaactgctgttaggcgacgatgacagtgttaaagccaccatggtggcccgccacgatgcgctgtttgaagttgagtttaacgatgaacgcccggtgctggatattctcaacgccatcggccatatgccgctgccgccctatatcgatcgtccggatgaagacgctgaccgcgaactttatcagacggtttacagccagaaaccgggcgctgtcgccgcgccaaccgcgggtctgcactttgatgagccgctgctggcgcgtctgcgtgagaaaggcgtagagatggcgttcgtaacgctgcacgttggcgcgggcaccttccagccggtacgcgtggacagcattgaagatcacatcatgcactctgaatatgctgaagtgccgcaggaagtggttgacgcggtgctggcggcgaaagcgcgcggcaatcgcgtggtggcggtcggcaccacctcggtgcgctcgctggaaagcgccgcgaaagcggccaaaaacgatctcatcgagcctttcttcggcgatacgcagatctttatttatcctggctatcagtacagcgtgattgacgcgctggtgaccaacttccacctgccggaatccaccttgatcatgctggtatcggcttttgccggttataaagccaccatgcacgcctataaagaagcggtaaaagcggaatatcgcttttttagttacggggatgcaatgtttatcacgtacaatccgcaggcaatttctgagcgcgtcggggaatagttccgcggcgctttgattgacgcgttggactgtttttccggcgtatggagaaaaaatgaaattcgaattagatacgacagacggacgcgcccgccgtggccgcctggtgtttgatcgcggcgtggtggaaacaccggcctttatgcccgtgggcacctacggcaccgtaaaagggatgacgccggaagaagtgcaggataccggcgcacagattatcctcggcaacaccttccacctgtggttgcgtccgggtcaggagatcatgaagctgcacggcgatctgcatgactttatgcagtggaaaggcccgattctgaccgactccggcggtttccaggtcttcagcctcggcgatattcgtaagatcaccgaagcgggcgtgcatttccgcaacccgatcaacggcgatccgatcttcctcgatccggaaaaatccatggagatccaatacgatcttggctccgacatcgtgatgatcttcgatgaatgtacgccatacccggctgactgggactacgccaagcgttccatggaaatgtccttacgctgggcgaagcgcagccgtgaccgtttcgattcgctgcaaaacaaaaatgcgctgttcggtattattcagggcagcgtttacgaagatttacgtgatatctccgtcaaaggtctggtagagattggctttgatggctacgctgtcggcggtctggctgtgggtgaacctaaagcagacatgcaccgtattctggaacatgtctgcccgcagatcccggcagacaaaccacgatacctgatgggtgtgggtaaacccgaagatctggtggaaggcgtacgtcgcggcattgatatgtttgactgcgtgatgccgacgcgtaatgcgcgtaacggccatctgtttgtcaccaatggcgtggtgaaaatccgtaacgcgaagtacaagagcgataccggcccgcttgatgaagagtgtgattgctatacgtgtcgcaattattcactcgcttacttgcatcatcttgaccgttgcaacgaaatactgggcgcgcgtcttaataccattcataacctgcgctattaccagcgcttaatggctggtttacgcaaggctatcgaagagggtaaattagagagcttcgtgaccgatttttaccagcgtcagggtcgtgatgttccacctttgaacgttgattaattttaataatgagggaatttgaatgagcttttttatttctgatgccgtagcagcaacgggcgcaccggcgcagggcagcccgatgtctttgatcctgatgctggttgtatttggtctgatcttctatttcatgatcctgcgcccacagcagaaacgtaccaaagagcacaagaatctgatgaactccatcgctaaaggcgatgaagtgctgaccaacggtggcctggtgggtcgcgtgaccaaagtagcggaaactggctacattgctatcgccctgaatgacaccactgaagtggttatcaaacgtgacttcgtagctgccgttctgccgaaaggcacgatgaaggcgctgtaatctttcgttttcccaaagggaagtgccgtgttaaaccgttatcctttgtggaagtacatcatgctggtcgtcgtgattatcgtcggcctgctatacgcacttcccaacctgtatggtgaggatccggcagttcagatcactggtgcgcgcggcgtcgccgccagtgagcaaacgctgatccaggtccagaacaccttaaaacaagaaaaaatcactgctaagtctgtggcactggaagagggcgctattcttgcgcgtttcgactccaccgatacgcagctgcgcgcgcgtgaagcgctgctcagcctgttgggtgacaaatatgtcgtggcgctgaaccttgcacctgctactccgcgctggttatcctccatcaaagcagagccgatgaaactcggtctggatctgcgtggtggcgtgcacttcctgatggaagtggatatggacaccgcgctcggcaaactgcaggaacaaaataccgacagcctgcgtagcgatttacgcgaaaaaggcattccttacaccaacgtgcgtaaggaagataactatggcgtgagcattgtgttccgcgacagcgcagcgcgcgatcaggcgattacttacctgactgcccgtcaccgcgacatggtgatcaccagccagagcggcaacgccctgcgcgcggtcatgaccgatgcgcgtttgagcgaagcgcgtgaatatgcggtacagcagaacatcaacatcctgcgtaaccgtgtcaaccaactgggtgtcgccgagccgctggtacagcgtcagggcgctgaccgcatcgtggttgaactgccgggtattcaggacaccgcgcgtgcgaaggaaattcttggcgcgactgcgaccctcgaattccgtctggtgaacaccaacgtcgatcagtcggcggcggcgtctggccgtgtaccgggtgattcagaagtgaaacagatgcgcgaaggccagccggttgtgctgtacaaacgcgtgatcctgaccggtgaccatatcaccgactccacttccagccaggatgagtacaaccagccgcaggttaacatttcgctcgacagcgcaggtggcaacatcatgtctaacttcaccaaggacaacatcggcaaaccgatggcgaccctgtttgtggagtacaaagacagcggtaaaaaagatgcgaacggtcgttccgtactggtgaaacaggaagaggtgattaacgtcgccaacatccagtcgcgcctcggcaacagcttccgtattaccggcatcaataaccctaacgaagcgcgtcagctgtcgctgctgctgcgtgcgggtgcgttgattgcgccgattcagatcgttgaagaacgtaccattggcccgaccttagggatgcagaacatcacccagggtctggaagcctgtctggcgggtctggcggtctccatcatcttcatgctgttcttctataagaagtttggcctgatcgccaccacggcactgatcgccaacctggtgctgattgtcggcatcatgtccctgctgccaggggcgacgctgaccatgccgggtatcgcggggatcgtcttaacccttgcggtagcggtggatgcgaacgtactgataaacgaacgtatcaaagaagagctgagcaacgggcgtagcgttcagcaggcgattgacgaaggttatcgcggcgcgttcagctccatttttgacgccaacgtcacgacgcttattaaggtcatcatcctgtatgccgtaggcaccggggccattaaaggcttcgccattactaccggtatcggtgtggcgacgtcaatgtttaccgcgatcgtcggcacccgtgccatcgtaaacctgttgtacggcggcaaacgcatcaacaagctgtctatctgaggagtgcgttgtggcacaggaatatactgttgaacaattgaaccacggccgtagagtctgggactttatgcgctgggattactgggccttcggtatctccggttttctgctgatcctgtcaattatcattattggcgtgaaaggctttaactggggtctggattttaccggcggtacggttatcgaaatctcgctggaaaaaccggccgatatggatcagatgcgtgaagcgctggaaaaagccggctttgccgatccgctgttgcagaactttggcagcagccgcgacatcatggtgcgtatgccgcctgccgagggtgaaaccggtggtcaggtgctgggcagcaaggtcgtgagcgtgattaacgaagcgaccagccagaatgccgcggtgaaacgtatcgagttcgtcggcccgagcgtgggtgcagacctggcgcagaccggcgcgatggcgctgatggtggcgctgatttccatcctggtttacgtcggcttccgctttgagtggcgtctggcggccggtgtggttatcgcgctggcgcacgacgtcatcatcaccatgggcgtactgtcgctgttccatatcgaagtggatctgacgattgtcgcctcgctgatgtcggtgatcggttactcgctgaacgacagcatcgtggtatcggaccgtattcgtgaaaacttccgcaagatccgccgcggaacgccgtacgaaatctttaacgtgtccctgacccagacgctgcacaggacgttgatcacttcaggaaccaccttagtggtgatcctgatgctctacctctttggcggcgccatgctgcagggcttctcgctgaccatgctgatcggtgtgtccatcggtactgcatcgtcgatttatgtcgcgtcagcgctggcgctgaagctgggcatgaagcgtgaacacctgctggtgcagaaagtcgagaaagaaggcgcggaccaaccgtcaattctgccgtaaaccgacgctctgcgttgaaaaccgcagcctcagcgctgcggttttttttcgcctgcgttttacgggcaaaaaaaagccagcggttaagctggcttttcgatggggctgacagacaaatcagaagttataacctgccaccaggtaaccaccccagccggtagagcggacgttttctttcatccataccaggtctgcatcatcattccactgaccgccgttgtgccagtaacgcgctactaccgagtagtgccagtgatcgtagctcagggacagaatgtggctggaggcgatggagtcgttggtacgctgcttgatgccgttcatcgcatagctgctcttatcgcccaggtctgagccccagtcaaagttggtgaagccgatgtagctcaggttaccgccccacagttgggtgatcggcacgaagtatttcactttgaaacggtagccgtcccactcgttttcgttttccgccaggtagttctgccactggtatttcgcatacacgttcagtgacaggctcatcggcaggccggtatcgatgtcggtacccagacccatgtaccaggtgctctgacgaccagaggcgttgcggcccatgtcgtagatgtagttgttcgcgaaataccactctttaaacggaccgaagctcagatcggcgccggtcagcttatcgatagagaaacgcggttcgatttccataaacagcggcgaaccatggttccagatcccgcgggcatcggtgttaccaccgaagaataccggtgcatccaggtaaccatagaaatcaaaccagtcttttttggcaaatgcttcatattccaggtaggtatcgttacggatctgcggtccaaaacgggtgtgatagctgcctaccacgttcacgctctggtgccaccagtcggaaacgaactccggcttgtcattttctgccgcattgactgcgaatgaggaggagagagccagtgctgcaccggcgacgagtaatgtttttttcatagtttagccactgattaggttcccttgcgggagcgaaagaacgcgcgtattgagtttctaaatgtttcgtatttcagcgagcctattataagtatccatgctcacaaaaatatgtgttgtttcacatatccattacgcacgtaatcgattgcgttcacgtttgcgtatataaaacgcagggattgtactgagattcatctgtcttgcaaatatttcgtggaaaaaggcggtaggggagggaaaagggcgagaggctcgcccttaaacaggatcactgattggtggcgggctgaatatcgtggacgcgtacaaagcccagctggtccggcgtgatgccgttaagctgcagcggcagatcaacgtcgctcggcgccagggtgctggccggggcgttaatcagctggttttgcacgttcacttcctgataatcgttggtggtgccctggatctgaccccattccaccgtaccgctaaacgctggcagcggatcgttcgattcgccctgaatgcgcagcgtcacgcgcgtgccgttcgcatcaggcgcgatgttcaccagcgacatcttcagcataccgatctggctgtgcagaagggcaggggtattcgcgcccggcaacaggtacacaccgctgctggatttggcgttcagcgcattttgctgggtgattttcaccgtctcctgattcagcttactcatttctttgttaagcgtgctgacactttgatgcaactggcggacttcgctctgctgcgcgcaggcgctgagggtaaacaggctgccgaccagcaaaattttcaggtaacgtcttgtcatcgtgttggtttccttgcaaagagcattgcctgtaatagtagcctgcacgaaccggcttgccatcgatcctttatctcaaaagcggtcttgcctttgttgtcacggcagatcaggttaaaatagatttcagctaattttaacgtcaggacgccgtatgcattgcccattctgtttagccgtggataccaaagtaattgactcccgcctggtcggtgaagggtcgtccgtgcgccgccgccgtcagtgtctggtgtgtaatgaacgcttcaccacttttgaggtggcagaactggtgatgccacgcgtggtgaaaagcaacgagatccgcgagccctttaacgaagaaaaactgcgtaacggcatgctgcgcgcgctggaaaaacgcccggtaagcgccgatgacgttgaaatggcgctgaatcatatcaaatcccagctgcgcgccaccggcgagcgcgaagtgccgagcaaaatgatcggcaacctggtgatggagcagctgaaaaagctcgataaagtcgcctatatccgcttcgcctcggtttaccgcagcttcgaagacatccgcgaatttggcgaagagatcgcccgcttacaggattaagctcatgcacgatgagatgtacatggcgcgcgcgctgaaactggcgcaacgcgggcgttttaccacccatcctaatcccaacgtcggctgtgtgatcgtcaaagacggcgagattgtcggcgaaggctatcaccagcgggcgggcgaaccccatgctgaagtccatgccctgcgtatggcgggcgaaaaggcgcgtggcgccaccgcctatgtcaccctggaaccctgtagccatcacggacgcacgccgccatgctgcgacgcgctgatcaacgcgggcgtgtctcgtgtggtggcggcgatgcaggatcccaacccgcaggttgccggacgcgggctgtatcgtctgcaacaggaaggcattgaggtcagccacgggctgatgatgagcgaggcggaaaatcttaataaaggttttctgaaacgtatgcgcaccgggtttccttatgtgcagctgaagctgggcgcgtcgctggatggccgcaccgccatggccagcggcgaaagccagtggataacctcaccgcaggcaaggcgcgatgtgcaacgtctgcgcgcgcagagtcatgctatcctcaccagcagcgcgacggtgctggcggataatccgcagcttaacgtccgttgggacgaactcccggcggacgtacaggcgcagtattcgcaggcgcagttacgccagccgctgcgtattgtggtcgacagccagaaccgcgtcacgccggaacaccgtctgatccagcaggcgggtgaaacctggtttgcccgcacgcagcaggactcgcggtcgtggccggacaacattcgccacatccaggtgcctgaacacaacggtcatctcgacctggtgctgatgatgatgctgctgggccgcgagcaggttaacagcatctgggtggaagccggggcgtccctggcgggcgcgctgcttcaggccgggctggttgacgagctggtggtgtacctcgccccgaaacttttaggcagcgacgcccgcggtctgtgcgtactgccgggctttgaggcattagccgatgcgccgcagtttacattcagtgaaattcgtcaggttggacctgatatttgcctgcatttgaccactgcgtaatgccctcgtaaaagggaagcagtgcgcaaagtattatgataaaatccgcccccctgcggggccaaatgaacccgtaaaggaagagtatgaacattattgaagctaccgttgctgccccggacgctcgcgtcgccatcaccattgcgcgtttcaacaacttcatcaatgacagcctgctggacggtgctatcgacgcactgaaacgtatcggtcaggttaaagatgaaaacatcaccgtggtttgggttccaggtgcttatgagctgccgctggcggctggcgcactggcaaaaaccggtaaatatgatgcgattatcgcgctcggcacggttatccgtggcggtaccgcccatttcgaatatgtggcgggtggcgcaagcaatggtctggctcatgtcgctgaacagagcgaaatcccggtagcctttggtgtgctgaccactgaaagtattgaacaagccatcgaacgcgccggtaccaaagccggtaacaaaggtgcagaagctgcccttaccgcgcttgagatgattaatgtattgaaggccatcaaagcctgatttttttgtaaggggaatttccgtgaaacctgctgctcgtcgccgcgcccgtgagtgtgccgtccaggcgctttactcctggcagttgtcccagaacgacatcgccgatgttgaataccagttcctgtctgaacaggatgtcaaagatgtcgacatcgcgtatttccgcgaactgctgtccggggtggcgactaacagcgcatatctcgatggactgatgaagccctacctgtcccgtctgctcgaagagctgggccaggtcgagaaagcggtactgcgtatcgcgctgtttgaactgtctaaacgtgcggatgtgccgtataaagtggccatcaacgaagctattgaactggcaaaaacgtttggcgcagaagacagccataagtttgttaacggcgtgctggataaagccgcacccgcgatccgcccccacaaaaagtaatttgctggtccgcgcggcgaagtgcagttgccatttcgccgcctccccagtctcctgtttatcattctgctgaggcatagcgtatggcatgcggcgagttttcccttattgcccgttattttgaccgcgtaagacgcgcgcgtctggatgtcgaaaccggcattggcgacgattgcgcactgctcaatattcctgacaagcaaacgctggcaatcagcaccgataccctggtttcgggcaaccattttcttccggatatttcccctgtcgatctggcgcacaaagcgctggcctccaacctgagcgatcttgcggctatgggcgcggatccggcgtggctgacgctggcgatcacgttgccggacgtcgatgaagcctggctggaagcctttagcgatagcctgttcgaacagattaattactacgatatgcagctgattggcggcgacaccacccgtgggccgctgtcgatgacgctgggtatctacggctatgtgcctgcgggccgcgcgcttaagcgttcgggcgcgaagcctggcgactggatctatgtgactggcacgccaggtgacagcgcggcaggtctggcgatcctgcaggatcggctgcatgttgataatgagcaggacgcgcagtggctggtaaaacgccatctgcgtccgacgccgcgcattctgcaggggcaggcgctgcgcgatctggccagttcggcgatcgatttatccgacgggctaagttccgatctcgggcacatcgtgaaggccagcgactgcggcgcgatgctggatatggatgccatgccgttctctgacgccatgcgccgtcacgttgagccggagcaggcgctgcgctgggcgctggcgggcggcgaagattatgaactctgctttaccgtgccggaacgcaaccggggggcgctggacgtggccattggtcatcttggcgtgccctttacctgcatcggccagatgagcgccgatgtggaaggcatccagtttacccgcgacggaaaaccggtatcgtttgatttaaaaggatacgatcactttgcaacctcgtaaggatagtgcgaaaagccgtcttagcatgcgcaacccctggcatctgctggccaccggttttggcagcggcttaagtccgattatgccgggcacggcgggttccattgcggccatcccgttctggtatctgatgacttttctgccgtggcagctctattcgctggtgatcatgctttcgatcagcatcggcgtttatctgtgccatcaaacagcgaaagatatgggcgtgcacgatcacggcagcatcgtctgggatgagttcatcgggatgtggatcacgctgatggcgctgccgacccatgactggcagtgggtggtggccggttttgtgctgttccgcttttttgatatctggaaaccgtggccgatccgctggtttgaccgcaacgtgcacggcggcatgggcattattgtcgacgatattatcgccgggattatcgcggcggcggtgctgtatgtaatcggtcatcactggccgattggcattatttagccgttttccccggcctgatcttttcagaacaggccggggcagcgattatttaaatcccaccacggcatgctgtttatacggcatttccatttcggcgatctgctccggcgtcagttgcagatcaaccgcctgcaacaactcttccagctgctcttcccgtgacgtgccgataataggcgcggccacgcccggcttactcagcagccaggccagcgccacctgcgcccgcgttgcgcccacgtcttccgctatcgcggccaggcgttcggcgatctgcgcatcgctctgctcgctgtcgtcatagagttttttacccacttcatcggacaccagccgcgcggtggtttcaccccaggggcgcgtcagacggccacgggccagcgggctccacgggatcaccgcgatgccttcctgatagcacagcggcagcatgtcgcgctcttcttctcggtagatcagattgtaatggttttgcatggtgacgaaacgcgcccagccgtgctgtttttgcagatccagcgcctgggcgaactgttcggtgtgcatggacgatgcgcctatgtagcgcgccttaccggctttcaccacgtcgttcaacgcttccagcgtttcttcaataggcgtgttgtaatcccagcgatggatttgcagcagatcgacatactccatgccgaggcggcgcaggctgtcatctatggaacgcaggatttgcgcccgtgacaggccttcggtgagatcgcccgacgaataatagactttggtggcgaccaccacctcgtcgcggcgtgcaaagtctttcagcgcgcggccaacgatctcttcgctgctgccatcggaatagctgtttgccgtatcgaaaaagttgatgccgccttccagggcgcgctgaataatcgggcggctgctctcttcaggcagggtccaggcgtgattgccccgatccggctcgccaaaggtcatacagcccagacaaagacgggaaaccttaaggtccgtttttcctaatgtattgtattgcatggttccactcctgctacgggtacgagattacctaagcatagcaggagcggaagagggagttaggccagccagtttttgatgctggcttcaataccggcagcgtccagaccaatggcggcgcgcgcctcgtcctgggtgccctgaggaataaaatgatccggcaggccgaggttgagcaccggcaccagcgtgcggttcgccatcagcacttcgttcacaccgctgccagcgccaccgatgatggcgttttcttccagcgtcaccagcgcttcatggctgcgggccagcgacaggatcagcgactcgtccagcggcttcacaaaacgcatgtccaccagcgtggcattgagcgattccgcgacctgtgccgcatcggccagaagagtgccgaagtttaaaatcgccactttttcgccctgacgtttcaccacgcctttacccaacggcagcttttgcagcggcgtcagttccacgcccagcgcattgccgcggggataacgcaccgcgctcgggccatcgttatagtgatagccggtaaacagcatctggcggcattcattttcatcgctcggcgtcatgatcaccatttccggaatacagcgcaggaatgagatgtcgaacgcgccctgatgcgtctgcccgtcagcgccgacaatacctgcgcggtcaatggcgaacagcaccggcagcttctggatggcgacgtcgtggatcacctgatcgtaagcccgttgcaggaaggtggagtaaatcgccaccaccggcttgtaaccgccaatcgccagacccgccgcgaaggtcacggcgtgctgctcggcaatcgccacgtcaaaatagcgatccgggaatttacgggaaaactccaccatgccggagccttcgcgcatcgccggggtgatcgccatcagtttgctgtctttggccgccgtttcgcacagccagtcgccaaaaattttggagtaggacggcatgccgccgacgcttttcggcagcgttcctttagccggatcgaatttcggcaccgcgtggaaggtaatgggatctttttccgccggctcataaccacggccttttttggtcatgatatgcaggaactgcgggcctttcaggtcgcgcatgtttttcagcgtcgtcaccagccccagcacatcgtgaccgtccaccgggccgatatagttaaagcccagctcttcaaacagcgtgcccggcaccaccatgcctttaatatgctcttcggtgcgtttgagcagctctttgatcggcggtacgccggagaagacttttttgccgccttcgcgcagcgtggaatagagtttgccggacagcagctgcgccagatggttattcagcgcgccgacgttctcggaaatcgacatttcgttgtcgttgagcaccaccagcatatccggccggatgtcgcccgcgtggttcatcgcctcaaaggccatgcccgcggtgattgcgccatcgccgatcacacagacggtgcgacgctgcttgccttctttcgccgccgcaacggcgatgccgatcccggcgctgatcgaggtggacgaatgaccgacgctcagcacgtcgtattcgctctcgccgcgccacgggaaggggtgcagcccgtctttctgacggatggtatcgatcttgtcacgccgtccggtgaggattttatgcggataagcctggtggcccacgtcccagatcagctgatcgaaaggcgtgttatagacataatgcagcgccacggtcagctcaatggtgccaagcccggaggcaaagtgcccgctggagcggctcacgctatcgagcaggtagcgacgcagttcgtcgcacagcttcggcaggctctctttcggcagcagacgtaactccggggcggagtcaaccagtgccagtgtcgggtatttggctatatcaaaactcatcggccactcgtcttactcgtcataattcagcgggcagtttgccgccctctgcgttatcaggagcatataaaaagtttatttatcacgctggattatgtaattcgccagtgcttccagtgccgtggtatccagtgactgggcggccagcgcgtctaacgcgtggcgggcatcgtcaatcaggtcacgggcttttgtctgagcctgctctaagcccagtagtgcggggtaggtgcttttacctaaaaactgatcggcaccctggcgtttgccaagggtcgcagtatcacccaccacatccagaatgtcatcctgaacctggaacgccagaccgatgctttcggcgtagcgatcgaggatcggcagcgcagcgcgtcctttatcaccggcgcttaacgcgcccagtcgcaccgcggcgcggatcagcgcaccggttttatgccggtgaatacgttcaagctccgccagaccgacctgtttgccttccgcctcaagatccagcgcctgtccgccgcacatgcctgcgacgccactggcctgcgccagttcagacaccatagcaaggcgatcgcgcgcgtcgacttccggcatgggcgtatccgcgaggatagaaaacgccagcgtttgcagcgcatcgcccgcgaggatcgcattcgcttcgccgaatttaatatggcaggtcggctgaccgcgacgcagatcgtcatcatccatcgccgggagatcgtcatgcatcagcgaataggcgtgaatacattcaatggcggcggcaggggcatcgagcgtggatgcgctcacgccaaacatctggcccgtagcatacaccaggaaaggccgcagccgtttgccgcctaacagtgtgccatagtgcatggcctcaaccagtggagtgttctgaaagggctggggagaaataaagcggcgcagggcgtcattcgcctgctgtacgcagatttcaagttgctgtgcaaaatccatgtttactcggcgtccggagtgaaaggcgtcagcggggcgtcatcattatcagagagcaggatctgcacgcgctgctctgcctgttgcagtttaacctgtccctgacgggccagctgtacgccgcgctcaaattcatttaaggcttcttccagcggtaagttgccgctttcaagacgggtgacaatctgttccagctcattgagctccgtttcgaaactggccggtgcgtcatttttctttggcatgtgaatgtctgactctctcatttattcggccccgctatggtagcggagtggcgcaacttagcaaataaggcgtaatggtcatgcaatatgcgcaggttgaccacgatggtggtatacttctgcgcctggatgcagccgcaggtatgggctgctgtatatttctctcaacagatcgcttgcctgatctgccaacgaaccattgccgccatgaagtttatcattaaattgttcccggaaatcaccatcaaaagccaatctgtgcgtttgcgctttattaagatgctgaccggaaatattcgtaacgttttaaaacattataacgacgacacgctcgccattgttcgccactgggatcatattgaagtccgctccagagacgaaaaccagcgtctgactattcgcgatgccctgacccgcattccggggatccaccatgtgctggacgtggaagatgtgcctttcacttcgctgcatgacatttttgaaaaagcgctggcgcagtatcgcgaccagctggaaggcaaaaccttctgcgtgcgcgttaaacgccgcggtaaacatgagtttagctctattgaagcagagcgctacgtgggcggcggacttaatcagcatatcgaatcggcgcgggtaaaactgacgcacccggatgtcaccgtacatctggaaattgaagatgaccgtttgctgctggtgaaaggccgctacgaaggcatcggcggtttcccgatcggtacccaggaagatgtgctgtcgctgatctccggcggtttcgactctggcgtgtccagctatatgctgatgcgtcgcggctgccgcgtacactactgcttctttaatcttggcggcgcggcgcatgaaatcggcgtgcgtcaggtggcgtactacctgtggaaacgttttggcagctcgcaccgcgtgcgctttgtcgccattaactttgagccggtcgtgggcgagatcctcgaaaaagtggaagacggccagatgggcgtggtgctcaaacgcatgatggtgcgcgcggcgtcaaaagtcgccgaacgctatggcgtgcaggcgctggtgaccggcgaagcgctgggccaggtgtcgagccagacgctgaccaacctgcgtctgattgataacgtttccgacacgctgatcctgcgtccgctgatctctcacgataaagaacacattatcgatctggcgcgtgaaatcggcaccgctgactttgcccgtaccatgccggaatactgcggtgtgatctcgaaaagcccgaccgtaaaagcggtgaaagcgaaaatcgaagcggaagaagaaaactttaacttcgacattcttgatgaagtggtcgccgcggcgagcaatatcgacatccgcgaaattgccgagcaaacccagcaggacgtggtggaagtggaaaccgtcaccggtttcggcccgaacgaggcgatcctcgatattcgttccatcgacgagcaggacgataagccgttgcaggttgaaggtgtggaagtggtatctctgccattctacaaactcagcactaaattcggcgatctcgaccagagcaaaacctggctgctgtggtgcgagcgcggcgtgatgagccgcctgcaggcgctgtatctgcgcgagcagggctttgagaacgtgaaggtttatcgcccgtaatgaaaaagcgccgtaaggcgctttttttattcgtaataattataaattcctgccggtatcaccagctgtgacgccacttcgtgggccttttctcgcccgaccagcagatcgataatcttcagaccgaaatcaatggcggtgcccggcccctggctggtcagcaggttgacgcgcggatcccagaccacacgtttatcctgccactgatcttccgggatacggtctttcagcgccgggaagccggtcatgttgccgatggggaacagatcgtgaggaaccagcacggtagccgcggcggcgcagatggtggcaacgatgcggccggaaagatggaactgccgcaccgtctctaccagcagcggactgtcacggaaacattcggcgcctttaatgccgcccggcaggacgatgatgtcaaaatcgccgtcagccacttccaccagcggcgcatcggcaagcagcttcacgccgcgcgagcagacgatcctcagatcgccgtcgctggcaacactggcggtagtgacgttgatgccgccacgcaccagcaggtcgatggtggtgaccgcttccatttcttcactaccaggggcgaggcatatcagtgctgatgggctcatactcactttccttacgcttaacgagttcataaagtcgggtgttttccgggaccgctataccgtgcgcgcgggcgcgtctgagcaaatacccggtgatgtaatcaatttcggtatgacgcagggcgcgcacgtcctgcaacatcgacgagatgttatctttagtgctggcgatgatctggttgacgtaaagcagcaaatcctcagcggaagtatgatgaccttcccgctccatcaccgccgccacttcgtggcacagcgtctggattaaggccggatgcgcctgtagctcgccgttcgggcagttccacagcgcggtcagcggattgatcacgcagttcactgccagcttgcgccacagctcagggcgaatggtgttatgccaggctacgtccggcagcacgtcctgaagggtatccgccagatagctgtaatccccgtcctgctggcgtgcagggccaatgtgagtgataccacccgcgacgtgcagaatgacattgccatcgtggcgggcagcgtgcgtggtggtacccatcagcagaggctgggagatatttttcagctcatccaccgtacccataccattatggatgaggagtatcggcgtagcggcaggtaaactggcggcgaggtttcttaccggttctgacacctgccaggctttaagagtcaccagcagcagatcgctttgcgccaggaaatcaggatcgttcgcggttaacgacgcgttaaaaagggtgccgtcttcttcgatcaggtttacgctgcaataaggttgaggtacgcgaagccagccctggacttcatgtccatgcctgcacagcgcgctcagccacagctgacctaatgccccgcatccgagcacggtaattttcatggttcctcctggcctgcaacacttacgggcataacaagttgagttatgcttcttagcaggtattatgcatcgcaataaatagagagggagaagaaaagatgccatctttcgatattgtctctgaagttgatcttcaggaagtccgcaatgcggtcgacaatgccagccgtgaagtggagtcgcgttttgattttcgcggcgttgaagccactttcgagctgaacgaggcgaataaaaccattaaggtgctgagcgaatctgatttccaggtgaaccagctgctggatattctgcgtgccaaactgctgaaacgcggtattgaaggggcgtcgctggacgtacctgaaactttcgtgcacagcggcaaaacctggtttgttgaggcgaagctaaaacaaggcatcgagagcgcgacgcagaagaaactcgtcaaactgatcaaagacagcaagctgaaagtgcagtcgcagatccagggtgaagaagtgcgcgtgaccggtaaatcacgcgacgatttgcagtccgcgatggcgctggtgcgcggcggcgatctggggcagccgttccagttcaaaaacttccgcgattaactatcccaggcccggcgatacccttttcgtcggccttttttactcccttcacctgcttcagccaattaagtaaattaatcaatctattacgaatttgagaatgatgataatcacattctaggtgaaatcatcttgtcagcctggtctgcactgattactttgctaactcgaattagcaaagggcggggcagggatgccatcacatgaatttaaggcgctggccccgatataatggataaatggtgaggcgctatcatgtcagcagacaaaacaggtttattacaggatttatgtcagattaaaaatgcccgcagcgggcggctatccagctgggatcaaagcgggcgtaatcaggattactggatgatccccgccggggaaaccgttcggttagcggatataagtggtagcggttgtattacccatatctggatgacgcaattttgccgcaaaataaaaggccccggattgattgatccgacgcagggacaatatgtcgcgcccattaatgaaatcaataacgcccttggcgtaagctgggagcaacatgatgaagcttactatcgtaaggtactgctgaaattttactgggataaccaggtgcaaccgtccgttatcgtgccgctgggggattttttctgtgtcgggcattcggttccggctagctttacctcgctgcccttcactgtctcttgtcggcccgacgaaaattaccggcccggcgcgacggcggcgtttaactgctatttacccatgccctttaacgagcgcgcgattattgaagtcgaaaaccagaatgatttgccctacggacagtatttcaatatcgattttgaatgctatccggaaaagcatgccgacgatattgcttattttcatgcctggtggaagcgtgaaaatccctgccagggctgggggcctgaactgcaggttaacagcccggaagtcaatattccttgcctgagcgcggagaataattatgagcttctgaatattgagggggaagggcattatatcggctgcaatttatcggtgcgccatcggcaggaaacctggtggggcgaaggcgatgagatgatctttattgatgatgatccgctgtggccgccttcaattcatggcacagggacagaagattattttaatcatgcctggggaatgcaggactgttccgccccttttaatggttcctcactacacgattctcatttgccagggtttcagaccagctaccgctttcatattaccgatccagtgcattttaaaaaacgcatccgggtgaccatggagcatggtcatggtaatcatctttctgacgactgggcgtcgaccgtctactggtatcaaaagctgccctcgcccgtattgtcgatgcaaccggtggcggagcgtattccggcaagggcaggagaagcctttgccccgctgtctgaggtaacgctgaatgcagaaatgcaggcgcaaaaacagtgcgcggcgcagcgtcttgaaaactggcaaacgcttcgccagcaggaagtggataagaaaatcgccgccacgcgtgagaagtccattaacaataaaattatttcaccattttctgaataactaaacagcggtatgcgcattattgcggtatgcctggcgggttcccgtcaggcagaagatgtgcatacctgagccacctgaaatcacgttaccggaagagttttatcatgactacacgcttatcggttcttgaaaaaagcgcttatggcgcgggtgatatggcactcactatttctattatttccgcatccatacttatctatgctttcctgatccaggtcgtcggattatcgcccgttgacgcaggctggatattaatgattgtgcgcaccattgatgctatttccgatccgctgatgggaatattaaccagtaaattccgtacccgtctgggacgttatcgtcactggttgatgattggcgcaatacctttcggtatttcactctggctgttatttacttcttttggcgaaacctatagccagaaaatggcctggtcaaccggcgtctatatatttaacagccttgcctttacggtgctggcgatcccctatatttcattgattggcgtgatcaccgccgatccacaggagcgactgaacgctaacgcctttcggttcccgatggcgaaggtagccacgcttattgtttcaacctttgtgccgtactgggtgacccagggcagcgatgcgcgcagcagttacgcaacagcctttgcagtagtgggggcggtaagcgtcgttatcatgctgttctgcgcgtttaatgtgaaagagcgggtgatcactacgacacctgcagagcctttacgccgccaggtgaaaggcttgctgcaaaacgatcaatggcagattatcagcctcgcgatggtcgtgctgtttgtcggctttctggtgaatggcagcgtcgcgattatgtacggcaaagagtttgccggtgcgacggacgggtatgggattgcgatattcatgagtatgggatcggtaggaggcatccttgggccgttgatctctacctggctgacgcgtcattactgcaagataaaagtatttaagtattccatgtatggctcggcggtgatgtcgttattggcctggtggctggtaggggcgaacagcttctggagcgcgacgttcttttatttgctctgttctgtagtgtcacagattaatacgccgatcctctggtcttctattactgaagcttcagattatggcttatgcaaaacaggtattgatgcttccggtctggcgattggtatgatttctttctgccagaaattcggtatggggatcgccgggccgatcaccggctatttgttggcctgggtgggctacaccagtgagggcgcgcaaagtgcgtcagcgatcgcagggttatcctggatcatgctgctggtgccagcgctgttttatttactcaccggcctcattatgcatttctacgtgatcaacaacgcttactattccgcgatgatgcagaatggccgcaatgatcaagcgaccatactgtgtgaaaagcctcagtaaaaaggccccgcagctgacagggcggggcgcttgatttaagaccggcgcttgcgggtgatcagcgtcatcggcactctgacggtctcattaacgggatcgccggtaagcgcgcgctgcatcatattgaaggctttttccgcccaggcgtcttcgtcctgttgcattgaccagacattatttgccaggaaactcagcatcgggtgttcatcaaaggtgccgatatcaatatccggggaaagctcaccaaagcgggtacgcagcgcatcgatagccccctccagtaccggcagcgatgaggcgataaatacctccggctgcccatgttgtgcaagcaaccgatccatgatcgctctgccgccttccggcgtgttttctgctcctttgatgacccagttactgtggtctatgccctgttttttcagcgcctggaggtatccatccagccgatcgctgatgctcggtaactcggcatcgcctgccagaaaccagacgggttttttgcctgacgccagcagattctcggtcagcgtctgactaccttgcgcattttggctttcaaccagcgcgttgttgctgaacctgaaatcgcgatccagtagtaccatcggtttttttacctggcgcagatgatgctgttggttttccagcgaggagggaacaatgaataagccgtctatgttgcgggcgatcagcgctcgtaccagtttgttttcgtactcaatatcgtcataggtacagctgatggttaactggtagccggagcggcgacagcgcaactccagcttttcagccagggtggcaaagaagacgtttgaaatgttcggcacaataaaaccgagcgtgtcggttttattgagtttcagacttcgtgccgaatggttaagtacataaccataacggtctacatactccctgatgcgcgcctgagtctttacgctgatacggtactgctccgcttttccgttcaacactaaccgcacggtcgtgactgacaaattcagttcgttggcgatttgttcgactgttttggccactacagtatgctccggacaggtctttagagaatagtgatgaggccataatagaacgattatcaggcattgtctttatgcatcagtcggttaagcgcttgctgatgttcccacatttgtagataaacctgatatttacggtcatgagaggacttacgcgccggatttgccacaactctgctgccgggcctcaccatctgttgcgtcgccgcggcaagatccgggaatgcctgacaagccaccgcgccggtaatcgcagaccccaaggttacggcatcttcttcctgcaatagatggatatcataacctgtagcatcggcatactcacgcatccatagcgggttatgcgtagcgccgccgcacagcgccagccgcgcaatgatatgcccctgtttctgcatgacctcaataatatggcgtgtgccgtaggcgatggcctgaagcgtggcgaggtactgccgcgccacgcgggattcaccacgttccagctgtaacccgcatatactgccgcgcgcgtctggtcgggcgcggggagagcggttgccgtgatgatcggccagtatgtgcaaatccgctgtgggctcattttcgcgggtttccagcgcggccacccactcgttaaccagcgtaaccggatggtacccacgctgatgagcctgagtaatcagctctgttcctgtgctgcactcttgcaacgtccagtccactaacgcgcccgcagcgctttgcccgccctcggtcagccagtaccctggcaacatggctgaccagtatggcccccatacgccgggcgtcatgatggccgcttcgctacaaatcagatggcagttagatgtgccgcttatcagtgccagggtaccctgaggttgccgtccggttaaggctacgccgccggcatgggcgtcaatcataccgctggcgacgacgacctgcgtagacagccccagcgcctgagccgcctccggcgttaaggttccggcgcgagcggcgggcggcaggatgcgcggcggaattttatccctcagggcttccagcccggcggcagccagcagcgtgtcgctgaaacgctgttcatgagccagatagttccatttgcaggtcagggtgcacaggctggcgacatcctcccctgtggccttccagaccataaaatccgccagatccagtaaacggtgtgcgcgttgccaggtttgcggatgatggttcttgagccaaagcgctttcggcagttccatttcaatactgacttcgccgcccgtatatttaagagcgcgatcgccagtggcattgatcaactgcgtttccctcgccgcgcggtgatccatccacataatgatgttgtgatcgtcagcttcgccaggcgatacggcaagcccgttgccgtttttatcgatagccaccagcgaacaggtggcatcaaaaccaatcgaaactatctgcccggcgtcaaggccagcactggcgacagcctctctaaccgcctcgcaactctgctgccagatctcagcggaggactgctctacccgcgcctcggcgggacgaaactgtgaaatagcgcgagtggcgaaagccagccgctggccgtttgcgtcaaataccccagcgcgcacgctggctgaacctatgtctatgccaaggaaaaaacaggtcgtcattttctgctccagaaagtcagggttacatccctgtggttaaaccgctcgtgaggatcctcacaaaacccggcgaaaaatgttgtgatgaaaatcagaaaaactctatgctaattcgagttagcaaaaggatttgacgccaggggcgttgagggcaatcacatatctgtaaggatgagatctcattatgaaaggtaaaaaggttcttccgaagattggcattcgtcctgtcattgacgggcggcggatgggcattcgcgaatcgctggaagcgcaaacgatgaatatggcgtatgccaccgcgaatctgttgcaggcaaaactgcgtcacgcctgcggcagtgaagtggagtgcataatcgctgatacctgcatcgccgggctgacagagtccgcggcctgtgaggagaaattctcggcgcagaacgtcgggctgactatcaccgtcacgccctgctggtgctatggcagtgaaaccattgatgttgatccgttgcgcccaaaagcgatctgggggtttaacggcacggagcgacccggcgctgtttatctggcgtcagcgttggcggcacataatcagcagggcattccggccttttcgatttacggccaggatgtacatgacagtgacgacaccgccatcccgccggatgtggaagaaaaattgctgcgttttgcacgtgcaggcctgacggtgaccagcatgaagggcaaaagctatttagctttaggcggcgtttcaatgggaattgcggggtcacttgtcgatcatgatttttttgcgtcctggctgggcatgagggtgcagtccgttgatatgaccgaactccgccgccgtatcgatcaacatatttatgatgaagatgaactggcccttgcgctggcatgggcgacggagaaattccgcttcggagaagaccgaaacgcgcagcacaatcagcgtaacgaagcacagcagcgggagatcctgcgggaaagtttactgatggctatctgtatccgcgacatgatgcagggcaatccggtgctggcccgagcaggcttttgtgaagaggccctgggctataacgctgtcgcagccgggtttcaggggcagcggcactggacggatcaatacccgaacggcgacatggcagaagcgctgctgaacagctcatttgactggaatggcatccgccagccctacgttgtggccacggagaacgacagtctgaatggcgtcgcgatgctgatggggcacctgatgacgggcacggcgcagatcttcgctgatgtgcgcacctattggtcgccggaagcggttgaacgagtaacgggcgagacgctcagcggcgtggcggagcaggggattattcatctcattaattccggttcggcggcgctcgatggcaccgcgcagcagacggacatcaaaggaaatcctaccctcaagccccattgggaaatcagcaccacggaggtagacgcctgtcttaatgccactcgctggtgtccggcggtacatgagtattttcgcggcggcggcttttcgtcacagtttgtcacccgcggcggggtgccttttaccatgacgcgcgtaaatatggtgaaagggatcgggccagtactgcaaattgctgaaggctggagtgttgagctaccggaagcgatccatgcggtactggaacaacgcacagacccgacctggcccaccacctggtttgcgccgcgtcttacgggccgtggcccgttccgtgatgtctggtcagtgatgtctggctggggcgcaaatcacgctgtactgacggcgggccatgtcggtgcggatttcattacgctggccgccatgttgcgtattccggtcagcatgcacaatattgaggaggagcaggtgtggcgaccgtctgcgtgggcggcgcacggaatggatccggaagggcaggattaccgcgcctgccgcaactacggaccgctgtacaggcgctaaggaaaagcaaaccggttagccccggtcaggtctggtcggggcttaacgtgccagcagcgcctgttcgatctcaaagcgattcgtcactttgctgtcgattttgatgtatacgctgcgctcatcctgcaccaccagcacctcgctcaccccgggcaacgcgcgtaactgctcgcccagcgtgtcatctgcgggaacatccgccggaatttccacgcgcagactgctgacgtaagccggttcgctcatggtcagggataccagcagccagagggtcgccagcagcgcgccagccagaaataccgtctgcgaatcaaacataccgtccacccaacccgccatcgagccgccaatagccacacccaggaactggctggtggaatagatacccatcgccgtgcctttatagcccgccggggcttctttactgatcaacgatggcaacagcgcttccatcaggttaaaggcgaggaagaagatctgcacgcccagcacctgctcccagaaatgcggcccggcgccccataacacgatttcggcaatcagcagcagcgcaacgcagaagacaaacacccgcttcatgcggcgttttacttccgcatagatgataaagggcaccacgcagacaaaagaaatcagcatggtcgccagatagattttccagtgatccgcggtggcaaagcccgcggcttccagctggccgggcagggcgacgaaggtggacatcagcaaaatgtgcaggcacatgatgccgaaattgagttttaacagcttcgggctggcgataactttgctgaagcagcctttgaccatgcctgattcacggttcagcacatggtttttgctgtccggcaccacccatagcgtcagggcgataccggcggttgccagcgcggcgatcatccagaacagcgcatgcaggccgagcttatgggtgatgatggggccgagcaccatggcgatggcaaaggtcaccccaaaactgacgccaataaacgccatcgctttggtgcggttctgttcgcgggttaaatcggagagcagcgccatcacggcggcggcaatcgcgcctgagccttgcagcgcacggccaagaataatgccccagatcgagtccgacagggccgccaccacgctgccaataacaaaaatagccagcccgccgacgatcagcggtttgcgtccgatacgatcggacaataatccaaaggggatctgaaaaatggcctgcgccagcccataaataccaatggcgaaaccaatcagcgcttcgcttgcgccctgcaaagccataccgtaagtggtgagaacgggcaggaccataaacatgccgagcatacgcaacgagaacacagtccctaaaccccaggtggcgcgtaactcgcctggcgtcattttataatcgttcatttccacctcaaattctaaaaccgggcatagtgtagtgcgggggcagggcagggtaaagcggggtattttacaaataaaaaagggtgccgtagcacccttttaggtattaatgcgttaccagacgtaagtaagcaggctgtgagaatccgggaccataaagtcgacggacatcatcaccgacagcgaggtaatggcgacgatagaaaagacgaacagcttacgcgcccagactttatcatcttccactttataaccacgcagcgccattccgagccaccagacgctcaccgccgcagccaccaccagatatttataaccggcatagccacccagagtgagcatcagcgtcgccacagcgaaggcgatgatatacagcgtgatatggtttttggcaaccgagatgcctttcactaccggcagtaccgggatgttcgccgcctgataatccttaaagcggaaaatcgcgatggcgtaggagtggggcatctgccacaggctgaaaatcgccagcaggatcagcgcgccactgtcaaaatcaccggttaccgcgcagtagccaatcaccggcggcgcagcgccggagagagagccaatcagggtgccataaacggagtggcgtttcatgtacaggctgtaaacgccgacataaaccacaaaccccatcacgcccagccagcaggccagcgggttagcaccaaaccacagcagcataaagccagcaatacccaacaaggtggcatacaccagcgacattttcggcgaaatcaggcccttgaccagtacccggttcttcgtgcgctccattttgcggtcaatatcgcggtcgatgtagttgttaaatacacaaccggatgcgactaccagtgacacgccaatcagcgtagcagcgaaaaggggatagtcgatgctgcccttggaggccagcaggaaccccccgatcacggagatcaggttaccgaaaatgatgcctggtttcgttacttgcaggtattgcttaatcatactcgccgctcttagtgaaccatcatgttgttgttcaggctccacataatccagatggatcctgcaaccactatggcgataatcagcacggtaaagacaaaggccaccaggttccagcgatcctcagaagaggtattcatatgcaggaagcacaccaggtgaaccagaatctgtaccactgccatccccacgacgacgctaaccagcgtggcatgagaagcagtgccgttcattaccatccagaacgggatcaccgtcaggatgatcgacaggataaaacctgtcatgtacgtttttacggtaccgtgagaagcgccgctatgatcggttggatgactcattacattgcccccatcagataaacaacagagaacacacagatccacaccacgtccaggaagtgccagaacatgctcaggcacatcagacgggtacggttagtgctggtcagtccgcgacgggaaacctggaacatcatcagcgccatccacaccagaccagaggtcacgtgcacgccgtgggtacctaccagggcgaagaacccggacaggaagccgctgcgatccgggccgaagccttcggcgatcagatgatggaattcatagatttccatcccaacgaagcccgcaccaaacaggaaggtcagcgccagccaggacagaacctggcttttgttccctttatccatggcgataaccgccatgccgtaggtgatggagctaaacagcaggaggaaagtttccaccagcacgaacggcagttcaaaaatatctttaccgctcgggccgcccgctgtgccgttcaccagaacggcataggttgcgaacagacatgcaaagagaatgcagtcgctcatcaggtagatccagaagccaaagactttattggctcctgcatcgtgatgcccatggtcatgcgcatgagcgccagaatgtgccagagaatcagttgacatttttcagccctgctttgctaatttcatcaaagtgctggttttccagtttctcaacggtcgcgaccgggacgtagtaatccacgtcttcatcgaagctcttcacaatccaggtaatgatgatacctgcgaagcctacgatggccagccaccagatatgccagatcatggcgaaaccgaaaatggtgctgaacgcgccgataaccacacctgcaccgctgtttttcggcatatgaatttcttcataatgcgtcggctgctggtacgcttcgcctttctctttcatttcccagaacgcatcacgctcgtggatatgcggaactacggcaaagttgtagaacggcggcggggaagaggttgcccactccagcgtacggccaccccacggatcgcccgtcaggtcgcggttctggttgcgatcgcgaacagaggtataaatctgcatcacgatgctgaagataccgcaggcaatcaacagcgcgccgatttcagccacaatcatcagcggttcgaacatcggatcgatgtcctggctaacgcgacgggtcatacccatgaagcccatagcgtacagcggcataaaggttacgaagaagccgatgatccagaaccagaatgcacgtttgccccaggcttcgttcatggtgtaaccgaaggctttcggccaccagtaggtcatacctgcgaagcaaccgaacaccacgccaccgatgataacgttatggaagtgcgccaccaggaacaggctgttgtgcagtacgaagtctgcgcccggcacggccagcagcacgcccgtcatcccaccgatagagaaggtgacgatgaagccgatagtccacagcatggaagagtggaactggatacggccctggtacatggtaaacagccagttgaagatcttcaccccggtcgggatggcgataatcatcgtggtgataccgaagaaggcgttaacgttcgcaccgctgcccatggtaaagaagtggtgcagccagacgatgaacgacagtacggtaatagcgatagttgcccataccagcgaggtataaccaaacagacgctttctggagaacgttgccgtcacttcagagaacacaccgaacactggcagaacaagaatgtacacttccggatggccccaggcccaaatcaggttcacgtacatcatcatgttgccacccatatcattcgtgaagaaatgggtgcccaggtagcggtccagggtcagcagggctatcgtcaccgtcaggatcgggaaggagacgataatcagtacgttagtacacagcgacgcccaggtgaacacaggcattttgaacatcgtcatgcccggcgcacgcatacgcaggatggttacaaagaagttaataccggtcagcgtagtaccaataccggagagctggagactccagatccagtagtcgaccccgactcccggactgtactcaatgcccgacagtggcggataagcgacccaacccgtctgcgcgaactcgcccacacccagagaaacgttcaccaggattacgccgacaacggtgaaccagaagctcaggttgttcaggaacgggtaagcaacatcgcgtgcgccgatttgcagcggcaccacaatgttcatcagaccgataacgaacggcatcgccacgaagaagatcatgataacgccgtgggcggtaaagatctgatcgtagtgatgcggtggcaagaagccctgttcgcccgcggacaccagcaactgctgggtacgcatcatgatggcgtcggcaaagccacgcaccagcataacgatagcgacgaggatatacataatccccaggcgtttatggtcaacggaggttaaccattcgttccataagtaagaccacttaccgaagtaagtgagtgcggcaaccagcgccagaccaccgacgaggattgctgcaaccgtaaccatgataatgggttcatggtacggaactgcatccagtgttaattttccgaacatcgtattattcctcagccccttaatgagaggtttgggcgtgactcatgtccatgccttccataccttcatgagaactgtgttccccttccggctgcgtcacgtccatgcttttcccgtgagacataaatttgccaataacatctttaaacaaattcggtttcacgctggagaagtattcaaccttgttatattcgctcggagccgcaactttctcgtacgtcgccatatcgttcatgactttcggagactgtttcgctttggcaacccaggcgtcaaaggtggcgttatccggcgtagcaatagctttgaacttcatgccggagaaacctgcgccactatagttggaggaaataccatcataggtgccggcttcgttggcaatcaggtgcagcttggtctgcatcccggccatcgcataaatctggctacccagacgcggaataaagaaggagttcatcaccgagttagaggtgattttgaattccactggcgtgttcgccgggaaggcgatttcattcaccgtagcgataccctgctccggatagatgaagaaccatttccagtccatagcgataacttcgatggtcaccggcttagcatcgtgatcaagcggtctgcctggttctaatgcatgcgtggttttccatgtcagtacagcaaggaaaataatgattaagatggggatggtccagacaacagcttcaactttgttcgagtgcgaccagttggggctgtatttggcatccttattcgacgcccgatacttccaggcaaagccgatagccatcacgatagcggggatcacgacaatcaacatcagcccaagagctgtcagtatcaaggaacgttgttccagtccgatctgtcctttggggtccagcagtgctgaatcacaaccactgagtaaaacagtgcctgcaattaacgaaagcagtcccaaacttttattgtatttcctgagtctcatttaacgacctcaattccacggggatcaggtggcgtttaaagtgtgcgggcattttacgggaaggttacattactgtaaacatgaatggcgcggtgtcagcgaggtgtaaccgggttctgccgcgcgcgtcacatagaatgcaacaatctgtaaaaattcgcgatcgcctaagttacacctatgttagaacaaaactccgtcctccagttaattgatcaggttaattggtataaccaatcaattttaagtacaaattattaacattgaatcagcatttatagaacattacttgaaagaaataattcataacggtgctgaatcgtttaagaatagtcattattttaaaccgcacaaaataattaaagaaatttaagtttgcacgaatgaataatgccgactaacagcgattttatcgttcgatatttaatcaaaataataactcaggggaattaaacctgaggttaaccggttcagatcagacgagttttgcgcagggcgaggtagtcaagaacgcccccatagaggatacctgccgttgccagcagcgccccccattccagcagttgcaggccgaatgtccaggcggtaaggccggaagcgttaagaagcaaaatgaccagccaggccgcgatcagggcacagccgaccgccaggatccgcaacgccagccggtaggccgtggcatattcagtacgtggaaggaagctgtccgtttgctgggtaaacgcaagcgtctgcttacagaccagcagcaggagcaggccgggaagggcggcaaagaccgagaacagataaaaggttgaccagccatgcgcctcgacaaaccagccggcgaggggaccgacgtatacccgacccacggcagacagggcagagagcagggcaaactgcgtggcggaaaaggatttattgcacagtgtcatcaacagcgcaacaaaggcggcggtgcccatgccgccgcacaggttctcaaagaacaccgccgctgccatgctgtagatatgtttgtcggtgatggagagccaccagtaaccggcattagatatgccctgcaacacgccaaagatcagcagcgcgcggaacagcgtcaggcgctgcatcagtacgccgccgtacagcgcgcccacaatggtggcaatcaagcccagcgtcttattcaccaccccaacctcaccggcttcaaaaccaacgccgcggatcagaaaagtggtggtcaggctcatggcgaaggcatcgcccagcttataaaggacgatcagcagtaaaatcagccaggcgttgttacggccaaagaaatcacgcagcggcgcgacgaccgcctgttcaagggatttcggcaccggaataacgtccgtgggttccggggccagcagggtggcaatgatgcagggaataagcagcgccgccatcagccagtacataccctgccagccaagccatttatccgccagccacagcgccagtccgccggagaccagcatcccgaggcgataacccagcacgctgatggccgcacccgcgccgcgttcctctgcaggtaatacatccgttttccaggcatcgaacacaatgtcctgggaggcggaacaaaacgcgatcaccaccgccagcgccgccatccagcgcaactggctgaccggctccagaaagcccatcgcagcaatcgccaccagcagcaaaatctgtgtggtcagcagccagccgcgccgccgtcctaaaaatggcggcgtatagcgatccattaccggcgaccacaggaacttaaagacgtaggcctggccgaccagcgagaagaaaccaatggttttcagatcaatattctcgacggtcatccacgcctgcagggtgcccgaggtcagggcaagcggtaaaccggaggcgaagcctaagatcagcaggatcgctgattttggttgctgaaaaatgcgcagatagtggctggacataagagggacgctgacccgactgctgccgggtcagcgggcagaattaacgcgcgttctgtttaatgaattcgtggatgctcacgtcctgagacatgtccgcgatggtatcggtcagcacgctgttaaccgcgttagcaatgttctcgttcttggcggtgaacgcaccttcaacggagtagctggcgcgatagtttttggtcatcttgttgccattagccgcggtggcgataatcgcgatgtcggctttggtggcgatgttgtagcgcacgttaccctgcgacacatcggcatacagctgattgacaataatctgcaggttcaccgcaccgttcgggccaaccatgtaaccgcgggcggtcatctgtttttcgagtacttcctgcaacaggaaacgcagatcgcgtgtagcggtcagagtgactaactggttgtcacgggtgactttagccagtgcctgatcctgacgctgatcggcgccgttaatgctcacggtcacgcccatcaggctcgggtcctgctgcggcagcgtaattttcggtgaaacgtcaatggtgtttggcggtgtagcgcagcctgcgagcataaacagggcgaccagcgggaaaagcagtttttttaacatgtcgggggctctcggaagatcggatgcttataagagaataattgtcgccatcataacattgccaacggccggggcaaccagggaacgcatgtaaattcatcgtcttgtctgttttctgaccaccgaagacttttctgcccgcctgaggggggccggagcataactttgtctgttgagttaatgcctttgaatgagaaaaggtcacaaaagctaaataattgtttttttggtgtaatgaaagtggtaaaagcggctaacatttaaagggatgggtgatctctggacgctgtcagaggagtaaaatcatgatgatgcgtgaccaaatcgaatcaaaattaagggccgcgtttgaacccgcgtttctcgaagtggcggatgaaagctatcgtcacaatgtgccggctggttcagaaagccattttaaagtcgtcctggtgagcgaccgtttcaccggtgagcgtttcctgacgcgtcatcgtatgatttacagtacgttaacggatgaactggcaggatcggtacacgccttagcgctacatacctataccattaaagagtgggaaggattacaggatacggttctggcctcgccgccatgtcggggcgccggaaccatcgcctgataaatggaatttgcaactgctggaacttttccagtatgttgcgtacagaatatgtgaaaacggcctgcgggccgttttgttttgcctgagttttgtccggtttgtgccaaattcagacaaaaattagccgggaattgtgaaaaatgccgatccggcacgcaataaccgttctcgactcataaaagtgatgccgctataatgctgcgtcttatttttcggaatgtcttcgggatgattctggtgacagggaatgtatatctgattcaagagaacatcccggtactgtgaagccaaacttacacgcgcttccagagttgaccgagcactgtgattttttgaggtaacaagatgcaagtttcagttgagaccactcagggccttgggcgccgtgtaacgattactatcgctgctgacagcatcgagaccgctgtgaagagcgagctggttaacgtagcgaagaaagttcgcatcgacggcttccgtaagggcaaagtaccgatgtccgttgttgctcagcgttatggcgcatctgtacgccaggacgtgctgggcgaactgatgagccgtaactttgttgatgcgatcattcaggaaaaaatcaatccggccggcgcgcctaactatgtgccgggcgaatacaaactcggtgaagacttcacttactctgttgagttcgaagtgtatccggaagtgaagctgtccggtctggacaccatcgaagttgagaagccggttgtagaagtgaccgaagctgacgtagatggcatgctggacaccctgcgtaagcagcaggcgacctggaaagaaaaagacggcgctgtagaagctgaagaccgcgtgaccgttgatttcaccggttccgtagacggtgaagagttcgaaggcggcaaagccactgatttcgtactggccatgggccagggtcgtatgatcccgggcttcgaagacggtatcaaaggccacaaagcgggtgaagagttcactatcgacgtgactttcccggaagaataccacgctgaaaacctgaaaggtaaagccgctaaattcgtcatcaacctgaaaaaggttgaagagcgcgaaatgccggaactgaccgaagaattcatcaagcgtttcggcgtagaagatggttctatcgaaggtctgcgtgctgaagtgcgtaaaaacatggatcgcgagctgaaaggcgcggtgcgtaaccgtgtgaaaactcaggctatcgacggtctggttaaagcgaacgaaatcgacgtgccggctgcgctgatcgacggcgaaatcgacgtactgcgtcgtcaggctgcacagcgtttcggcggcaacgagaaacaagcgctggagctgccgcgtgaactgttcgaagaacaggctaagcgtcgcgtagtggttggcctgctgctgggtgaagttatccgtacccatgagctgaaagctgacgaagcgcgcgttaacacgctgattgaagaaatggcgtctgcctacgaagatccgaaagaagtgattgagttctacagcaaaaacaaagagctgatggacaacatgcgtaacgttgcgctggaagagcaggctgttgaagccgttctggaaaaagcgaaagtgactgagaaagccacttccttcaacgagctgatgaaccagcaggcgtaagtttcgccattacgtacataacgtaaccagaagcccgtcactttgctgtggcgggcttttttttatcatccagactttttaggatgagtgctaaaagcgcgtttcagtgttagcgttaagccaaaagcttgttatgcttgaaataaggcgtagccatccccattacagggagactgtcagaagtgttcttgctgaatatccgtccagggtggtcgtagtcagaccagtcatactcaagtagaatcggtccagcaggtttatttattttttatccaggagacggacatgtcatacagcggcgaacgagataactttgcaccccatatggcgctggtgccaatggtcattgaacagacctcgcgcggtgagcgttcttttgatatctattcccgtcttcttaaggaacgcgtcattttcatgaccggccaggtcgaagaccacatggctaacctgattgtggcgcagatgctgtttctggaagcggaaaacccggaaaaagacatttacctgtatattaactctccgggtggtgtgatcactgccgggatgtcgatttatgacaccatgcaatttattaagccggacgtcagcaccatttgtatgggacaggcggcctctatgggcgcattcctgctgactgcgggcgctaaaggcaagcgtttctgcctgccgaattctcgcgtcatgattcaccagccgttgggcggctatcagggccaggccacggacattgaaattcacgcgcgtgaaatcctgaaagttaaagggcgcatgaatgaacttatggcgcaccatacgggtcaatctttagaacaaatcgaacgtgataccgaacgtgaccgcttcctctccgctccagaggcagttgagtacggtctggtcgactcgattttgacccatcgtaattaatgctcaggccagacgtgtaccgctataatcagtaagagcggcactacgccaggcagcattttgcgcctggattggcatttgcgtcgtcgtgtgcggcacaaagaacagataagaggtttttactcatgacagataaacgcaaagatggttcgggcaaactgttgtattgctctttttgcggcaaaagccagcatgaagtgcgtaagctgattgccgggccgtccgtgtatatctgcgacgaatgtgttgatctgtgtaatgacatcattcgcgaagagatcaaagaagttgcgccgcatcgcgagcgtagcgcgctgccgacgccgcacgaaatccgtcatcatctggacgattatgttattggtcaggaacaggccaaaaaagtgctggcggtggcggtttacaaccactacaaacgtctgcgtaacggtgataccagcaacggtgttgagctcggcaaaagtaacattctgctgatcggcccgaccggttccggtaaaaccctgctggcggaaacgctggcgcgcctgctggatgtgcccttcaccatggcggacgccaccaccctgaccgaagccggttacgtgggtgaagatgtggaaaacatcatccagaagctgctgcaaaaatgcgattacgacgtgcagaaagcccagcgcggtatcgtctatatcgatgagatcgacaagatctcccgtaagtctgataacccgtccatcacccgtgacgtctccggtgaaggcgtgcagcaggcgctgttgaaactgattgaaggcactgttgccgccgttccgccgcagggtggacgcaagcatccgcagcaggaattcctgcaggttgatacctccaagatcctctttatctgtggcggcgcatttgcgggtctcgataaagtgatctcccatcgtgtagaaaccggctccggcattggttttggcgcgacggtgaaaggaaaatcagagaaaccgcaggaaggtgagctgctggcgcaggttgaaccggaagatttgatcaaatttggtctgatcccggaattcatcggtcgtctgccggtggtcgctacgctgaacgaactgagcgaagaagcgctgatccagatcctgaaagagccgaaaaacgccctgaccaagcagtatcaggcgctgtttaatctggaaggcgtggatcttgagttccgcgacgaagcgctggatgccatcgccaagaaagccatggcgcgcaaaaccggtgcccgtggcctgcgctccatcgtagaagccgctctgctcgacaccatgtacgatttaccgtccatggaagatgtcgaaaaagtggtcatcgacgagtccgttattgcgggtcaatccaaacccatgctgatgtatggcaaaccggaagcgcagcaagcttctggtgaataaatcgccaaaacatacagtcagttaataaaaaaggggggattttatctccccttttatttttcctgttccctgacgttgaatgtccgggaaacatccccatatactgacatacatgttaatggttgcgtgaagcacagtcatgccacctgattaccctggcggacactaaactaagagagagctctatgaatcctgagcgttctgaacgcattgaaatccccgtattgccgctgcgcgatgtggtggtttatccgcacatggtcatacccttatttgtagggcgggaaaaatctatccgttgccttgaagccgccatggatcatgataaaaaaatcatgctggtcgcgcagaaagaagcctcaacggatgaaccgggtgtaaatgatcttttcaccgtcgggaccgtggcctcaattttacagatgctgaaactgccggacggcaccgttaaagtgctggtcgaaggtttgcagcgcgcacgcatttcagcgctgtctgacgacggtgaacacttctccgcgaaagccgagtaccttgaatcgccggccattgacgagcgcgagcaggaagtgctggtacgcacggccatcagccagttcgaaggctatatcaagctcaacaaaaaaatcccgccggaagtgctgacgtcgctgaacagtatcgacgatcctgcgcgtctggctgacaccatcgccgcgcacatgccgctgaagctggcggacaaacagtccgtgttagaaatgtccgacgtgaacgagcgtctggaatatctgatggcgatgatggaatcggaaatcgatctgttgcaggttgagaagcgcattcgcaaccgcgtcaaaaaacagatggagaaatctcagcgcgagtactatctgaacgagcaaatgaaagccattcagaaagagctcggcgaaatggacgacgcgccggacgaaaacgaggcgctgaagcggaagatcgacgcggcgaaaatgccgaaagaggcaaaagagaaagccgaagcagaactgcaaaagctgaaaatgatgtctccgatgtcggcggaagcgacggtggtgcgtggttacatcgaatggatgatccaggtaccgtggaacgcgcgcagcaaagtgaagaaagatctgcgtcaggcgcaggaaatcctcgacagagaccactatggtcttgagcgcgtcaaagaccgcatccttgaatacctcgcggtgcagagccgtgtaaacaaactgaaagggccgatcctgtgcctggtagggccgccgggggtgggtaaaacctcgcttggtcagtccatcgcccaggccaccgggcgtaagtacgtgcgtatggcgctgggcggcgtgcgtgacgaagcggaaatccgcggacatcgccgtacctatatcggctccatgccgggcaaactgatccagaaaatggcgaaagtgggcgtcaaaaacccgctgttcctgctcgatgagatcgacaagatgtcgtctgacatgcgtggcgatccggcatcggccctgcttgaagtgctggatccggaacagaacgtcgccttcagcgatcactatctggaagtcgattacgatcttagcgacgtgatgtttgtcgccacctcgaactcgatgaacattccggctccgctgttggatcgtatggaagtgatccgtctttccggttacaccgaagacgaaaagctgaacattgcgaagcgtcacctgttgccgaagcagattgagcgtaacgccctgaaagatggcgaaattacggttgatgacagcgccatcatcggcattatccgttattacacccgtgaagcgggcgtgcgtagcctggagcgtgaaatctccaaactgtgccgtaaagcggtgaaacagctgctgctggataagtcgctgaagcacattcacatcaccggcgacaacctgcatgaattcctcggcgttcagcgtttcgactatggtcgtgccgatgatgaaaaccgcgtaggtcaggtaaccgggctggcgtggacggaagtgggcggcgatttgctgactatcgaaaccgcctgcgtaccgggcaaaggcaagctgacctataccggctcgctgggcgaagttatgcaggaatccattcaggccgcgctgaccgtggtgcgcgctcgtgcagaaaaactgggtatcaaccctgatttctacgagaaacgcgacatccacgttcacgtaccggaaggggcgaccccgaaagacggcccgagcgccggtatcgcaatgtgtaccgcgctggtttcctgtctgaccggcaacccggtgcgcgctgatgtggcgatgactggtgaaatcaccctgcgcgggctggtactacctatcggcggtctgaaagagaaactgctggcggcgcaccgtggcggcatcaaaaccgtgctgatcccggacgaaaacaaacgcgatctggaagatattccggataacgtgattgccgatctgaagatccacccggtgaagcgcattgaggaagttctgactcttgccctgcaaaatgagccgtctggcatgcaggttgtaagcgcaaaatagtgacctcgcgcaaagagcactaagaaaaacaaggctggcagcgcatttcgggcttgccagcctttttttgtatagctaatttagattgctgcctggatgtgtcatcatcaactgatgttgtaagggcatgacaggcctgatataactgctgcgcggtcgctctgtgaaggattcagtgcgatataaattataaagagaggaagagaagagtgaataaatctcaactgatagacaaaattgctgcaggggctgatatctctaaagctgcggctggacgtgcgttagatgctttaattgcttctgttactgaatctctgcaggcaggggacgaagtggcactggtaggttttggtacttttgctgttaaagagcgtgctgcccgtactggtcgcaacccgcaaacaggcaaagagatcaccatcgccgcggctaaagttccgggtttccgcgcaggtaaagcgctgaaagacgcggtaaactgagcgcgatctccaaagggattgtgaaaaagtacaagggcgcatcaaccgatgtgccttttttatttgtgattgcccaattaatcggccccggtgggctgacatttacccccgtttcttgtcacaatacgggtttgcgcgcggcggcaggataagcagtgttgcgtgggacctcaagtcatctacagcggagtgttgctacaccatgatggacaatttacgcacggcggctaatagcgttgtgatcaaaatcattttcgggatcattatcgtgtcgttcattctgaccggcgtgagtggttatctgattggcggcggtgatagctatgccgcaaaagtgaatgaccaggaaattagtcgcggacaattcgaaaatgctgttgcaggcgagcgtaaccgtatgcagcagcagttgggtgaacagttctctgaactggccgctaatgaaaattacatgaaaaccatgcgtcagcaggtgctggatcgtcttatcgacgaagcgctgctggatcagtatgcccgccatcttggcctcggcatcagcgatgagcaggtgaagaaagccattttcgcgaccaaagctttccagaataacggcacctttgacaatacccgctataacgcgctgattaaccagatgggcatgaacgccgatcagtatgcgcaggcgttgcgtaaccagatggtgtctcagcagctgattaatgccattgccggtaccgatttcatgctgaagggtgaaaccgacgagctggctaccctggtggcgcagcagcgtatcgtgcgcgaagcgatccttgatgtgaatgcgctggccgcgaagcagacggtgaccgatcaggaaatcaccagctattacgagcagaacaaaaacagctttatggcgccggaacagttccgcgtcagctatatcaagctggatgctgcaaacatgcagcagaatgcgagcgatgccgatattcaggcgtactacgaccagcatcaggatgaattcacccagccgcagcgtaaccgctatagcgtgatccagaccaaaaccgaagacgaggcgaaagctgttctcgacgccctgagcaaaggcgcagacttcgcccagctggcaaaagagaaatcctccgacatcatctctgcccgtaacggcggcgatatgggatggctggaaccagccaccacgccggatgagcttaaaaatgccggtctgaaagaaaaaggccagctgtctggcgtgatcaaatccagcgtaggtttcctggtggtgcgtctggatgatattcagcctgccaaagttaaaccgctggcggaggtgcgtgacgatctggccgcgaaagtgaagcaggaaaaaggccttgatgccttctacgcgctgcaacagaaagtgagcgaagcggcgagcaacgacaacgtctccctgaccggcgctgaacaggccgcaggcgtgaaagccgtggaaaccggctggtttggtcgtaacaacctgccggaagagctgaacttcaaaccggttgccgatgccatcttcaatggtggtctggtaggggaaaacggcacgccgggcagcaactctgacatcattaccgtcgacggcgatcgtgccttcgttatccgtgtcagcgagcataagccggaagccgtgaagccgctggatgaagttaaaacgcaggtgacggatatcgtcaagcacaacaaagcgcagcagcaggccaaactggatgctgacaagctgctggccgccctcaaagccggtaaaggtgatgaggcgctgaaagccgcaggtctgagcttcggtgaagcgaaaaccctgacccgcaccgggcaggatccgctgagccaggctgcctttgcgctgccgttgccagccaaagataagccgtcttacggcgttgccagcgatatgcagggcaacgtggtactgctggcgctggatgaagtgaaagcgggcaccatgccggaagagcagaaaaaagcgatggtgcagggtatcacccagaacaatgcgcaaatcgccttcgaagcgctgatgagcaacctgcgcaaggaagccaaaatcaaaaagggcgacatcgttgatcctcagcaataacgaggcgcttcgcatctttttgtaacccactgcaatattcaaaggccgcttacgcggccttttccatttctgaagcttgctgtttgcacccgtttagccgcctgtttatcgtgaggtggctgtcaacaaacaaggagataacagcatgaaacgtggaatcaatgccctcatttttactctcggcctcgcctgtgcaggcatgacacagagcacgcttgcggcgactgcaagcgctaaaccggcggcgacgcaaacgaaagcagacgccaggccggacgcgcaaaaccttacccaggcaaaggagacggcaaaagccggcgatgaggaaagtaccagggtcagcattaacgccgcttctgccgacgatctggcccgtgtcctcaacggggtagggctgaaaaaagcccaggcgatcgtcagctatcgggaggaatacgggccgtttaaaacggtggaagatcttaaacaggtgccgggaatgggcaatgcgctggtggaacgtaaccttgaacgtttaaccctgtagtttttggggttgcggagtcgctaaattttgccaggataaagaggtcataccagtgatgacctctgttcctggaaaaaaataaaaggttaaggcgctatgcagactcaaatcaaagttcgtggatttcatatcgacgtctaccagcatgtgaacaatgcccgctatctggagtttctggaagaagcccgttgggagggcctggaaaacaccgacagctttcagtggatgtccgcccgcaacatcgcttttgtggtggtgaacatcaatatcaattaccgccgaccggccgtgctgggcgatctgttgaccatcagcagccacctccagcaactgaacggcaaaagcggcgtgctaagtcagacggtgacgctggagccgggaggggacgtcgtcgccgacgcgcaaatcacttttgtttgtatcgacctgaaaacccagaaggcgctggcgctggaaggagagttgcgggacaaattacaggcgttgatggagtaaggccgggcttgatgccgggtggcgctgtcgcttacccggcctacgtgggcaatgccgttgtaggcccggcaagcctgcgccgccgggcaacaggtacgaacgcaggccttacgccaggcccgtctttttcttcatcgccgccatcacgcccgctttatccgccaggtagtgattcagaccgttagcgcgcaggttacaggcggcgcactggccgcaaccgtcgcccttaatgccgttgtagcaggtcagcgtctcgttgcggatcaaatccagtttgccccagcgatccgccagcgcccaggtttccgctttgtcgagccacatcagcggcgtctcgaagcgaatatcctttgccatgccaagattaacggcatgattgagcgctttcacgaactcatcacggcagtccgggtagccggaaaaatccgtctcgcacacgccggtaatgaccgcttccgcctgtacctgatacgcatagatcgcggtcagggttaagaacagaatattgcgccccggcacaaaggtattcgggataccgctggcgtctggctcatagtccggcaccgggatgctgtcgcgggtcaggctgctgaccgccagttcattaagcagggtaacatccagcactttatgcgcacgcgcccccagtttcagcgccagttcacgggcaacgtcgatttcggcgcgatgacgctgaccataatcgaaggtgacacagtggacttcatcatactgctgtaacgcctgcaccagacaggtagtggagtcctgacctccgctaaagacgacgacggcacgtttcataattcttcccgattgcatgtaaaacactatggtagcgtctgcggcagtgcgcgaccagcttcttcacgcgccggggcgggtagccaggcctcggtaaaatcaaaccagccgcgggtgttcaggcggatcccctgcacgccaggcggggcgctgatctgatactgatagttaaacagcggcgtcagcaccgcctcgtccattaatccgctgaatacatcctgcaaatccgcgcagcgcgcctgttcattcggctgacgctgcaccgcatccagcgtggcctggagatgggcaaagcgagaggcgggtaacagattgggccacagcggatcgcagcgtaaccattgctccagagtatattccggcgcttcgccgatcagcctgtcgcccatcatcaggtcagcagttgcaagcccgctacagttatcccagttcttcgcatcatgaaaaattaccgtcagttcacagcccagcccggcaagatagcgcttaagctcctccgccatggtgtgcagttccaccggcaggtgatacagcagcgtcagtttttccggcagcgccaccttttcctccgcccagtgcggcatcgcccagccgggcagtaattcccggctgggggtgatcaggttttcatccagcggcagggtctgtagcaggccgctctgatggacgatctgcaccagtcgccgcgcctgtgcctggctcagtctttcactgatacgccgggcgagataacaaaacccgaggctgatgccgctgctgacctgccgcaggtggatcagttcatccggcttgccgatggtgatctgcaccggatggcgacaactactgcccagatcctgctcgaacagttgcggggtgatccagtattccaccgcctttagcagcggatggctgaggtgataatgctcatggctttccaggcgcaccagttccgggctgaaggaggccagccggaaaggaccggtgcccaccagcggatgctgcggatgggccagacggctgccgtagcttgccagacggtgcgccagccagtgatccggctgatgcagcgtgaacagcagacagtgcgggtgcggcaccgcgatctccgccacgctgttaaacagcctgcgcagatcgggcagcgtcagcagatgctgcaaacgcatctgcaattgttgggcgttcaccgcatcgccattatgccagtgcagggtggtgcgcagatgaaaacgccagctcaggccatcggccgacacctcccagtggtgcgccaggtcgctctgcggcaaagggttatcggtaataaagcgcgtcaggccggaaaagatctgcccggccagatgctgctcggcgcgccccggcagaaagcccggatgcagcggctccagagggcgataatagggaatgcgcagagtaggtgagtcgttttgccacaggccgcccagaaaaggatgcagcagattgcgcagcgcctccggcggcagttgcgccagcgccagcgcgctgtgctgctgtccctcattcagggcctgctccagcagcgcattgcgcagcgatcctggcgtgacgtgaaaatgcagcacgccacgttttccacgccccgactgcgcctgccagctcagccagccggacgcctccatttgacgtaacagggtacgcatatggcggtcgctgcaaaaacagcgctctgccagccccgccacgctggcgtgctgcggttcgccatcggaaaactgccacaggcgctgatactgattaagtcgatttaactggcgcataaacccggaacaaatatcctgaagtattcactattacttccgtatatctcaggcaatactggtacacaagtttccgcatcacaaaaccgggataattatggcgcgactggctgcatttgatatggacggcaccttactgatgcctgaccaccgtttaggcgagcaaacgctggataccctgcgtcgtctgcgcgaccgggatattacgctggcgttcgctaccggccgtcatgcgctggaaatgcgtcatttgctggggatgattacgctggaggcgtatctgatcaccggtaacggcacgcgcattcactcgctggagggggagctgctgcaccgtcaggatctcagcccggacgtcgccgaacaggtgatccaccgtcagtgggatacccaggcgagtctgcacgtgtttaacgacagcggctggctgaccggagaagagatgcctctgctgctcgatttccatatttacagcggctttaaataccgggtggtggatctcaaagcgctcagcccgcacgaagtgaccaaaatctgtttctgcggcgatcatgaggatctggagcgtctgcgcattcagctgcacgaggcattaggcgatcgcgcgcatatctgtttctcggcctttgattgtcttgaggtgctgcctgtgggctgtaataaaggcgcggcgctggcgatcttaagcgatcggctggggatcgccatgcaggactgcatggcatttggcgacgcgatgaatgaccacgaaatgctcgccgccgtcggacgcggcatgattatgggcaacgccatgccgcaattgcgcgcggcgctgccccatttaccggtgatcggacactgtcagaatcaggcggtgtcgcactatttaacgcattggctgaccacaccacatcttccttattcccccgaataatgagcattgtcagcaagccgggtccgtttaaacccggctttttttacgccagtaaacgggcgatttccgctttccacggcgtcacatcgccgatattcgcctgcacccattccgcattgtaataggtgtcgagatagcgctcgccgctgtcgcacagcagggtgacgatagaaccggtctggcctgcgtcgcgcattctggccgccagcgtcagcgcgccccacatattggtgccggtggacgcacccactttgcggcctaactgcgtttccagccactgcgcggtggcgacgctggcggcatccggcacgcgcagcatctcatccaccacatccggcacaaacgacggctcgacgcgcgggcggccaataccttcgattttactgcccaccgggctgcgcaaagtgctatcgcgggtttgccagtaatccataaacaccgagttttgcggatccaccaccatcagttgagtatcgtagccctggcagcgcaggtagcggccaatggtcgcggaggtgccgcccgtaccggcgctcatcacgatccacgttggctccgggtgcggttcgctctgcatctggcggaagatgctgtcggcgatattgttattgccgcgccagtcggtggcgcgttcggcataggtaaactgatccatataatggccgtgcagctcccgcgccagcatctcggaagcggcgtagatctcgcaggctctctccacgaagtgacaacgcccgccgtagaattcaatctgctcgattttgcgcttcgccgtacaggacggcattacggcgataaacggcaggcccagcagacgggcaaagtaggcttccgacaccgccgttgagccggaggatgactcaataatcggcgtgccttctttgatccagccgttgcacagaccgtataaaaacagggatcgcgccaggcgatgcttcaggctgccggtcgggtgggtgctttcatctttcaaatagagctgaatacccggaaaacccggcagcgccagacggataaggtgagtatccgccgagcgttgataatcggcattgatttcactgatagcatgtttaacccaggtgtttttcatggcgcggatccgtttgtcattttgtgcccagcttagcggaaagcacggaaaaaattgttgctttatgacctttgaaatagactttaaggagaaagaaattctcccggagggggcaatgctagataaaattgacagaaagctgctttcattactgcaaagcgactgcaccctctctttgcaggcgctcgcggatgccgttaatctgacaaccactccctgctggaaacggctgaaacggctggaagacgacggcgtgatcaaagaacgggtcgcgctgctggatgcggaaaagctcggcctcgggcttacggcctttgtgctgatcaaaacccagcatcacagccgcgactggtactgccgctttgtctctgaggtcaatgcgctgcccgaagtgttaggtttctggcgcatggccggcgaatacgactaccttttacgggtgcaggtcgccgacatgaagcgctatgatgatttctataaacggctggtgaacagcgtacctgggttgtccgatgtgacctccagtttcgccatggaacagataaagttcaccactgcgttacccattgaataactctcccggcccgaagcaccaccgccggaaaatcacgttcaggaaatgaccgcgtgcgattatttgctcaattaagctggtactttcgccgggaatggcgacgctatctcggtgctgtagccctgcttatctttattgccatcctgcagcttatcccgccgaaagtggtgggctatgtggtggatggcgtgacgcaacaacattacaccaccagccgggtgctgatgtggatcggcctgctggtgggggtggcgattgtcacctacctgctgcgctacgtctggcgcgtgctgcttttcggcgcctcctaccagctcgccgttgaactgcgtgaggatttttaccgccagctcagccgccagcatccggagttttacctgcgccatcgcaccggcgatttaatggcgcgcgccactaacgatgtcgatcgcgtggtgttcgccgccggggaaggggtgctgacgctggtggattcgctggtgatgggctgcgtggtgctggtggtgatgtcgacgcaaatcagctggcagctcaccctgctggcactgctgcccatgccgatcatggccattgtcatcaagcgctacggcgaccaactgcacgagcgctttaagctggcgcaggcggcgttctcctcgctcaacgaccgtacccaggagagcatgaccagcatccgcatgatcaaggcttttggcctggaagatcgccagtcggcgctgttcgccgccgatgccgccgacaccgggcgcaaaaatatgaaggtcgcccgcgtggatgcgcgttttgatccgacaatttatatcgccatcggcatggcgaatctgctggccattggcggcggcagctggatggtggtcaacggctcgttaaccctcgggcaactgaccagctttatcatgtatctgggactgatgatctggccgatgctggcgctggcgtggatgtttaacatcgtcgagcgcggcagcgccgcctatacccgcatccgcgatatgctggcggaggcgccggtggtcaatgacggcagcgaatccctgccggacggacgcggcgagctggcggtgaccattcgcgaattccgctatccgcaaaccgacagcgccacgctgaacggcgtcaatttcacgcttaatcccggacaaatgctcggcatctgcggcccgaccggcgccgggaaaagtaccctgctgtcgctgatccagcgccatttcgatgtcgatcagggtgagatcgcctatcacggtattccgctgccgcgcctgaagctcgacgcctggcgcagtcgtctggcggtggtgaaccagacgccgtttttattctccgataccgtggcgaataatatcgccctcggcaagcctggggccacgcagcaggagatcgagcacgcggcgcgtctggccagcgtccatgaagacattctgcgcctgccgcagggctatgaaaccgaagtgggcgagcgcggcgtgatgctatccggcggacagaaacagcgcatttctattgcccgcgcgctgttgctcaatgccgagatccttatcctcgacgatgcgctctccgccgtggacggtcgtaccgaacacgagatcctgcacaacctgcggcagtggggagaagggcgcacggtgatcatcagcgctcaccgcctgtcggcccttaccgaagccagtgaaattctggtgatgcagcacggacatgttgctcagcgcggtcatcacgaccagctgtcgcagcagcccggctggtatcgcgacatgtatcgctatcagcaactggaagcggcgctggatgacgcgccggaagaaaaagaggatcctgccaatgcgtagttttgggcaactgtggcctacgctcaaacggctgctagtgtatggcaaaccctggcgtaaacccctgacccgcgccgttgttatgctgtgggtggcggcgattgccgaagtctccggcccggcgctgatcagctattttatcgataacatggtcgccaaaagttacctgccgtgggggctgctggcgggcatggcggccgcctatatcggcctgcaactgctggcggcgggactgcactatgcgcagtcgctgctgtttaacgaggcggcggtgggcgtggtgcagcaactgcgtaccgacgtgatggacgcggcgctccgtcaaccgctgagcgccttcgatacccaaccggtggggcagttgatctcccgggtgaccaacgataccgaagtgatccgcgatctctacgtcactgtggtggcaaccgtgcttcgcagcgcggcgctgatcggcgcgatgctggtggcgatgttcaccctcgactggcgtatggcgctggtggcggtgaccattttcccggcggtgctggtggtgatggcgctgtatcagcgctacagcacgcctattgtccgtcgtctgcgcagctatctcgccgacatcaacgacggctttaacgaagtgatcaacggcatgggcgtcatccagcagttccgccagcaggcgcgctttggcgagcggatgggggaagccagccgctcgcactacacggcacgtatgcagacgctgcgcctcgacggctttttgctgcgcccactgctgagcctgttttcggcgctggtgctctgcggcctgttaatgctgtttggctttaccgccgtcggcaccattcaggtgggcgtgctctatgcctttatcagctatctggggcggcttaacgaaccgctgatcgaactcactacccagcagtcgatgctgcagcaggcggtggtggcgggggagcgcgtgtttgaactgatggatcgcccgcgccagacctacggcgatgacgatcgcccgctggaaagcggcgctgttgagatcgaaaacctgtcgtttgcctatcgtgatgaccggctggtattgcaggacattaatctgaccattccgtcacgcagttttgtggcgctggtggggcataccggcagcggaaaaagtacgctcgccagcctgatgatgggctactacccgcttacccggggggaaatccgcctcgacggacgtccgctctccaccatcggccataacgcgctgcgcaacggcgtggcgatggtgcagcaggatccggtggtaatggcagaatccttttttgaaaacgtgactctcgggcgcgacatcagcgaagagaaggtctggcaggcgctggaaactgtgcagctggcggagctggcgcgcagcatgagcgacggaattcatacccggttgggggagcagggcaataacctctccgtcgggcaaaaacagctgctggcgctggcgcgggtgctggttggcactcctcagatcctcatccttgatgaggcgacggccaatatcgattcgggcaccgagcaggcgatccagcaggcgctggcggcgatccgccagcagaccacgctggtggtgatcgctcaccggctgtcgaccattgtcgaggcggataccattctggtgctgcatcgcggtcaggcggtggagcgcggcacccatcaggcgttgttaaatgcgcaggggcgctactggcagatgtaccagctgcaactggccggggaagagctggccgccgccacgaaagaagaatcgcttatcgcctgatgcaccattatcaggcaggctactgacagccatcgctgttggtgcaaaaatgcaacgcaccctgcactggcatggtgcgtttttcttttccaggaacaatctgaatccccgtcacacttttcccttttgctttttcccctcgccacacggcgtaacggcctgaacttctcctcgtttttatttctggcacagcgattgcaataccagatccatgttagctgctgccattaccgaattccgcctggaggaactttatgaagctggttaccgtggtgattaaaccattcaaactcgaagacgtgcgtgaagcgctctcttcaattggtattcaggggctgaccgtgactgaagtgaaaggcttcgggcgtcaaaaaggtcacgccgaattgtaccgtggcgccgagtacagcgttaacttcctgccaaaagtgaagattgacgtggcgattgctgatgatcagctcgatgaagtgatcgacgtgatcagcaaagcggcctacaccggaaaaattggcgacggcaaaattttcgttgccgagctgcaacgcgtcattcgcattcgtaccggcgaagccgacgaagcggcgctgtaactcctgcacacagtgatagggatgggaaaaatgagcaaaaccacttttaaatccgtacttgccgcgctggctctgcttccgggactggcgctggccgccccggctgttgctgacaaagcggacaacgcctttatgatgatctgcaccgcgctggtgctgtttatgacaattcccggcatcgccctgttctacggcggtctgatccgcggcaagaacgtgctgtcgatgctgacgcaggtaacagtgaccttcgcgctggtatgcatcctgtgggtggtttatggctactcgctggccttcggcgaaggcaataacttcttcggcaactttaactgggcgatgctgaaaaacatcgagctgacggcggtgatgggcagcttctaccagtatattcacgttgcgttccagggctcgtttgcctgtattaccgtcgggcttatcgttggcgcgctggcggagcgtattcgtttctctgcggtgctgatcttcgtggtggtatggatgacgctctcctatgtgccgattgcgcacatggtctggggcggcggtctgctggcttcccacggcgcgctggactttgcgggcggtactgtggtgcacattaacgctgcggtcgccggtctggttggcgcttacctggtgggcaaacgtgtcggcttcggtaaagaagccttcaaaccgcacaacctgccgatggtgtttatcggtacggcgatcctctacgtgggctggtttggttttaacgccggttccgcaagcgccgcgaacgaaatcgccgcgctggccttcgttaacaccgtggtggcaacagcggcagcgattctgtcctgggtctttggtgagtgggcgctgcgcggtaaaccttcgctgctgggcgcctgttccggtgcgattgctggtctggttggcgtgactccggcgtgcggttatatcggcgtgggcggtgcgatgatcgtcggtctggcggcaggtctggcggggctgtggggtgtgactatgctgaaacgctggttacgtgtcgacgacccgtgcgatgtgttcggtgtgcatggcgtctgcggcatcgtgggctgcgtactgaccggcgtattcgcttcctcttctctgggcggcgtgggcttcgcagaaggcgtgaccatgggccatcaggtgctggtacagctggaaagtatcgccatcaccgtggtgtggtctgctgtagtggctttcatcggcttcaaagtggcggacatgacggttggcctgcgcgtaccggaagagcaggagcgtgaaggtctggacgtgaacagccacggcgagaacgcctataacgcctgattactgacgtttaactgtgcccggcggcgcaagcttgccgggcctacgtttatctcgtaggccgggtaaggcgaagccgccacccggctcttacttttgccaacactgtgtatttttaacgtgatgactgtatttgcctttctactacttcataaacatgctgcgcaaattgatttgccgcataatcaatgtctttgctcgtattttccacactgcctgtgccataaatcgttttattttttacgactgagcggccattgatactgactgacagcaagccgctcaggtcagtgttattagcaacgcctgattcttgcgtggtttctgtataggtatatgtacgatcgtcacagcggcgctccgtttctctcctgatttttggttttctttttttctcgtcttcatcatctctgtagtaaacatcaacatcgtagcaatattgttctgtcgctgttctttccacgggaatatctcgtgtaaagtctcgcgaggtacgatttgctgacgtacctttcagtgtgacgatgacattatttccttttttttgcgggctgtactgaatgtcataaatgttatttttagaatcatagcttgcgggtatgttacttttaattgttgctaaggtttcaacttttatggagcgctttatttgcgggataatataatttgccagaattggtgtgccatcaatgtatttttcacctgtattgttaataatgatatgccacgtcgcgttatcatacgcatttttaacttcattgatgatatcagggcgcttgctatcgtagtaatagctcattaaaagatcatagaatttttgctttttatcgtcctgcttcagcgctcgttcatgaaaagcctggctaagaggtttggtgacttcctgaagcgttatccgatcgacagtaaaagcagggttgataccgcctttcagcgatgcactcattttaggtgcaacttcctgtatcgccgggatccagcatgcccatgtatcggcttttagccgttgtgaggcaatatcggattggctgttaatagacgcaaccttttgcattactgtattataattactaacgaaattttgtaacactgtctcaactggcttttgacggcgtcctgattctgctgtattcagcgcatactgcaatttttttaatccagaacagtaatcgccggaggtaatatcctctgtcgaatgttttagttgcttgttaactctcgccgtggtggacagaccgcaagccgtcaatagcagcatgcatgacacaacaatgaagtatctgagtattttcattgatatcttccatgattatttgtgggttaatgcataatctatataaatatataaaattctcaatcacggatatttatagcagttattgcagtaaaaggaagatctaatagtaaaaacatcccccgcatttatttcgagggatgttgtatcgtcatattaattagtattgcgattgcgcatcacgccttcctgcacggtcgacgctaccagcacgccatcctgcgtatagatctcaccacggacaaagccgcgcgcgctggacgccgaggtgctctccacgctgtacagcagccactcgttaatattgaacgggcggtggaaccacatggaatggtcgatggtcgcgacctgcatcccgcgctcaagaaaaccgacgccgtgcggctgtaacgccaccggcaggaagttgaaatcagaggcgtaacccagcagcgactgatgcacgcgcggatcgtccggcacgttaccgttcgcgcggatccacacctgacgggtgggttcggcgacatggcctttcaacggattgtggaactctaccgggcggatctccagcggcttgtcgctgagaaacttctctttagcctgcggcggcagcaggtgcgccagcgagcgggcaatgtcggtttctgatttcagcgtatccggtgagggagcgtcaggcatggttttctgatgctcatagcccggctccggtgcctggaaggaggcggtcatatagaaaatcggcttaccgttctggatagccgcaacgcgacgcgcactgaagctgttgccatcgcgcagcacttccacgtcgtaaacaatgggtttttcactgtcgccggggcgcaggaaatagctgtgaaaggagtgcaccaggcgctcaaccggcacggtttctttggcggcatacagcgcctgccctacaacctgcccgccaaatacctgacgaagccctaaatcttcgctttgtccgcgaaacaggccctcttcgattttttccagatttaataatgccagcagattgttcaacgcttgactcatatgtttcctcaataaaaataaaatccgccagtccggagggttcggtctaagtataacgcaggatcgtcagtggtccgatgggtgcaaaaatctgaataaccggccatttccaggcagaaatgagtgatatgtgccacacttattcccgttatctaagtgttaaccactgattctggcaggaataaatccttctggtgcattgaagataaggagaactcaatgaaactcgtgcacatgttaagtggtgttgcggtcgctgtttcgctggctgcctgcgcggataagagcgcggatattccgacacctgcaccaaatccaaatacgtctattaacgctacccaatcgactattgcgcagcctaatgtctccggttctgtgtggatccgccagaaagtggcgctgccaccggatgcggtgctgaccgtgacgctggccgacgcttcgcaggccgatgcgccgtcgaaagtgatcgcgcagaaagcggtgcgtaccgagggtaaacaggcgccgttcagctttgtgctgccgtttaacccggctgacatccagccgaacgcgcgcattctgttgagtgcggccatcaccgtgaacgataaactggtgtttgtcaccgatacggtgaaaccggcggttaaccagggcgggactaaaatcgacctgaacctggtgccggtgcagcagacggcgatcccgttgcagcagagcggtggcgcaaccaccacggtaccttctacgtccccgacgcaggtggtgccttcggcttctacgccagcgccgacccagatgtaatagttttactgcccggcggcctttgctgccgggtcagcggttttatgagtacacccaccgatagcgctgtaaatcaatctgcccgtctcctgatacctgaaccccttccgccagcaacgcctgtcgctgtcgttgcagatccggcccgctgagggaaatagccccatgacgattgaccacccgataccagggcagcgtcgtgccttccggtaagcgcttcagtacgccgcccacctggcgcgcggctctgggcgatccggcaagacgcgccacatcgccataggtggtgacaaatccttcgggaatggaggcaactatctgccatacgcgctggggaaaagagtcctgcggatccatagcatctcctgagtattgattcttcaggataaacagccagccggacactgtgaagagggggctgcgcaataaaccagcatacgacaggcgcgcgcttgcaattgccggggtgtacagggataatgcgcctgcgcgttggttaacaacgctctcaatgggggccctgttggttctcccgcaacgctactctgtttaccaggtcagatccggaaggaagcagccagagcagatgacgtgtgtgccgggatgtagctggcagggcccccacccatttgtgccccgcataactcgctatgtttcgcctcgtcaatccctcttattagccgcacctgaatttcccgctgcgttatgtgacacccctcagcatattattacgctgtcatgtaaatgaaatgttattgtcattatagtgtcataaatgcatggcagattaatcgtgggtaattcaatgggtaagggataatcatggttagtgcagttttaaatgttaaaattgacgaagcagtcaaagagaaacttcgccattacgcagaagccaataacgaaaacctgagcacggccactgagaagctcttactgctggcactggaatcggacgaagaaaccagcgtttcagaagaagagatcgacagtcagcacatcgaagaagataacgcttcaccattaacttccaaagaaatcaaagccctgagaaaaattctgaagaagaaaaaatgaaacaacatctccagaagaccgcgaccagctacggcgaagcctgtcagttattgcgatccggccatgtgaaaaccgtacgcctgaactggaatgtcggcaccgatgaattttttcgcatagcctctgactggtgtgatgccggtgccagaatcaaaaaagatggcgagcactttattatttcgattaagggatttcctatcccgcgacaatagtcattatgttgtcatgcaggcgtcatcgaaataacatccgaatatgagaacctgtccgaaaatacaacgtcacacaaccatctcatgttcattatggatgatgattacgacgagccgttcggctcgtcgctattttctcagatcactttccgctgccgtaacatcatcggctgactgaccagcgacgcccagatcggttgcagcgtcataaaggcctcgcgcaaaacttcatccggctgtgaaaacggcatccgtaaaaagcgatcaaaagccccctgtaaaccgaaacgcgttcccgttcccagactgataccggtactttccgcgtgggtggcaaacagcgtcgccagcgcatcgggcagttccacccagaacgataatccgccctgcggcgtcgtccactgccagcggggaaagaatccctgcaacagcgccgcgcagtcatcccggtgcgccatcagcatctgccgtcgcgccggtaaaaaactctcgccgttttcgacaagccagcgggttgccagctgttccagcagcggcgagcctaaatccagggtttcgcgcatttgtaccagtgcggcgatggtacgcgccggggcgcggatccatcccacccgcagcccgccccagaaacttttgctggcggagccgagtgtaatgatcggcgcggcggtatcaaaggcggccagcgggggaggcggcggcgcgtccatccacagatcgaccatggtttcatccaccaccagcgtggtgcgcgtgcgcgccgccaggcgggcgacgttttcgcgggtcggcgcatccatacagcgcccggtgggattgtggaaatccggcatcagataggcaatgcgcggcgaggtctgggcgatagtggcggcgaggccgtccacatcccaaccctgagagggtaacgctactcccaccggacggcaggacgccccttcgatggcggcaatcgccagcggataggtgggatgatccaccaccacacgatcccccggcccggtcagcagccgcaggatcagcgccaggccgctgaccgcgccgttgacgatcatcacctcgtcggggcgtgtcggcagcccccgcgccacgtaacgccgggcgatggcttcccgcagcgccggtaaaccctgctggtcgtagccggtgccggacagcagcggcggcattgccgtcagcgcgtgctgataagcctggtggatctccggcccggcgggcagcgaagcggcagaaagatcaagcgcggtcggctgcgccatgcgggtcggcaccacgcgtttgctttccggcaggatcaccaccgagccgctgccgtggcggctcagcaaataaccttcctcccgcaactgcgccagagcgctggcggtggtggtgcggctaatgcccagcgcgctggctaactcccgctcgccgggcagacgcgtatccagcgccagtcggccatcaagaataagcaaacgcagggcctgcgccagttgccgccataagggcgtgcgggaggcggattgttgccactggccgagcaggcgtaccagggactgacttccggtgcgacgaggtgacatagcggtccactttttgaaaactggtcattaatcataatgccagccagggccatgatgtcactctgtttcgcagttttcggggtgagagatggttcggcgtttgatccagttgtatatcggtctgagtttttatggcgtttccaccgcgatgtttgtgcgcgctaatctgggagccgatccgtggaatgtcttccacctcggcgtcggtaagctattgtcgctggatatcggcgtggtgatgattgccaccggcgcgctggtgctgctgctgtggatcccgctgcgtcagcggccgggactgggcaccatcagcaatgtcattgtcattggtctggctgccgatgccgcgctggcgctgatgccgccgctggaatcgctggtcgcgcgcagcgtcctgctggtggcggctattgtggttaacgcgctggcgaccggtatgtacattggcgcaggcttcggttccggcccgcgcgatggtctgatgaccggcatcaatgcccgcaccggctggtcggtacgctcagtgcgcacggcgattgaaatcaccgttctgctgctgggctgggcgatgggcggcacctttggcgtcggcaccgtgctgtacgccctgaccatcggcccgctgatccagctctgtctgccgtggtttcgtccgcgcccgcaaccggttgacgtgccgctgccgcaaaccccggttgtttaaacgggcgaagcgctcacaacatcatgctttagattgaggtacactcacgccattctgactgttgcggtgtgagtgatgaaaccgataaccctgtacgatgtggcccgccttgcgggcgtctcctaccagaccgtctcccgcgtgattaatcaggcggagcatgtttccgcccgtacgcgcgaaaaagtgcagcgggcaatggcggaactgcactacattcccaaccgcggcgcgcagcagctggcgggcaaacgcacccgcacgctggggctgatcaccactgatctggcgctgcatgcgccgtcgcaaatcgcctcggcggtgaaaacccgcgccgggcaggcgggctgcggcacgctgatttccatggtggaacgtcacgatctggcggcctgtcaggcagcgcttcaggagttgctatcacagcgtgtggacggcctgctggtgaatattccgctggacgacgaggatgcgcaggcgctggcggcgcaggcacggccaacgccggtgctgtttctggacgtcagcccgacggcggcggtcgacagtctggtgttcgacgcggcgcagggcgcaagcctgggcgcggcgcatctgctttctctcggccaccggcatattgcgctgctgggcggtccggaaagctcggtgtcggcccgcgcacgttttgcgggctggctggcggcgctggatgaggccgggcttgccccggtcgcccgcgctcatggcgactggagcgccgcctccggctatgagaaaacccatttgctactggcctgcgcgcctcacaccgaagcgatcctcgtggcgaacgatcagatggcgctgggggcgatccgcgcctgtgcagaaaagggcattcgcgtgccggagcagctgtcgctggtgggctatgacgataccgccgacagcgcctggttctctccgccgttgaccaccgtgcggcaggcctttaaggaggcgggtgagcgcagcgtcgactggctgctgggcggggaggccgcaggccgcagtgagctgagccagacccgctgcccggtcacgctggtggtgcgcggctctaccgccgcacccggcgggcagacaatcgacggccaaacgctggcgcagcggctgaatgaactggcggtgctggcggcgcggctggagaggcgttaacacttttgtgatcgacgccgcttctggcggatccgatcctttacccgccgtgaagaaacaggcatggtactgttaattgtgagcgcttcgcaaaattcagaggtcactatgtctgcatctgctttatccaccctgatagcccgccgcgactgggaaaacccggtcgtcacccagtggcaccgtctgcccgcccatgcgccgatgaacagctggcgtaacgccacagacgcggcccgcgaggcggcatcgccgtcccgccgtctgttaaacggcgactggcaatttcgtcttttccccgcgccggaagcggtgccggaacagtggctgacacaggagcttgacgatgccgtcgccatgccggtgccgtccaactggcagatgcagggcttcgacacgccgatttataccaacgtgacctatcccatcccggtgacgccgcctgttgtcccggccgggaacccgacgggttgttactcgctcacatttgagatggacgagggctggctggcagccggacagacgcggattatttttgaaggcgttaattcggcattttacctgtggtgcaacggcgaatgggtcggctattcccaggacagccgcctgccggcggaattcgatctcagcgcctgtcttaaacccggcgctaaccggctggcagtaatggtgctgcgctggagcgacggcagctatctggaagatcaggatatgtggcgcatgagcgggattttccgcgacgtggtgctgctgcacaaaccggcgacccatatcgccgattatcaggttgccacccatctcaacgccgattttacccatgcgcagctggtggtggatgttgaactggcgggggagtatgcggattgtcaggtggcgctgacgctgtggcgcggcgatgaggctatcgcgcaggccagccaggggccgggcagcgagattattgatgaacgcggcgcctgggcggaaaaactcagcgtcagcataccggtggctaacccgcgcctgtggagcgcggaagatccggcgctctaccggctggtggtgtcgctgctggacggcaatggcaaactgctggagacggaagcctgcgatgtgggcttccgcaacgttgagatcagcaacggcctgctgaagctgaacggtaaaccgctgctgctgcgcggcgtgaaccgccatgagcatcacccggagcgcggtcaggcgattgatgaagcgaccatgcgccaggacatcgaactgatgaagcagcataactttaatgccgtacgctgctcccactatccgaaccatcccctgtggtatcgcctgtgcgatcgctacggcctgtacgtggtggacgaagccaatatcgaaacccacggcatggtgccgatgcgccgcctgtctgacgatccgcgctggttcccggcgatgagcgagcgcgtgacgcgcatggtgcagcgggatcgcaaccatccgtcgatcatcatctggtcgctgggcaatgagtccgggcatggcgccagtcacgatgcgctctatcgctgggtgaaaagcagcgatccgacccgcccggtgcagtatgaaggcggcggggctaacactgcggccaccgatattatctgtccgatgtatgcccgcgtggatcaggatcagccgttcccggcggtgccgaaatggtcgatcaaaaaatggctcagcatgccggatgagcagcgcccgctgattttatgcgagtacgcccatgcgatgggcaacagcttcggcggtttcgccaaatactggcaggcgttccgcgactatccccgtttacagggcggttttgtctgggactgggtggatcaggcgctgaccaaaaccgatgataacggcgagcgcttctgggcctacggcggcgattttggcgacacgccaaacgatcgccagttctgcatgaacggcctggtgttcccggatcgcacgccgcatccggcgctatatgaagcccagcgcgcccagcagttcttccggttccggctggagagcacctcaccgctggtcatcgatatcaccagcgagtacctgttccgcacggcgaataatgaagtgctgcgctggtcgattgcccgcgatggcgacgtgctggcgaccggcgagctggcgctggacattgcccctgaaggcacacagcgcgttacccttgacgcgcccgcgctgagcgccgcgccgggggaagtctggctgaacgtagatatttatcagcgcgaggcgacggactggtcaccggcagatcatctctgcgcttgggatcagtggcgcttaccggccccgctgtttgtcgccccgccagtagcgagcggcaacgcgcctgcgctcgccatcagcgatgaagagtatgtgatcacccatcagacacagcgctggcagttttcccgcttaagcggcgagctgacgcagtggtggcagggcgaaacgccaacgctgcttacgccggtgcgcgaccagttcacccgcgcgccgctggataacgatatcggcgtcagcgaagtgacgcgtatcgatcccaatgcctgggtggagcgctggaaggcggcggggatgtacgccatgacgccgcgcctgctgcactgcgctgcggaacgcaccgccgccgaggtctgtattgaaacgcgccactgctgggaggctggcgggaaagtgctgtttatcagccacaagcgctggcgcatcgacagccatggcgtgctgcatggcgacgtggatgttgcagtggcgaccgacgcgccgccgccagcgcgtattggcatcacttgtcagctggcggatgtggagccctcggtgagctggacggggctggggccgcatgaaaactatccggaccgtaaactggcggcacgccaggggcgctggacgctgccgctggcggcgctgcatacgccgtacattttccccggcgataacggcctgcgctgcgatacccgcgaactgcgctacggcgcgcatcagctgaacggacgcttccactttgccctcagccgttacggtcaggcgcagttacaggcgaccacgcaccaccacctgctgcgcgaggagccgggctgctggctgcatctggatgcgttccatatgggcgtcggcggggatgattcctggagtccgagcgtgtcgccggagtttattctggcgcaggatcgcgtgcactatcgctttagctggcagcaacgccgctaacccccgattgacgcgggcagcaagactgcccgcgttgatttattcgcgcttagcggtgcgcagattcgcttcggcccacagaataaaggccgctttcggcagcgccttgctgtacagccaaccctgaccatactgcacgccgtgctcccgcagccacgcctgctggctgtcggtttcaatgccttccgccaccatcgccagatccagcgctttcgccatctcaataatttgtggcgtgacgtttttatactccagcgcatcgacaaaggatttgtcgatcttgagaatatcgacgttcaggttttgcagatagctgaggctggaatagccggtgccaaagtcgtcgatataaatggcgtgtcctgccttgcgcagcgcgtcgatggccggggcgctgatctccggatcggcaaacccgcgctcggtgagttccagggctatttgcgcaggcgacagctgccagcgcgccagctgttcacgcagcagcacgggcagggtgtcggaggtcagatcgcccggatccagattcacggaaatatgtatttccggatgctgttgcagccatttgcccaaatcctcaaacaccgtttcgataatgagctgcgtcaggcgcggcatcaggccggttttctccgccagcggaataaacacatcgggcgtgagaaaggtgccatccacttgcggccagcgggcaagggcttctgcgccgacgatcctgccattactgagcgtgacaatgggctggtaattgacgacgatatcccgcgcgtgaatggcatcaagcaaacgctggcgcggtgactgcaaacgacgcagatagcgcagcaagaaaagcgccagcagcagactcatcaacaggccgaacggcagccagatcaacagctggcggtgccagcttttttccagcggcgcgagagaggcggaagtgacaatggccacgcccagttgcgggtaatacttcatggtatatatagcgccctggaatttaagctgctcatcgccgttctgtttcaggcgctgccagagcgcaggggtcagtgcaaagctgctggcgatcacctggttgctgtcggtgccaatcagcgcggtgctgatcgaccagttaccaaaaggcagcacgtcaatcaacgactggggatcgatcatcaccacatggcgctttccccccagcgccagcatggtacgttgcaggccgatgtcgttctgggtggtgagccaggcgcgataaccgtcgcgggtcactttgacagtcgccggaaagatgccttcagtgctcaggctttccagagaggagcagcgcggcctgaagccgtcgagatagatcacttcctgaatataacgatttacgtaggagacgcggcgcattgccagcaggtgttccggtccgcagggcttgccgctgaaggtttcaatatcatccagcgcgcgtttaccctgctcaatcacctgttccgtgcgcatcaccacccgcgaggcgtaattgcccatctcgctggcaaagttttcctctgcctgacgatgcgccagccagatgctcagcccgacggggagcagtaccgccaggagcagtacaccagtgatgacgctgataagccgccggttgttcataatcaaaagtccctgttttgatgttcaccacaccttgtggaatgatagcgttatatcacggctaattaatacattattgcaggatgcgtcagatgaagaaaaaagagtttgtgacgcaggatttgctgagcaaaatttatcagaaccgcgagccgggcccgcgtaaactgccgccggagcgccagttagccagcgaatacggcgtgtcgcgttttaccattcgccaggcgctggaaaaactggccagcatcggcgtggtacgtattgtccagggttcggggatctggatcaacgaacagtcgcgcagtaatccgctggtgtacaactcgatcactgaaaagcgcttcgatcagatccgctttcgcatgatcagcctgcataaaaaacggcctgaccgcgatgaacagcagatcttcggcctgccggaagagagctttatctggcagttttgccgcctgcgttttgtggatgaagaggcggtgcagatcgaagtgtcccgtatgccggtggcggattttccggatctgaatcagcaggtgatcgagcgctcattgcagcagtacgtgctgagcaagggttatcaggtgtcccatctgctgaccacctaccgcgcggtgagcgtcagccgtgaacaggcggtgctgctgggctgcaagaagggcagcccggcgatgcatatcagcaatcgcggtattctggaaggcggccaggtgtatgagatcagcgatattatcgacatcaattacacctgcacctacatcattccctataaccgcgacaatctgaccttccgccagggcggcagttaaggcgtgtggatgctgccgtccggcaggcggctttgcgtccactcatgggggcggtagaccaccgggctggcgagggctttttgctcgtcaaaaccgacgccgatacccggcgtttccggcgcacagacaaagccgtttttcgccaccggcgcgccggggaataccgcatcggtaccggcggagcggggaataaactcctggatcgccgcgttgtgcaggtgaatattcagatgggtgtttaccgccacgccaatcggcgtcatatcgccagggccgtgccaggcaagacgaacgccaaaggcctggcagagcaccgccagcttcagcgccggggtgatgccgccaatctgcgagatatggcagcggataaagtcgatgcggcggttgacgatcagatcgtgccactccgccgggttgttaaacagctcgcccatcgccagcggcgcggtgctgtgcgcccgcacctgctccagccacgcgctttgcgccggcggcagaatatcttcaataaaataaggctggtacggctccagctgttttgccagctgcaccgcctgttgcgggaacagccgctcgtgaacatcatgcaggatatgcaactgatagccatatttctcccgcagcgcggcaaacatcgccaccgtgttgctcatgtactcctgctggtcgaaataggcgcccggcgtgggattgtcaggggtgtgcagattcgctggcgtgccgccgtaaaaacccagctgacagcgcacatggcgatagccctgcgccaccagtttgtcgacggcggcaaagagttcgtccagggtttcgccgctggcgtgggaataggcgggaatggcatcccgggatttaccgccgagcagctgatagagcggcatcccggcgagctggcccttgatgtcccacagcgccatatcaatgccggaaatggcgttgttcatcgccgggccgttacgccagtaggcgttgacgttcatcatctgccaggcgtcttcgatatggttggcgtcgcgcccgaccatcagcggtttcaggtactcgtcgaccagggttttcaccgccagcgggcgctgttgaaaagtggcgcatccatgtcctgtgatgcctttatcggtggtgacccgcacggtaaccaggttgtggcgatcggggcgggtaataaaacattcgatatttttgataatggttggcgtcacagggaatactccttttcaggccagatgaatcgtaatggctattatcatcccctgaatttccggaaaaggtaaaccgttttttttataaatattttggtcagttatttggatttattttaattaaataccataccaattttcgttatatgaccttttgatgttgctgttagagcggaattgtgacgaaattcatattttattggtttgttttgtggtgacgatttacctaccatgagtgacagatattaaaacgacaacacttccggcaggagcttttatgggaacgcaagacgccattaacaatattatccgtctggtgggcggcgagggtaatattaacaaggtatggcactgtatgacgcgcttacgctttgatctcattgacgataataaagtcgatcagggtgaaatcaaaaagctgccgggcgtcctgggcgcgcagttgcagagcgaccagtttcagatcatcatcggcccgaaagtgaacagctggtatgagcaaatgctggccacgcttggcggcgacaatcgaaccaacgacgcaccggcgcagaaagggcggaaaagcctggtgtcgatgtttatggataccgtctccggcgtgttcgggccgattgttccggcgattgccggggcagggatgattaaaggtctgctggcagggctgatcgccctgaagctggtttctgcgaaaagcgataccgtggtggtgatcgacctgatcgccagcggcgtgttctattttctgccgttcttccttgcagtgtcggcggcgaaaattttcaaaaccaatgaatatctggcggcggcggtggcggcctgtctgatgtacccgtcgctgattgaggcggcaaaagcgctggcggcgcatcagccggaggcggtgacggcgttctggctgctcaacgccattccggtatcggtctttaactattctgccagcgtgataccggtgattttctcggtgctggcgctcagctatatccaccgctgggtggacagcatcatgcctgacgtgctgaaaacggtgtttacgccgacgctgacgctgttcctcggcgcgctggcggcgctggtggtgattggcccgatcggtatttacctcgggaaagggctggcgctgtttatcgaagggctgttcagcgtgtcgtcgagctttgccggtctggtggtcggggcgatccgcccggtggcgatcctcaccggtatgcaccacgcgatgacgccgattgcgctgcaaaacttcagcgaccgtggttacgacatgctgatgccgatgatgtttatggccaacatggcgattgccggttctacctttgctatctggcgcatcagtaaaaaccgccaggatcgcaccgtgaccttatcggcggggatttccgcgctgctgggcatcactgaaccggcgctgttcggcgtgctgacgcgctacaaaaaagcctttatcgccgcgaccatcgccagttcgctggcctcggcgttcattgccttctttggcgtgcggctgtacggctatattctgtcgagcattttcagtctgcctgcctatatcggcccgtactttatgttcgccctcgcaggcgtggtaatagcgctggtgctctccttcattttaacgacgatccttgtcggaaaagatcagccggacgcctgagttaacgtcggtgcgccagacggcgcgccgacatttgcttacttcctctctttgattcttccctgctttcgcatccttatgtgctttaaagagttgtattccttttattaccgggatagaattttgttatgttataacaaaacatctgaggcattatgaaagctgatatccatccccattaccggacggtggtgttccacgacaccagcgccaacgaatatttcaaagtaggatcgaccatcaaaaccgatcgcgaaattgagctagaaggcaagacctacccctatgtgaccattgaagtgtcatcaaagtcacatccgtactataccggtaagcagaagacgttcaccaatgagggcagcgctgcaaaattccagcagcgattcggtcgttttatcagttctaagaaggactaaaagatgcaggtgctgaattcattacgcagtgcaaaacaacgtcacccggactgtcagctggtgcgccgtaaagggcgggtgtacgtgatttgcaaatcgaacccgcgctttaaagcggtgcaggggaaaaagaaaagacgttgagggataaagaagaaacgggcggcaattattttgccgcctctttgcgcgtcagggtgtagatatcgtaaaacgacagctcgcccttacgggccatcatctgctgtaactgtaatttctctttctcgctgaccacaggcgagctgaggatatcgtcaatcagcgtttgcggtacaaagcgggtgttgtaccactcgccgttgtagcagacgcggaaatccagcacatcgatatcttcatagcggtagcgcggataaacatcaaaaaagaagaagccgttaagcagcgcaaagagcaccaccagcagccagacggagcctgccagggtttcagactgcaacatcaccgccagggtggcaaaccaggcgatgtacataccgacaaataatccgggatgattgcggatgaagctgatgctgaagcgcggcctgttgtcgcgtttctcgcgggtattaagctcatcgatagtttgcatgagcagccgctggatctcggtcatttatttccctttttattcggacgaggtgcaggtgaaaccgcctattttacgcgcccgcagagtctgaaaaaaagtaacagtcgcacggcaaaaaacaataacagtcagacggcgccaggcgtcagcgttttgatgatgcgcgccgggttcccggcaatcaccacgtcagacgggacatcgcggatcaccacgctgcccgcgccaatcaccacgttatcgccaatggtgacgccaggatttatcaccgcgcgtccgccgatccacacgtttcgaccaatgctgaccggcgcgccgaactccagaccactgttgcgcgcagtggcgtccagcggatgcgtggcagtatagatatgtactccgggcgcgatcatacagttatcgccgatgcggatcgggcagacatccaggaaaacgcagtcaaagttagcgtagaagtctttgccgaggaaaatattgtagccgtagtcgcagcggaaatttggttcgatatacgcattgccgctgtcgccaagcagttccgccagcatagcgcgacgtgccgctttttcatctggcacggagtggttgtatcggtgaatgatttctctggcgcgcagacggtcggcgcgcagggtgtcatccgatggccggtagggcagaccggctatcattttttgtttctcgtcgctcattgctttctcaccagtaaaattaacagtgaacaccgtaaagtgagatagccggaaaggataataccttcgcgagggcttgtgatcgcgatcacatgggcactcgctgttcatcgtcgggagaagccgcctgacaaaggctatgggagagcgctacgatacaacctcaaaaaacatcacagggattaacggacgaatttccaaaccgacgacggaattttgtcatacagcttattcatggtcagttcagccagacggtgatccgccgctgaataaaatacggtcagttccggatccgacagctcatatttattcttttcaatgacgcgttccagcgtatcaatagtctgacagcgcctcaggcgcatcaaataatcagtcttggttaatggtttatcagacataacttcacctttgtaatagttctaacaggagaggctaacggggttagccctgctcacattgaggaaacagcgaaacaagcgattccctgatttacgccatttctgtaagtcttctgtgttaatgccgtagctgctgaacaacataaacgtgtcatcgaggtattcatcgatttgggcgatcagcttattatcttcattatacttaattttataattaagtgcgaaggttgctatatgctcaacaagctcgtttaactgtaaattgattgctgaagttggatcatttacccagccatggtggctttcttccagattggcgaggcaatcatggtacagggtttcacaaagaaatttcagctgcgcaatatcatgcctttttggcgagtattcgtccataacgcatccccttctgagtgacttttttttactaaccgaacaccgtatcgggatggatacaacactgtgacctgccgcgtaagctgctcttacgtctcattttaactataagccagactgaataatatttcctggctctattacgaaaaattacaattattacaacttatgtctgtcagtaaggttatttccgatggttaatctaccgccgtggggcgcgttaaatcttcagcacctttaatgcatccttaggtttcattaggttatccgggattaactggtcggatgttattgccgtgttcgcgactaagaaaattacttaggaataatcttactgaacagcaaaattcacaataattaagatttttacccatacttttaagagtgaacttaagccttaagaattatatgacttattttcgttgcataatataaacgcacagacaataagctggttttatcattttttgcgaaaaagaaaaaggccgcttgcgcggcctttgttaaagcatcatggcttaatggtgctcaaccttatgggaatgctcaatatcttccgatttgcggctgaagcggcggcgaaccaccacaaagaacaccggtacgaagaagatagccagtacggtcgcagtgaccatcccgcccattacgccagtacctacggcgttctgcgcgccggaaccggcacccgagctgataaccagcggcataacgccgaggataaacgccagcgaggtcatgaggattggacgcagacgcatacgtaccgcttccatcgtcgcctcgatcaggcctttgccttctttctccatcagatccttggcgaattcgacgattaatatcgcgttcttcgccgacaagccaatggttgtcagcaggcccacctggaagtaaacgtcgttacccagaccgcggaaggtcgcagcaaggagcgcgcccagtacccccagcggtaccaccagcatgaccgagaacggaatcgaccagctctcgtacagcgccgccagacagaggaagacgacaatcagcgagatggcatacagggcaggggcctggttgccggagaggcgttcctgataggacatgcccgtccagtcgtaaccgatgcctgccggcagtttgcccgccagttcttccatcagatccattgcttcaccggtacttttacccggtgcggcttcgccaagaatttccatcgacggtaaaccgttatagcgttccagacgtggtgagccgtattcccagtgcgtggtggcaaaggcgttcaacggtaccatctgcccttcgttaccgcgcacataccagttgccaatatcttccggcaacatacggtatttggcttctgacatgacgtaaacttttttcacacgaccacggtcgatgaagtcgtttacgtagctgccgccccatgccgcgccgagggtggtattaatatcgctaatggatacacccaacgcctgcgctttttcctggtcgatatcgattttaaactgcggcgtatcttccagaccgttcggacgcacgccaaccagcacatcagagcgcttgccgacttcgccgagcagctggttacgcgcctgggtcagtttctcgtggccaagaccgccctggtcgatcagctggaagtcgaagcccgtcgccgtaccgagatcaacaatcgccggcaggttaaaggcgaagaccatcgcatctttaatctgcgagaaggtgcccatagcgcgaccggtgatcgcatccactttgttttcatcgcccggacgctcgccccactctttcagggaaacgaacgcgataccggtgttctgtccacgacctgcaaaaccgaaaccgttaaccgcaaacacagagtttacgttcgctttttcgtttttgaggtagtagtccgtcacctcatccagcaccttctgcgtacgctcctgggttgcgcccgcaggcagctgaaccatggtcaggaacacgccctgatcctcgtccggcaggaaggagcttggcagacgtacgaacaggtaggccataccaataacgatgatgatatagagcagcagataacgaccggtactgcgcaggatattccctatgctgtcggtgtaatggttggtgctcttatcgaacatgcggttgaaccagccgaagaagcctttcttgccttcgccgtgatcgcctttggcgaccggcttcagcatagtggcacacagggccggggtcaggatcaacgcaaccagaaccgacagcgccatcgctgaaacgatagtgatggagaactgacgatagatcgcaccggtagagccgccgaagaaggccatcggaataaataccgccgacagcaccatcgcgataccgaccagcgcgccctggatctggcccatggacttacgcgtggcttctttgggcggcagaccctcttcggtcattacacgttcgacgttttccaccaccacgatggcgtcatccacaagcaggcctatcgccagcaccatgccgaacatcgtcagggtgtttatcgaatagccaaaggcggagaggatcgcgaaggtccccagcaatacaacaggtacggcaatggtcgggatcagcgtggcgcggaagttctgcaggaacagatacatcacgatgaacaccagcacgatcgcttcgaccagggttttaaccacttcgttaatggagatttttacgaacggcgtagtgtcatacggataaaccacttccagaccggccgggaacgtctctttcatgcgttccagttcagcacgtaccgcgtttgccgtatccagggcgttcgcaccggtggcaagtttaatccccagaccggaagccggctggttgttaaagcgcgcgataatatcgtagttttcaccgcccaactcaatacgagagacgtctttcagacgcacctgcgagccatccggattcacttttagcaggatcttgccaaactcttccgtcgaggtcagacgcgtctgcgcaatgatagaggcattaagctgctgccctttcaccggcggggtaccgcctaactgacctgctgccacctgggcgttttgcgctttgatggcgttaatgacatcaaccggcgttaactggaagttgttcagtttggtcggatccatccagatacgcatcgcatattgcgaaccaaagagctgaacgtcgcccacgccgttagtacggctgatcggatcctgcatgttggcggcaacatagtcagaaatatcttcctgggtcatggagccatcggtgttaatcaccccgaccaccatcaggaagctactcgctgatttttgtacgcttacaccctgctgctgaacttcctgcggcagcagcggcatcgccagctgcagtttgttctgcacctgaacctgtgcaatgtctgcgtcagtaccggattcaaaggtcagggtgatctgcaccgaaccggtggagtcactgtttgaggacatgtacatcaggccatcgataccgttcatgttctgttcgataacctgggttacggtatcctgcaccgttttagcgtcagcgccagggtagtttgcggatacagttacagcaggcggcgcaatcgtaggatattgcgctaccggcaactgcataatcgcaagccccccggccagcatgacgatgatcgccaacacccatgcaaatatggggcgatcgataaagaaattaggcatgtcttaacggctcctgtttaagttaagacttaggctgttctgactgggcgccgcctgcggcttgctctttcgtctcagccttcacttcctgcacttttacctgagcgccaggacgaactttttgtaatccggtgacgatgacgcgatcgcccgttttcaggccatcggtaaccagccatttatccccaatcgcctgcgtggcggtgatctggcgctgttcaactttgtcgccttcgccaaccaccatcacgctcgcatcgccgcgtggcgtacgggttacgccctgttgaggcaccagcagcgcattcgggttaacaccttcttcaagacgagcgcgtacgaacatacccggcagcagggaatgattcgggttcgggaaaatagcacgtagcgtaatagagccggtggtctggtcaacggtcacgtcagagaactcgagggtaccggtttgcggcagtttttcaccgtcgctggtgataagttccactttcgccttgccgttttcctgtttcagcttgccgctttccagctcctgcctcagacgcaggaaatcgttgctcgactgggtgacatccacataaatcggatccagctgctgtacggtagccagcgcggtagtttgaccgctctgcaccagcgcgccttccgttacggcggatttaccaatacgaccgctgataggggaggtgactttggtataagcgaggttaatacgcgcggtttcaacggcagctttcgcggccacgacagcggcattggcctgcatcgcatcagcctgcgccgtatccagatcctgttgactgatgtagttggtgccaatcagtttctgataacggttaagggtaacctgagcaattttcgctgcggcctgcgctttcgccagatcgcctttggcgctctcataagaggcctgataggtggctggatcaatctgataaagcgagacgcccgcttcgatatcgctaccttcggtgaagttacgttttaagataatgccgctgacctgaggtctgacttccgcgatgcgatacgcgctggtacggccaggcaattcagtggtgatttgcagaggttcagatttgagtgtcacaatcccaacttctggcgcctgtccggcaccttgttgctgagccggtttatcatcacatcctgtaagcgctaagctgcctgaaagcatcagaacgaccgccagaggcgtgaaccctctgtttttgttcataggtaaacctcgagtatccgatttcaaattgatcaatggatcaagcgtccacaaacccattgctgcgtttatattctggtcatgctatgttacatacattcataaatgtatgtaaatctgactcctgtaaaatcacctacatatggcacgaaaaaccaaacaacaagcgttagaaacacgtcagcacattcttgacgtggcaatgcgattgttctctcagcaaggtgtctcttcaacctcgctggctgaaattgcgcaggcggcgggtgtgacacgcggcgcgatttattggcacttcaaaaataagtcagacttatttggtgaaatttgggagctgtcagagtccagcattagcgatcttgagcttgagtatcaggcaaaattcccggacgatccactctcagttttgcgggaaatcctggtttatattctggaggcgacagttattgaagagcgccgtcggctaatgatggaaatcatttatcacaagtgtgagtttgtcggtgaaatggcaattgtgcaacaggcacagcgcagtttatgtcttgaaagttacgatcgtattgagcaaaaccttaagcgctgcatacaagcgaaaatgttaccggcagatctgctgacccgtcgggcggcgatcctgatgcgcagttatatttccggcattatggaaaactggctgctcgcgccacaatcctttgatctcaaaaaagaagcgcgggattacgtggcgattttgctggagatgttccagttctgcccgacgatgtgtaaagcgcccggcactctgtccgcttaagacaaaatctccgtcgccaggatttatcctggaggctttgcgcgccgctaggtagtcgctggcgggcgtgatattctccgtgccaggctatttccggccgctttccggttaagaacacattcacactaaaattatgctgcacaccatacgcccgcaaaacccgatttccgcgtttgcctttgcgctgtgtttattcgtcgcgtcattttgcgtcacgataaacgtagcccaggccgcaaccgatctgccttcccgtgccgaaacgcaaagtcggctggatgcgctgaacaagcaaaaaacccacagcccgcaggataaactggtcattgaagatctgaccgaaaccctggacacgcttgataaaatcgagcgtatcaaacaggaaacggcgctgctgaaacagaaagtcgcccaggccccggaaaaactccgtcaggcgacggaagggctgaacgcgttaaacgataaagacaatgacgacgaaacgcgtaaaaccctggccgcgctgtcgttgcgtcagctggaatcccgcgttgctcaggtgctggatgatttgcagacggcgcaaaacgatctctccacctataacagccagctggtgtctttacagacacagccggagcgggtgcagaacgccatgtatgccgcctcccaggagttgcagcagatccgcaaccgtctgaacggcaccatgaccggagaaggggcgctgcgtcctacgcagcaagagttgctgatggcgcaacaggcactgctgaacgcgcaaattgagcagcagcggaaaagcctcgaagggaataccacactgcaggatacgctgcaaaaacagcgcgattacgtcaccgccaacagtaatctgctggagcatcagctacagctgttacaggatgcggtcaataataagcgcctgacgcttaccgaaaaaaccgcccaggaagccgtcaacccggacgaaaccgcccgtatccaggcgaatccgctggtgaaacaggagcttgatattaaccatcagctcagccagcggctgattgatgccaccgaaagcggcaacgcactggtgcagcaaaatatcaaagtcaaaaactggctcgatcgcgccctgcaatccgaacgcaacgtcaaagagcagatcgcggtgctgaaaggcagtctgctgttatcccgcattctgtatcagcagcaacagacgctgccgtcagcggatgagctggaagacatgaccaaccgcatcgcggatttgcgtctggaacagtttgaaatcaaccagcaacgtgacgcgctgttccagaacgacgcctttgtgtcgaagctggaagagggccaccagagcgaggtgaatgatgaagtgcatgacgcgctgcttcaggtggtggatatgcgtcgtgagcttctcgatcagctgaacaagcagctgggcaatcagctgatgatggcgattaacctccaggtgaatcagcagcagctgatgagcgtctccaaaagcctgcaggaaatccttacccagcaaatattctggatcaacagtaataagccgatggactgggagtggcttaaagccttccccgaagcgctgaaagagcagatcaaatcgaccaaaatcaccgttaactgggaaaaagcctggcctgcggtggctatcgcgctgctcgccggattgccgctgctgctgattgccggtctgatccgctggcgtctgcgctggctgaaacagtatcaggcgaagctcgcggatgaagtgggacagctgcgtaacgacagccagctgcatacgccaaaggccattcttatcgatctgatccgtgccctgccggtatgcatgctgatcctcgccgctggcctgatcctgctcaccatgcagctcaatatcagcgaactgctgtgggcgttcagtaaaaaactggcgctttactggctggtattcggcctgtgctggaaagtgctggaaaaagacggcgtcgccgtgaagcatttcaacatgcctcccgcgctcaccagccactggcgtcggcagattgtgcggttaagcctcgctctgctgccgctgcatttctggtcggtggtatcggaactgtcaccgctgcacctgatggatgatgtgatagggcaggtggtgattttgcttaacctgctggttatctccgcgctgatctggccgatgtttcgcgaaagctggcacgataaagagtcgcacagcattcgtctgatcaccattaccgtgctgtcgattgtgccggtggcgttgatggtgctgacggccacgggctatttctataccacgctgcgcctctccggccgctggatcgaaaccgtctacctggtgattatctggaacctgctgtaccagaccgtcctgcgcggtttaagcgtggcggcccgccgtatcgcctatcgtcgggcgctggcgcgtcgacagaatctggtgaaagagggcgcagaaggagccgagccgcaggaagagccgaccatggcgctggagcagatcaaccagcaaaccctgcgtatcaccatgctggtgatgattgcgctgttcggcgtggtgttctgggcgatctggtctgatttaatcaccgtcttcgcttatctcgacagcattacgctgtggcattacaacggcagcgaagcgggcgttaacgtggtgaaaaacgtcaccatgggcagtctgctgtttgccgtcattgcgctggtggtggcctgggcgctgatccgcaacctgccggggctgctggaagtgctggtgctctcacggctgaaaatgcgccagggcgcgtcctacgccatcacgcagatccttaattacgtgatcatcgccgtcggcgcgatgacggtcttcggctcgctcggcgtgtcgtgggataaactgcaatggcttgccgcggcgctctcggtcggtctgggttttggtttgcaggagatcttcggtaacttcgtctccggtctgatcattctgttcgaacgtccggtgcgcattggcgataccgtgactatcggcaccttctccggtacggtcagtaagatccgcattcgcgccaccaccattaccgattttgatcgtaaagaggtgatcatcccgaacaaagcctttgtgaccgagcggctgatcaactggtcgctgtccgataccatcacccgcgtggtggtgcgtcttggcgtggcttacggctcggatctggagaaggtcaaagaggtgttgctgaaagcggcgatggagcatccgaaagtgatgcacgatccggaaccggcagtgttcttcaccaccttcgggccgagcacgctggatcacgaactgcgtctgtacgtgcgtgaactgcgcgaccgcagctacaccgtggatgagctgaaccgcactattgaccgcctgtgccgtgaaaacggcatcgacatcgcctttaaccagctggaagtccacctgcgtaataccaaaggcgacgagcataccgaagtgaaacgtgatctgagcggtgataattccgcgccaggcatcgcctgacagacatccgccaaccctctcctgtgggagagggtcactctgtggcggcgcttgccgccactttcttctcaaaatcccggcgtacgatctccagcgctttcagcactgtatccggcggaatggcgtgttcttccagcagcataatcaaatccaccgccagtttaatgtcgtccggggcattctctaatgacatgataacgtcttccttagcgggtcatccgtgccagcacggactcaatacgatgtaatgcagtctgacagcgggacagccggccttgcagcgccacgatctcctgttgcagtttctgctgttctgccgtatcgacggctgcgcggcatcgcgcttcccgtgtctgtttcatttcgatcagacggcgctcaaattcctgatgctgcaaacggcggcgctgccattttgcgatccccggcgccgcatgatcccactgcctgagcgaccaggtggcggtttcgcgcatcagggcggcaatttgcgcgctgagatgctccgccagccagctcacctgagccagctgcgctttctccaccgcatggcgaagggcggcgagattggcttccgcctcctcaagacaggcggacatcagcgtgctgcgcgtgcggaaaagctggcgatcgaagcgcgcgctgacggtggcatggccggcaaggggcgcaacctgcatccgtaatgccgccagttgctcagcgagcgtctgtaaaagtcgaaccgttttcacctgtctctccggtcattcattcaaagcctgtgttaaagtgaccctaacatcagataacgatccctatcatgcaacgcactattttaatcatcatcggctggctggcggtagtcctggggacgctgggcgtcgtgctgccgctgttacccactacgccttttatcctgcttgccgcctggtgctttgcccgctcctcgccgcgctttcaccagtggctgctttatcggtcatggtttggcggctatctgcggcactggcagaagtaccgcgcgatgccgccgggcgcgaagccccgcgcaatcgtggtgatcctgctcacctttgcgctgtcattatggctggtaaagctgatgtgggtacgcattttgttgttatgcatcctcgcctgcctgctgatttttatgtggcgcatcccggtggttgacgaaaaacaacaaaatcagtgacgcgaacggaagtgtgttgcatttgtcgcgcgcagccagtaaattcgagcgttttcgagcacgggcactcctggttaaatgttaaacaacggttgcatttgatccttctcagcgtgccgtgagtaacaccgtttctatcaggcaaaaaatccatgaccgcgactgcgcagcagcttgaatatttaaaagacagcatcaaaagcatccaggattatccgaaaccgggcatcctgttccgtgatgtcaccagtttgctggaagacccgaaagcctacgccctcagcattgaactgctggttgagcgttataaggatgccggtatcaccaaagttgttggtactgaagcccgcggcttcctgttcggcgcaccagttgcgctggcgctgggcgttggtttcgtcccggtgcgtaagccccgtaaactgccgcgtgaaaccatcgcggaaagctatgagctggaatacggcaccgatcagttagagatccacgtcgatgccatcaagcctggcgacaaagtgctggtggtggacgatctgctggcgaccggcggcaccatcgaagccaccgtgaagctgatccgccgtctgggcggcgacgtcacagacgcggcctttatcattaacctgtttgatatcggcggcgagcagcgccttgaaaaacagggtattaaatgctttagcctggtgccattcccgggtcactaatacccgtcatcgacattcatcatgcgggcctgctggcttgcatgatgaagtgtattcagcctgttgctgtgttagcataacccctcgtaaatcacctttcagcgttgcagagcctgccaatgagctatcaggtcttagcccgtaagtggcgaccacaaacttttgctaacgttgtcggccaggaacatgtgctgaccgccctggcgaacggcttatccctgggacgcattcatcatgcgtatctcttttccggcacccgcggcgtcggtaaaacgtccattgcccgtctgctggcgaagggactgaactgcgaaaccgggatcaccgccacgccctgcggcgtctgcgataactgccgtgaaatcgagctggggcgctttgtcgatctgattgagatcgatgccgcttcccgcaccaaagttgaagatacccgcgatctgctggataacgtgcagtacgcgccagcccgtggccgcttcaaggtctatctgatcgatgaagtgcacatgctgtcgcgccacagcttcaatgcgttactgaaaacgctggaagagccgcctgcgcacgtcaaattcctgctggcgaccaccgatccgcaaaaactgccggtgacgatcttatcgcgctgcctgcaattccatctcaaagcgctggacgtcgatcagatccgccagcagcttgagcacattctcgacgaagaaaaaattacgcacgagccgcgcgccctgcaactgctggcgcgcgccgccgacggcagcctgcgcgatgcgctgagcttaaccgatcaggcgattgccagcggcgacggtcaactgaccactcaggccgtcagccagatgctcggcacgctcgacgacgatcaggcgctgtcgctgattgaagcggtggtggaagccaacggcgaacgcgtcatggcgctgatcaacgacgccgccgctcgtggcgtggagtgggaagccctgctggtggagatgcaaacgctcttacaccgcatcgccatggtgcaactctccccggccgcgctcagcagcgacatggcggccattgagcaccgtatgcgcgagctggcccgcaccgtgccgccgactgacgtacagctctactaccaggcgatgctgattggtcgtaaagaattgccgtatgcgccggatcgccgtatgggcgtcgaaatgacgctgctgcgcgcgctggccttccatccgcgccagccgctgccggagccgcaggttccacaacagtctttcgcgccggcggcccccacggccgttctgaacccgacgcaggtcgccccgcaacaacacgccgtcgccccaccggccataagccatgacgcgccattaccggataccaccagtcaggtgctggcagcgcgtaatcagcttcgtgcccagggagcgaccaaagcaaaaaagagtgaaccggcagcggcaacccgcgcgcggccggtgaataacgctgcgctggagcgcctggcgaccatgagcgaacgcgtgcagtcgcgtcccgcctcatcgacccaggaggctccgcctgctaaaaaagaagcctatcgctggaaaacgaccacggtcaccgaagcggtaaaagaagaagtcgccacgccgaaggcgctgaaaaaagcgctggagcatgaaagaacgccggagctggcgaaaaaactggcggaagaagccattgcccgcgatccctgggcggcgcaggtcagccagctcaatctgccgaaactggtggagcaggtggcgctcaatgcctggaaagaacaggacggcaaccgcatttgcctgcatctgcgtccgacccagcgccatctgaattcggcgggcgcggctaaggtgctgacggaagcgctgtcgaccttatgcggcgaagcagttgaactgactatcattgaagatgataatccgtcggtacgcacgccgctggaatggcggcagacgatttatgaagaaaaacttgcgcaggcgcgcgagtcgattgtcgcggataataatatccagacgctgcggcgcttttttgacgcggagctggatgacgaaagtattcgccccatttgacagccagcggtgctgactgtcgccaaccctgaatgtgacttacctgaccggtaaatcacccctagcctgagagagaagcctatgtttggtaaaggtggtctgggtaacctgatgaaacaggcccagcagatgcaagaaaaaatgcagcagatgcaggaagagatcgcgaagctggaagtgaccggcgaatccggcgcgggcctcgttaaagtgaccatcaacggcgcgcataactgccgtcgcgtggaaatcgatccgagcctgctcgaagacgataaagacatgctggaagatctggtggcggcggccttcaacgatgcggcgcgtcgtattgaagaaacccagaaagaaaaaatggcgggcgtgtcctccggcatgcagttgccgccaggctttaagatgccgttctgatgcaagccagcccgctgttaaatcagctgatggaagcactgcgcagtctgccgggcgttggcccgaagtccgcgcagcgtatggcgttttcgctgctccagcgcgatcgcagcggcggtatgcgactggcacaggccctgacgcgcgcaatgtctgaaatcggtcattgcgcccagtgccgcaccttcaccgaacaggaagtgtgcaatatctgcgcaaatccgcgtcgccaggaaaacggtcaaatctgcgtggtggaaagtcctgctgacatctacgccattgagcagaccggacagttttccggccgttactttgtgctgatggggcatctgtcgccgctcgatggcatcgggccgaacgacattggccttgataagcttgagcagcggctgtcgtctgaacagatgaaagaggtgatcctcgccaccaatccgacggtggaaggggaggcgaccgccaactatattgcggagctgtgcgcgcagtatggcgtcgatgccagccgtatcgcccacggcgtgccggtgggcggcgagctggagatggtcgacggcacgacgctgtcgcactcgctggccgggcgtcacaagatccacctttagtaaaaatcagtaaaaaaaatcgggggcatttctttgcccccgcttgaaattcttcccgcatatccccatttccccctcaacaccaaatggcattgttgaggtattttttcgatgaaaggacaagaaacacgcggtttccagtcagaggtcaaacagcttctgcatctgatgatccactcgctgtattccaacaaagaaatcttcctgcgtgagcttatctctaacgcctcggatgcggcagataaactgcgctttcgcgcgttgtcgaatcccgatctttatgaaggcgacggtgagttgcgcgtacgcgtctccttcgataaagagaagcgtacattgaccattgccgacaacggtattggtatgaaccgtgacgaggttatcgaccatctgggtacgatcgccaaatccggcaccaaatctttcctcgaagccatgggctctgaccaggcgaaagacagccagctgatcggtcagttcggcgtcggcttctactcggcgtttatcgtggccgataaagtcaccgtgcgcactcgtgcggcgggcgacagcgcagaaaacggcgtgttctgggaatcggccggtgaaggcgattacaccgttgccgatatcaccaaagaggatcgcggcaccgagatcaccctgcatctgcgcgaaggggaagacgacttcctcaacgactggcgcgtgcgctctatcatcagcaaatactccgatcacattgcgctgccggtagaaatcgagaagcaggaagagaaagacggcgaaaccatcgtcagctgggaaaaaatcaacaaagcccaggccctgtggacccgtaacaagtcggaaatcaaagacgatgagtacaacgaattctacaagcacatcgcccatgactttaccgatccgctgacctggagccacaaccgcgttgaaggcaaacaggaatacaccagcctgctgtatattccgtcccgcgcgccttttgacatgtggaaccgcgatcataagcacggtctgaaactctacgtgcagcgcgtattcattatggacgacgccgaacagttcatgccgaactacctgcgcttcgtccgtggcctgatcgactccaacgatctgccgctgaacgtctcccgtgagatcctgcaggacagcaacgtcacccgtaatctgcgcagcgcactgagcaaacgcgttctgcaaatgctggaaaaactggcgaaagacgatgctgaaaaatacctgactttctggaagcagttcggtctggtactgaaagaaggcccggcggaagatcctgccaatcaggaaaccatcgccaaactgctgcgctttgcctccacgcacaccgattcgtccgagcagaccgtgtcgctcaccgattacgtgtcgcgcatgaaagaaggccaggagaagatctactacatcaccgccgacagctacgcggccgcgaagagcagcccgcacctggaactgctgcgtaagaagggcatcgaagtactgctgctctctgaccgcatcgacgagtggatgatgagctacctgaccgagttcgacggcaagccgttccagtctgtcgccaaagccgatgagtcactcgacaagctgaacgacgaagtggacgaaagcgcgaaagaggcggaaaaagcgctggagcctttcgttgagcgcgtgaaaaccctgctgggcgagcgcgtcaaagaagtgcgcctgacgcaccgtctgaccgacacgccagccatcgtcaccaccgacaacgatgaaatgagcacccagatggcgaaactctttgccgctgcgggccaggccgtcccggatgtgaagtacatctttgaactgaatccggatcacgctctggtaaaacgcgccgccgatacccaggacgacgcgcagtttaaagagtgggttgaactgttaatggatcaggcgctgcttgccgagcgcggcacgctggaagatccgaaccagtttattcgccgtatgaaccagctgctggtttcctgatagcgtcatttcctgccggataagcccctgcgcttatccggtctggacgatcaacctgtaggccggataagcgtcagcgccatccggcattttttcgccagaattaccgcttttcttataattccccattaaccgtttcagcgtcgggcgcctttcttgaggcgaaggcgtgataatggtatcttttagcgcttttttaaaaaattttgataacctttgaggggattttcgcaatgcgtatcattctgcttggcgctccaggcgcggggaaaggaactcaggcacagttcatcatggagaaatatggcattccgcaaatttccacaggtgacatgctgcgtgccgcggttaaatccggcagcgagctgggcaaacaggcaaaagacatcatggacgccggtaagctggttaccgatgaactggttatcgcgctggtgaaagaacgtatctctcaggaagattgccgtaacggttttctgttggacggcttcccgcgtaccattccgcaggctgacgccatgaaagaagccggtatcaacgtggattacgtgctggaattcgacgtaccggacgaactgatcgttgaccgtatcgttggccgtcgtgttcatgcagcctctggtcgtgtttaccacatcaaattcaatccaccgaaagtggaaggcaaagacgatgtgaccggcgaagagctgaccacccgtaaagacgatcaggaagaaaccgtgcgtaaacgtctggtggaataccatcagctgaccgcgccgctgatcggctactatcagaaagaagccgaagccggcaacaccaaatatgtgaaagtcgacggcaccaaagcggtgagcgacgttcgcgcagagctggccaacatcctcggctaatgcttttccccggtggcctcaccggggaactcccttctgttttccctttcgctacaattggtttcgtttacctgcaattcagctacaattatcgcccgtttagaaggataagaggcgcgaatgagtcaggcgaaaaccggcatactgctggcgaatctgggcaccccggatgcacccacaccccaggccgttaaacgctatttacggcagtttttaagcgaccggcgggtggtcgataccccacgtctgctgtggtggccgctgttgcgcggcgtgatcctgccgatccgttcaccgcgcgtcgccaaactttatcagtccgtatggatggaagaaggctcgccgctgatggtctacagccgtcgtcagcaacaggcgctggccgcccgtctgccggaaatgccggtggcgctcggtatgagctacggctcgccatcgctggaaagtgccgtggacgaactgctgtcgcagggggtggaacatctggtggtgctgccgctctatccgcaatattcctgctccaccgtggctgccgtctgggatgagctggcgcgtattctggcaaaaaaacgccgtatttccggcgtctcttttattcgcgattacgccgacaattcagcctatatcgacgcgctggtaaacagcattcgcgcctccttcgccgtacatggcgaaccggatctgctgctgctctcctatcacgggatcccgcagcgctatgctgacgaaggggatgattatccgcagcgctgccgcgacaccacccgtgaagtggtttccgcccttggcctgccgccggaaaaagtgatgatgaccttccagtcgcgctttggccgcgagccgtggctgacgccgtacaccgacgagacgctgaaaatgctcggtgaaaagggcgttaagcacatccaggtgctgtgcccgggatttgcggctgactgcctggaaacgctggaggaaatcgccgtgcagaaccgcgaattcttcctcgaagcgggcggcgaaaaatatgaatatattccggcgcttaatgattcagccgatcatattgagatgatggtcagcctgacggccccttatcgctgatcgcgaagcgggccgcgagtgtgctaccatttgcggcccaattcttcactattactgattatgaaatttcccggcaaacgcaaatccaaacactactttcctgttaacgcccgcgatccgctgttacaacaacttcagccggtcagcgacgccagtacttcctgggtggtgggtatcgatcagacgcttgtggatatcgaagcgaaagtggatgacgcgtttgttgaacgttatggtctgagcgccggacattcgctggtgatcagcgatgaagtagcggaagcgttgtatcaggagctgatgcgcgacaccctcatcacgcaccagtttgccggcggcaccatcggcaacaccatgcacaactattcggtgctggcggatgaccgctcggtgctgttgggcgtaatgtgcagcaacgtcgagattggcggctacgcttaccgctacctgtgcaacacctccagccgtaccgatctgaactaccttcagggcgttgatggcccgatagggcgctgctttacgctggtgagcgactccggcgagcgaacctttgcaatcagccctggcgcgatgaaccagctgcgcccggaaagcattccggaagcggtgatagccggtgcctcggcgctggtgctgacttcctacctggtgcgctgcaaaccggacgagccgatgcgcgacgcgaccatgaaagccgtcgagtacgccaaaaagcataacgtgccggtggtactgacgctgggcaccaaatacgttatcgccgataacccgcagtggtggcgtgatttcctgaaagagaatgtctcgatcctcgccatgaacgaagaggaagcggaagcgctgaccggcgagagcgatccgctgctggcctgtaacagcgcgctggactgggtggatctggtgctgtgcaccgccggaccggtcggtttatatatggcaggcttcacggaagagcaggcgaaacgcaaaactcagcacccgctgttgccgggcgctatcccggaattcaaccagtatgagttcagccgcgccatgcgtcatcaggactgccagcagccgctgcgcattttctcccacatcgcgccttacatgggcggcccggagaaaatcatgaacaccaatggcgcaggggatggcgcgctggcagcgctgctgcacgacatcaccgccaataacttccatcgcactaacgtgccgaactccagtaagcataactacacctggctcagctactcatcgctggcgcagatgtgcaaatacgccaaccgtgtgagctatcaggtgcttaaccagcattcgccacgtctgacccgcggtctgccggagcgtgaagacagcctcgaagaagcctactgggagcgctgatttcgtgatgacaggccggacaggatattgagccctgtccggcaacctcactttatcccgtcaccacctcgcccgcaggcggcgtttccagcagttccagcatggtgcgggcgatttcacgctcgcccatcaccacctgattagcaccgcgttcggtgatgtaatccacctcatcgtcataatgcgcgcgggcgataatctcaatattcgggcacttctcccgcgccgaggccacgatttccccggcttcatagccgttcgggatcgtcagcagcagccagcgggcgcagtcgagatgcgccagattcatgatctcttcgttggcggcgttgccgagcaccgcgcggataccccgctcgcgcagctcatcgacgcgggagcgggaggtttcgatcaccaccagcggaataccctgcgccatcagcttttcacccagcaggctgccgacgcggccaaagcccaccagcagcgcatgattacaaatgtccaccgggatctgcttctcttcttcgatggcttcttccagcgtctgctcttccagggtttcggttttatcaaggtatttttcaaggatggcgaacaggatcgggttcagcataatcgacaggatcgccccggccagcaccaggttctgcccggtctgcggcagtaaatccagcgccatccccagcccggcgagaataaaggcaaactcaccgatctgcgcgaggctggcggcaatggtcagcgccgtgcggggcgagtgaccgaacaggcgcaccaggaagaaggcggccacggatttaccgaagataataattgccagcgtgccgagaacggccagcggttcatcgatgaggatcagcggatcgaacagcatgcccaccgagacaaagaacagtaccgcgaaggcgtcgcgcagcggcagggtatcgtgcgccgcccggtggctcagttcggattcgttcagcaccataccggcgaagaacgcgccgagggcaaaggaaacgtcgaacagctccaccgcgccaaaagcaatgccgagcgccagcgccagcaccgaaagcgtaaagagttcccgcgatccggtcgccgcgctgcgtgcgaggatccacggcaccagacggcggcccaccagcatcatgatggcgataaaggccaccaccttaccgatggtgatactcatatccagcgccagggtggcgaggccgacattgcctttttccatcatgcccgccaccgcaggcagcagcaccagcgtcagcaccatcactaaatcttcaacgatcagccagccaatggcgatttgcccgcgctgactgtcgataagctgccgctcctcaagggcgcgcagcagcaccaccgtactggcggtggaaagacacaaaccaaacacgataccggtcatcagtgaccagcccatcagagacgagagcgccatgcccagcagggttgccaccgcaatctgtgcgatagcgccgggtatggcgatggactttaccgccatcagatccttcagcgaaaaatgcagtcctacgccaaacatcagcaggatcacgcccagctcggccagttcaggcgccagtttggtatcggcaacgaagcccggggtaaagggtccggctaacacacccgccagcaaatagcccaccagtggcgaaatgcgtaatttgttggcaagcatgccgaggataaaagcgagcacaaggccgccgacaatggtggtgataagcggtgtggcgtgatgcatcccatctcctttcgtgaaggtgtgtatccatttttggtcgaaaaccaaaagcccgaattacagtttatgacaattttaaccattatgttgatgaataattgttgaattctgaagaaaagagcaacctgtgctaaaaaatcgggcatcagccaggatctgaaaggagaggggctggcgggcagatggggcgggagaatcgggcgaccacccacacggtttggtcgcccgtaaattacgctttctgccggttatcgggcaggaatatcgttaagatccccagtaatggcaggaaagcacagattttataaaccaaaaagatactggtatggtcggcaaccagccccagcacagcggcgccaaggcctcccatgccaaaagcaaagccgaagaacagaccggaaaccatgccaatccgccccggaagcagctcctgggcatagaccaggatggcggaaaacgccgacgcgagaataaagccaatgatcaccgttaaaatgccggtccagtacagagatgcatagggtaaaacaagggtaaagggcgcaacgccgaggatcgagccccaaatcacatatttacggccaatcttatccccgagagggccgccaatcatggtgccagcggccacagcaaacagaaacgcaaacagatgatactgggcgttttgcaccgataaaccaaatttttccatcaaataaaaggtgtaatagctgctgatgctcgccatatagaaatatttcgaaaaaatcagcatcagcaggatggaaacggcgaggatcaccttattgcgcggtagcggattgattactttcaccgccggtttgcctttattgacgcgatgctgcgccgcataccagcggctgacctgcgccagcaccacgatcgccagcagcgcagccagcacgaaccaggcaacgttgcctttgccgtaaggggcgatcactaacgccgccagcaaagggccaagtgaactgccgaagttgccgcccacctgaaacagggactgcgccaggccatgacgtccaccggaggccatgcgcgccacgcgggatgactccgggtggaacactgacgatcctgtgcccaccagcgcggccgccagcagcaccatgccgaaactgcccgccagtgccagcagcaccagcccgctcagcgtaaagcacatgccaatcggcaatgaccacggcattgggtgtttatcggtataagcaccgaccaccggttgcagcagcgacgaggccatctggaaggtcagggtgatcagaccgatttgcacgaaagtgagggaaaactcagactgtaacagggggtaaatcgccagaatcagcgattgcagcatatcgttaagcagatgagagacgctgatcgcccccagaatgccaaacgaggtgcgcgcctgcggcgacgcaggcgatcccgacaaggccggggcgggttcacttattgccataaaattcacttctttttaatggtggaaggggcaggtgtttatcataaagatgactaataattatctgcctaacatacctgcccgaaaggtttgaaggaagtcgcaattctgaaaacttatttgtctaatattgccgggcacgctactttttgcgtctgttaaggatcagggagagaagcatgaaatttgtaaagcagggcatcgcgctggcaatgctggcggcactggggctgacgactttaccggctcaggcctacgaaaaagataaaacctataaaatcaccattctgcataccaacgatcatcacggccatttctggcgtaacgattaccgtgaatatggtctggcggcgcaaaaaacgctggtggacggtattcgcaaagaggtggcggcagagggcggcagcgtgctgctgctctccggcggcgatatcaataccggcgtgccggaatccgatctgcaggacgccgaacccgattttcgcggcatgaatctgattggttatgacgcgatggccgtcggcaaccacgagtttgataacccgctcagcgtgctgcgccagcaggaaaagtgggcgaaattcccgttcctctccgccaatatttatcagaaaagcaccaacgaacgactgttcaagccctgggcgattttcaaacgccaggacttaaaaattgcggtcatcggcctgaccaccgatgacacggcaaaaatcggcaatcccgagtatttcaccgacattgaattccgcaaaccggcggaagaagcgaagctggtcattcaggagctgaatgccaacgagaagccggacatcctgatcgccaccacgcatatgggccattacgataatggcgagcacggctctaatgcggcaggggatgtggaaatggcacgcagcctgccgacgggcgcgctgacgatgattgtcggggggcactcgcaaaacccggtatgcatggcgtcggaaaacaaaaaacaagtggattacgtgccagggacgccctgcgcgccggatcgccagaatggtatctggatcgtacaggcccatgagtggggaaaatatgtcggacgggctgattttgaattccgcaacggcgagatgaaaatggtgcgttaccagctgatcccggtcaacctgaagaaaaaagtgacctatgataacggcgacagtgaacgcgtgctctacacgccggaaatcccggaaaacgcccagatgctctccctgctgacgccgttccagaacaaaggcaaagcccagctggatgtgaaaattggtaacgtgaacgcgcacctggaaggcgatcgcagcaaagtgcgttttgtgcagaccaacctggcgcatctgatccttgcggcgcaaatggcgcgcaacactgccgatttcgcggtgatgagcggcggcggtattcgggattccattgaggccggggacatcacctacaaagacgtgctgaaagtgcagccctttggcaacatcgtggtctacgtcgacatgagcggcaaagaggtgaaagagtacctgagcgccgtggcgaagatgaaaccagattccggcgcttatccgcagtttgctaacgtcagcttcacttctgcgaacggccagcttaacgatctcaaaatcaagggcgaaccggtggatgacgccaaaacctaccgcatggcgacgctgagctttaacgccaccggtggcgatggctacccgcgcattgatgaaaagccgggctatgtaaataccggctttattgacgcggaagtgctcaagcagtttatccagcagaattcaccgctggatgccgcgacctttgagccgaaaggcgaggtggtctggcagtaaccctttctcttgccctctccctggggagagggccggggtgaggggcctactcgcggcgggcaatatcggcgaatttcgcatcaaggatcttcgcaagatccgccgccgccagctcaatatccagcccgcgtttgccgcccgacacataaatggtggcaaactgctgcgccggggcgtcgatcagcgtcggcagacgctttttctgccctaacggactgatgccgcccaccaggtatcccgtagtgcgttgcgccaccatcggatcggccatatccactttcttcgcgcccagcgccttcgccactttcttcagatccagctgtccggccaccggcgtgacggcgacggctaactgcttcatgtcgccgtttatcgccaccaaaagcgttttataaacctgatcggcattcaggccgagcttacgcaccacttcatcgccaaaattcgtttcgctgggatcgtgatcgtaagtgtgaagctgaaaagtaaccttgtttttttccagtaatttaacggcgggtgtcataaaaatccttcttaccactgaggtatcacacagccagcatacgccgggcaaggggcgcaaaaatagtaccatcttgcgcaatagtgttggcagttgcgctaactttgagcgacaattagcgcgcactggcgttaacgccagaactacaataatgatgaaattcctctttgacgggccaatataattattggccatttttttgccgcaacagcgtcggcaagttcccctctccgtacagatgcagcgcgcccgcggctaccacataatgccccggcggcaacgcctgcaaatgctcacaccatgcctgattacgctgatgcatcaggatctcatacagcggctcgctgaaggtcgacggcagcgcgatgtcccgatccgtgggcggtttgttcatccaccagccaatcatcacctgcaacagccgggcattggtgtgccagtgctccagcgtatccagcagcagggctttaccgtcgtcgggcaactgactcagcagatcgatttgattctgcgtcccttccagttccatcaccggaagcgccgcctgttttgccgcctgcaacagctgataatcaatgccgaaatccggacgcaggcccagccgctgcgcctgggtagcctgcaacaccagcgcgattttccacgcgggctgatcgtcaaagatgtcaggggcaagggataaggtttgtagcagcgtttcaagatcgcgctgttccgcgtccgtcagccgttccgccagcggcgcgcgcggcggaagatcgttgaagggcgaggcctggccggagacatcggcctcgacaatcagcgccgtcgcctgctgaagctttttcagcaagccagcgggcaggggggtcatgtcgcgcgtacccatatgaatactgccgaccagatgaagatgacgcccgccgggcagcgtcaaatctatcgcgggccacggataacggggggcccgcagtgcgtcaaaccaaacttttaaccggctaaacaggttcatacaggctcccgcaaaagaaaggaccatgctagcgcgcgaggaaggtgggtgcaaatcggctaacggcgaccctcccgcaggaaggccgccggtgcggatcaggctttaggtttgtagcgcaacaggcggttggcgttgctcaccacggtgatggatgacagcgccatcgccgcgcccgccactaccgggcttaacagcgagccggtaagcggccacagcacccctgcggcaatgggaatgcccagcgagttatagataaaggcccccagcaggttctgcttcatattgcgcagcgtcgctttcgaaatatccagcgcatccgccacgcccgtcaggctgtgacgcatcagggtgatagccgccgtttcgatggcgacatcgctgccgccgcccatggcgatccccacttccgcctgcgccagcgccggtgcatcattaatgccgtcgccgatcatcgccacctgacggccttcctgctgcaatttcttaatcgcatcggctttgccgtccggcagtaccccggcgattacctcatcgattccggcttcctgcgcaatggctttcgcggttaccgggttatcgccggtgagcatcaccagccggtagccggcctgatgcagacgcgccagcgcgctcacgctgtcggaacgcagcggatcgcggattgccagcagcgccacggcggtgccgtccaccgccaacagcaccggcgtcgcgccctgcgccgcccgggcggcaatcgcctcgtcaagcgcgcgggtatcaacgtgctgttgattaagcagcgcctggttgcccagcaacagcgcgtgattatccaccatgccgctgacccccagcccgccgagggtacggaaatcccgcacctccggcagctcgtcgtcagcggctttttcgacgattgcgcgggccagcggatggccggatccctgctccagcgccgccgccagccgcagcacctcgcgttcttgataagcgccggtcagggtgacggcgaccacctgcggtttgccttccgtcagcgtgccggtcttgtcaaagaccagtgtatccacctggctgccgcgttgcagcgcatcggcatcgcgcaccagcacgccatattcagcagcgcgcccgacgccggagataatcgacatcggcgtggccagccccagcgcgcacggacaggcgatgatcagcaccgtggtgacgatcaccagggtataaacaatttgcggcgcggggccgaagaaataccagatcgcgccgctgaacagggcaatggcgaccaccaccggcacaaaaatggccgagattttatccgccagctgaccgatttccggcttgctgctctgcgcctggcgcaccatgcggataatgcgcgacagggtggtgtggctgccgacggcgctggctttgaacagcacgctgccatcggtcattactgtcccggcgtgaaccgcatcgccctggcttttttgcagcggcaccggttcgccggtaagcatcgcctcatccagccaggcttcgccctggacgatctcgccgtcgaccggcacgcgatcgccggtggtcaggcgcaggatcatgcccggctgcacctccgccagcggcagggttttctcacccgcgtcggtgaccacgcgcgccgagggtggcgttaagtcgagcagacgttccagcgcttttgacgagcgcgcccgcgcccgtgcttccagcatatgcccgaggttaatcaggccgatgatcatcgcgctggcttcataatagaggtggcgggcttccatcgggaaggcgtgcggccaaaggttgacgctgatggaatagagccaggccacgcccgtccccagcgcgacaagggtatccatggtggcagtgcggttcagcaggcttttccaggcgctgcggtaaaaatgcccgcccgcgaacaccatcacggcgagagtgatagcgccgatcaccagccacagggtgcggttagcatcggtgaccatcatattgtcacccgtcatgccccacagcatcaccggaatacccaccagcagcgcgacaatggcctgccagcggaaacgttttaaggtcgcaagggcggtttcctgttggcgctcgcggcgcttcacatcatcttcgatgatctccgcgccgtagccggcattttccaccgcgctcactaattcagcggcggaggcgctgcccattaccagcgcagagcgctccgccagattgacccgtgcctggctgacgcccggtaccgcctgtaaggctttttgcacgcgggagacacagctggcgcagctcatgccgcttaacagcaactgctggctgtcttgcaggtcatccgctgccggaagctcaggttgcgccgctgtcagtgcttccgacgggagtgatgactctgccagcggtttagcctttgggtattcggggctcgcgtcgtacccggcttgtttaatggtatcgataagctccgccgcgctggcgctgccggtcacgtcggcatgggtcagcgtcacttccgcctgttcaacgtcagggcgctgctccagactttctttaacacgtttcacgcagtggccacaggtgaggccatcaagcgctaaagcgatggtttgcgacataattaaactcctgtaatttcggttgaaccaatacacacattgattacagttataaaggttaaaccttccatcaaggggaaggtcaagggggaaagatgaatatcagcgatgtggcgaaaaaaaccggcttaaccagcaaagcgatccgtttttatgaggaaaaagggctggtgacgccgccgttgcgcagtgacaacggttaccggcactacacgcaaaaacatctcgatgagctgacgctgctgcgtcaggcgcggcaggtaggatttaatcttgaggagtgcggcgagctggtggggctgtttaacgatcctgcgcgtcacagcgctgatgtgaaagcgcgcacgctgcaaaaagtggcggagattgagcgccacattgttgagctgcaatcgatgcgcgaacagttgctgacgctggcggcctcctgtccgggcgatgacagcgccgactgcccgattattgataatctctcgggctgctgccatcgcaaggcgcaggcataatcagcctgcttcccccggagaaagcgcctggcgaaaccagcgggtacgcgataacagcaaagtaaacaggccggtgcacagtagcgacgtgcccatggcaacaaagtagatcgtccagtgttccgtaaacaccgacagaaaacccggcagcccggaaatgccaatcgacggggctttcacctgatagctggcgacgatgctgcccgcgatgcctgcgccgaacatcgccgccataaagggaaagcgatagcgcagattaacgccaaagatcgccggttccgtgacgccaagccaggccgataccgcagcgattgcggccacgccctgcatctttttattgcgcaccagaaagaaaatcgtcatcgcgcccattccctgggccaggctcgccatcacctgaatcggccacagggtggtgtaccccagggtgccgatcatttgcagattcacgcctaaaaacagatgatgcatccccgttaccaccagcggcgacaggatagcggcgaaaaccccgcccgccagcccaggcgcgacgtcaaacaaccacaaaatgctgccggtcatgccatttcccagcagcatggtcagcggaccaatcactaaaaatgccgcaaagccggtgaccagcagggtcacgggcgcgacgataatcacctgcaccatatccggaaccacgcgcgccagtaaacgctcagtacgcgccagtaaccaggcgcaaagcagtacggtgatcacctgcccctgataggccacttttttcagttccaggcccataatcgaccagtactgcacctgatccggcgtttttgagaactgctgggcgctcattaaatccgggtggatgagcagcagaccaagcacaatccccagcaccggattaccgccgaattttttcactgccgaccagccaatcagcgcaggcaaaaacagaaaagaggtgttggcgataagattaataatgccggacacgccctgccaggagggataatgttttatcagcgcatcatcaaaaaacagccccggattaaccagaatattattcagccccagtaatagcccggaggcgacaatcgctggcaggaccggaataaatatatcggcaagagtctttatcagttgctgtaaaaggttgccgcgtttttcggatggtttttgggaagggactggagtatttccgcgctgccgggaaatttcctcataaaccttatcaaccagcccggggccgataataatctgaaattgcccgttagcgttaaaacaacctttaactaaatcattgctttccagttcctgaatattaatacacttctcatcatgcagtaccagccgcaatcgcgtcaggcaatgtcccattgaaatgatattattactcccgccaataagtgtaagcagcgaactggcgttatcctccagcgttcctttcatgattttcgtcctgaagtatcgggtgccgctccggataattacacgcgcttttttatactgtcaatacacttaatttattgattttatgaatatattgtttataagttatccgtgctattcgccgttgtttttctggacagaaaccgggcgtagtgccacgatggacgcgatattcttcgcaaatggaattccgatgatgcagcccaatattttgctgatgatttcccatgacagcggacgtaaatttcagaactacggttatcgggtggcaacgccgcatattaatgccctggcgcaacgcggcctgcaatttgacaattgttattgtccagccccgcaatgcagccccagcaggggcgcgttattaaccgggttatacccacataataatggcctcatcgggcttgcgcatctcggtttttgtatttcagagggtgtaactactttaccaaaagaattacaaaaaaacggctattatacggcgctgatcgggctcagtcatgaaaccattaataacgcgccgccggtcgcggaacgcatattctcctctaccaccgcgcttggctacgatgactatatcccggtgcccggcgagcgcgcgtcacaggttgccgattcggtgatcgattttctcctccgccatcagcatgacgatcgcccgttttatcttaacgccggtttttttgaaacccaccgcgatttcgatgaatatcagccagttgcagatcggcctgacgaggtggaggtattcgattttctgccggatgtggatgccgttcgccaggatatcgccctgtttaacggcgcgttaaagatgctggacagtgctgtggggcgtatttgcgcggcgctggatgcaacgggactgggcgataacaccatagtggtgttcaccaccgatcatggcgtcgcctttccgctggcgaaaggcaccttaaaaacggcggggctggagacggcgctgattatcgtgctgccgggcaaagcggctgtcaccggccgtcggcaggcgctgttgtgcaatatcgatctgatgcccaccttgcttgaacttattggcgcagcctgtccccacgggcttgatggcaaaagttttgcttcgcttttgcacagcccgtgcgacgaagggcgggagtcgttctttaccgagctgacctggcacgacaaataccaccctatgcgcggcgtgcgtaccgcccgctacagctacgtcaaaaattttgccgacgggccgctggtctatattcccgttgatgcgcatctgagtctgtctgggcttgcggtgcgggagcggctgtacgtgcctaacgagccggaggagctatacgatctgcatctggatccgctggagaaaaataatcttatcgctcatcctgactatcaggccatcgccgcccggctgcgtgagcgcgtggcaaactggatgcgtgaaaccgacgatccgttgcttagcggtccggtgaaaggcgttgagtcacggcgctgggcgcaggagatcgccgccggtcgggcgtatccgggacgggaaaagtggcagaagcagatgaaaagcccggaggacgatgaccgcaccgggtaaaggggcggccatcgggggaagggatcagcgggcgcatatccgcagcgtgatcccctcaacggctaccaccaccaccggcgtcccggcaggcagatcctcatcggcgctcaccggccaggagctgtcgcccacccgcatgtgtccgcggccattcaccagccccgtttccagcgtaaagcgacggcccaccagctgaacgccccgctgattcagcgcggcatcggcaggtttttgttctttcacccgccgcgccagccagcgccaccacagccaggcggccagcatggtcagcagggaaaacatcaccccctgccactcccagccaaagggcagcagccagaccacaaggcctgtcaccaccgcggccacgccgctccacagcagataaccgttgccgccgagcatttcagccgctagcaggatcccgccgaggcttaaccagaaaatgtgcggatgcgcgagcaggatgtccatggctatttcttccgcgcagtggcgctgtcgctgagcagttctgaaatcccggcgatggatcccatcaggctgctggcgtccagcggcatcatgatcactttgctgttattggacgagccgatatgttgcagcgcttcggtatatttttgcgccacaaagtagttcaccgcctgaatatccccggcggcaatcgcctgagacaccatcttggtcgcctcggcttccgcttccgccgaacgctcgcgcgcttcagcctgcaggaaggcggactgccgctcgccttccgctttcaggatcttcgattgcttctcaccttcggctttcacaatctctgcctggcgaataccttcggcttcgagaatataggcgcgcttggtacgttccgctttcatctgcgcgttcatggcgtcaatcagttccgctggcgggcgcacatcgcggatctcaatacgggtgatcttaataccccacggattcgtcgcttcatcgacaatatgcaacaggcgggtgttaatgttatcgcgctgcgacagcatttcatccagctccatggagcccagcacagtacggatattggtcatcgtcaggttgatgatcgccagctccagattgctcacctcataggcggctttcggcgcgtcgatcacctgaataaagcacaccgcatcaatggatacgttggcgttatctttggagatcacttcctgggacgggatgtcgagcacctgctccatcatattgattttacggccaatgcggtccataaaaggtaccaccaggctcagccccggttgcagggtgtgggtgtaacgcccgaagcgttcgacggtccactgataaccctgcggcacgattttcacccccgcgccgaccaccaccagagcaacaaagataagaatagggataacgataagcataaaacctcctgttattaaatccgtgggtattgaattacatccatttcattgcgggtaagtataacttttatcgccatcaggcacccctgttaatcctgagggtgaaaaagggcgggaatgaaatcaaaagatgcggacgctttatgcaacaggataagaccgcacggcaagtacggaatatgacttttcagactaagtggtaacccgcaggctggcacaataccactgcactccgtaggccgggcaagcctgcgccgcccggcgaaacccatgtcagtacagcaaagaatacagcttacggcgatatttcgacgccagcgcatcacccgtgccaagcgctgccaggatctcctgcaacatcttacgcgcctggccgtcggcggcattcagatccttgctcagatggctgaacagcaactccagcgcttcttcattgcggcccacctgatgcagttgcagcgccagctgcgtggcgagcgttgcgtttgccggatcgatttccacctgctgttgcagcagctggatctccggcgtatccgccgcctgtttcagcagatcgatctgcgccaccagcccctgatagcgggtatcctgatcctgcatcgggatggttttcagcaccgcttccgcatcctcggagcggttaagggcgatttgcgtttccgccagcagcagaccaatttcgctcgcctgatttgaaagctgccaggcctcttttaacagaggcagggcatcagcatagttgccttcttcgatcagctgcattgcctgctgcgctttcagctcttcttcacgcggcagcactttttccagcagcgcgcggatggcttcttccggctgcggcccctggaaaccatccaccggctggccgttctggaacaggtaaacggtcgggatggcgcgcaggccaaactgcgaggccaccatctgctcggcgtcgcaatcgaccttcgccagcaggaactgcccgttatactgcgccgccagcgactccagcaccggcgtcagttgctgacaatgctggctacgctcggaccagaaatagaataacaccggcgtggcgacagactgctccagcgtttgctgtaggttcgcttcggtaacattgacaatattttgtacggacataacgttttctctgttttcgcgtttatctttacatggggtcaggcgtggagccttcaactcagccgcgtaaaattttatccatcagacgatccggtaacaggcgttttaatacccttaccgcatgggtgaccagcgtcaccggataacgtacttttggccgcttactctcaaaagcatggcgcactttggcgaccactgcctccgggccgagggtaaaacgtgcggcgatacccggattttccaccggcttgtcgctggtctgattgacgtttttcgtaaagcgggtgcggatgggaccaggttcaatcaggctcaccttaatgcccgtgtgccgcagctccatacgcagcgcatccgaccaggcttccagcgcatatttactggcggcataggccccgcgaccgggcgtggagatcagccccatcactgatgacgtcatcacgatacggccctcaccgtgggggatcatcgcgggcagcaggcgcatagtgagctggtgcgcgccaaaaaagttggcggaaaactgctgctccatctgctcgcgggacacggtattaagcgcgccatagaccccgtaacccgcattattaaagaggccgtacagacggttttcggtgcgcgcaattacctcatcggccgcgcgatccacactttccggcgagtccagatccagtaaaatgccggtaaaacccatcgcattcatccgcgatacgtcatcgggtttgcggcaggcggcaaggatatgaaatccctggcgcttcatctctactgccgtttccagaccaattccgctggaacatcctgtaattaagaccgatttttgcataactttacccgtcggctttcccgattatttatgaggcgtggtttactaaaggtgccaggcgtgtcgccatccagtcggcgataaacggctgggcgtcagggttaggatgaataccatcgtcctgcatccactgcggtttcagatagacctcttccataaagaagggcaccagaggaatatcgaactcgctggcaagtttgggatagatggcgctgaacgtctcagtgtagcgacggccatagttcgccggcagacggatttgcatcagcagcggttgcgcgtcggcggcttttatttcctgcaaaattttacgcagcgtggcttcggtctgcgccggtgcgaaaccccgcaggccgtcattgccgcccagttccaccagtacccagcgcggctgatgctttttcagcagggcgggcagacgcgccagcccctgctgcgaggtatcgccgcttatactggcattaactaccggcgtcttctgctgccatttatcgttgagcagcgccggccaggccgccgttgccgccatgcgatacccggcgctcaggctgtcacccagaaccaacaacgtgtccgccgcggcggcgcgacaggttaacagaagcataaaaaggaagggcaaatgccagcggaaaacattgttgaagttcatcatcttaagaagtccgtcggtcagggggaacatgagctgtccatcctcaccggagttgagctggttgtcaaacccgcgcagaccatcgcgctgattggcgaatccggatccggcaagtccacactgctggcgatcctcgccgggctggatgatggcagtagcggtgaggtgcacctgctggggcagccattgcacagtatggatgaagaagcgcgggcagccctgcgcgcgcagaacgtcggctttgtctttcagtcctttatgttgatcccaacgctgaacgcgctggaaaacgtcgagctcccggcgctgttgcgcggcgaaaagagcagccagagccgggaaaatgcccgcgcgctgttaagcgaactggggctggcgaagcgtcttgatcaccttccggcgcagctttccggcggcgaacagcagcgcgtggcgctggcgcgcgcctttaacgggcgtcccggcgtgctctttgctgatgaacccaccggcaacctcgatcgccagaccggggataaaatcgccgatctgctgttttccatgaaccagcagtacggcactacgctgatcctcgtcacccacgatccacagctcgctgcccgttgcgatcgtcgtttgcggctggttaacggcctgctgcaggaggaagcatgatcgcccgctggttctggcgcgaatggcgctcgccatcgcttttgatcgtctggatggcgctgagtctcgccgtcgcctgcgtgctggcgctcggcaacatcagcgaccgcatggagaaaggcttaagccagcagagccgcgactttatggcgggcgaccgcgcgctgcgcagttcccgggagatccccgacgcctggctggatgaagcgcgtaagcttggcctgaaagtcggcacgcaaatcagctttgccaccatgacctttgccgatgacacgccgcagctggcgaacgtcaaggcggttgatgacatctacccgatgtacggcgagctggaaacccgcccggctggcgtaaagccgcagccgggaagcgtgctgcttgcgccgcgtctgatggcgctgctgaaactgaaaaccggcgatgaaatcgatgtcggcgatgcccgtttacgtattgccggggaggtgatccaggagccggatgccggtttcaatcccttccagatggcgccgcgcctgctgatgaacgtggcggatgtggcgaaaaccggcgcggtgcagcccggcagccgcgtcacctggcgcatcaagtttggcggcacggccgcgcagctggaagcctacgagaaatggctgctgccgcagttaaagccggagcacaaatggtacggccttgagcaggatgaaggggcgctcggcaaatcccttgagcgctcgcagcagttcctgttgctgtcggcattgctgacgctgctgctggcggttgccgccgtagcggtggcgatggggcattactgccgcagccgctacgatctggtggcgatcctcaaaaccctcggtgcggggcgcgcccagctgcgcaagctgatcgtcggccagtggctgatggtgctggggctgtcagtcattacaggcggcgccatcggcctggtgtttgaacgggtgctgatgatcctgctcaaacctgtgctgcccgccgcgctgccgcctgccagcctgtggccgtggttgtgggcggtgggcaccatggtggtgatctccctgctggtagggctgcgtccgtatcgtttgttactggcaacgcagccgctacgcgtgttgcgccgcgatgcggtggccagcgtctggccgctgaagttttatattccggctattagtatcgtcaccgtcctgctgctggcctggctgatgggcggcagcatgctgctgtgggcggtgctggccggggcggtggtgctggcggcgctgtgcgggctgctcggctggatgctgcttaacgtgctaaaacgcctgacgctgaaagcgctgccgctgcgcctcgcggtgaatcgcctgctgcgccagccctggtccaccttaagccagctgtcggccttctcgctgtcatttatgctgctggcgatgctgctggtgctcagaggcgatctgcttgaccgctggcagcaacagctgccgccggaaagcccgaactatttcctgatcaacattgcttctgagcaggtcacgccgctgaaagggtttctctcggaacatcaggtgatcccggaatccttctatcccattgtaagggcgcggctgacgcagattaacggcacatccacggacggcaatcaggatgaagccttaaaccgcgagcttaacctgacctggcagtcgcaaaaaccggatcacaacccgatcaccgcaggcagctggccgccgaaaaccggggaagtgtcgatggagcaggagctggcgaaacggctgaatatttcgctgggcgacagcgtgacctttatgggcgatacccaggatttcaccgccagagttaccagcctgcgtaaagtggactgggaaagcctgcggcctaacttctacttcatcttcccgcctggcgcgctggacggacagccgcaaagctggctgaccagtttccgctgggaaaacggcaacgagatgctgacgcagcttaaccgcgaattcccgacggtcagcctgctggatatcggcgcgatcctgcaacaggtcggtcaggtgctgcaacaggtgagccgcgcgcttgaagtgatggtggtgctggtgaccgggtgcggcgtgctgctgttgctggcgcaggtgcaggtaggaatgcgtcagcgtcatcaggagctggtggtctaccgcacccttggcgcgggcaaaaaactgctgcgtaccacgctgtggtgcgagtttgcgctgctcggttttgtctccgggctggtggccgccatcggtgcggaaacggcgctggcagttctgcagacgcgtgtgttcgacttcccgtgggagccggactggcggctgtggctggtgctgccgctttccggcgcgctgctgctgtcactgtgcggcggctggcttggcacacggctgctgaagggcaaagcgctgttccgtcagttcagcggttgattctctctgcccctctccctgcgggagggggcatcgtccatcgctccccctctccctgcaggagggggccggggtgagggcattgacgatcccctgtcattcagtgacatactcagtagcatcatgaaatattttcaattactgccgcgccgcctttatgccatcttaaaccgtcaaattctgaatgcgccgcgtagcacggtgcgtcacacagcacatatcacattgatcaggagaaattatgggacgtcgtttcagcgtgcgcgccgccgtcggggcattactgttaacctgcgggcttgcacaggccagcgatccacaaaccatcaccttcggcgtggccccaggcccctatggtgacatggtaaaacaggccatagcgccgtcgctgaaagaaaaaggctacaaagtggtagtgcgcgaattcagcgactacgtacagccgaacatggcgctgtccaacggcagcattgacgccaacctgttccagcactcgctctatttcaacaaattcgttgccgataaaaacctcaagctgacgaagctgattaacgtgccgactgccggcatgggcttttactcgcacaaaatcaaaagcctggatgagctgaaaaagggggatatcgttaccctgtctaacgatcccaccaacctggcgcgcggcctgcgtttcctgcaatccctcggtcttatcaccattaaagacaatatcgatccgaccaaagcttccgagcgcgatatcgccagcaacccgaaagggctggtgttcaaaccgctggaagccgctcagctaccgcgtaccctcgacagcgccaccgccgccctggtcaacggcaactttgctatcgccgcgggcatgaaactggactcggcgctgaagcaggaacagctggatgataatctgaaaaatatcatcgccgtacgtagcgaagacgccgaaaaacccttcgcgaaagacattgttgcagtagtcaaatctccggcttaccgcgcggtgatcgactcgccagacaacgtctacagcgcgttccagaaacctgaatggatggttgctgcggataaaaaataagcggcacacaggattaattctggcaggctgcggcctgccttttgcatttcgaggacggcatgattgagatagataaggtctgcgtggactttcccgcaggccgtggcccgacgacccgggcggtggacgacgtcagcctgcgcattgcgccgggcgaaatttttggcattgtcggcaccagcggcgcgggcaaaagcaccttattgcgcaccctgaacgcgctccagcgtccctcgcagggcagcatcaaaattaatggcgtcgagatatccgcgctggaaggcgtcaccctgcgccgcgcgcggcaacgtatcggcatgatcttccagcattttaacctgatgcacacccgtaccgtggcgcagaacgtcgccttcagcctgaaagcggcaggctgggagcgggcgaaaatcgccccgcgcgtggcggaaattcttgagctggtagggctggcggataaagcgaatcgctacccggtacagctctccggcgggcagaaacagcgcgtcggtattgcccgcgctattgccaatcacccggacgtgctgctgtgcgatgagccgacctccgcgctggatctggaaacctccgccaccattctggcgctgttaaagcagattaatgacaccctcggcatcaccattgtgctgatcacccacgaaatgaacgttatcaaaaccatctgcgatcgcgtggcggtaatgtccggcggcaaagtggtggagatgggcgaggtgtttgatatttttgcccacccgcagcacgcgttcacgcagcagttggtgtctcacaccctgaacctgacgctgccggaacgtctgcaacagcatctgccggggcagttgctgaagatcctgtttattggcgattcggcggagcagccggtgttgtccgacgcggcgatccagtttggcgtggcggtgaacatcctgcacggcaaaatcgaatacctcggcgagcgggcgctcggcattctggtcgtgcagctcaccgctcccgataacccgacggcggtggacgccgccgttgattatattcgcaaccgtacggcacgcgtggaggtgatccgtggatgagttattaccggatttgatgctggcgtttaatgaaaccttccagatgttgagcatttcgacggtgctggcgatagtcggggggttaccgctgggctttctgattttcgtcaccgatcggcacctgttctggcaaaatcgcggcgtttatctcatcagttccgtactggtgaacatcatccgctcggtgccctttgtgatcctgctggtcctgctgctgccgctaacgcagtttctgctcggcaacaccatcgggccgattgccgcctccgtaccgctgtcggtggccgccattgctttctatgcgcggctggtggacggcgcgctgcgggaagtggataagggcattatcgaggcggcggaagcctttggcgccagcccgatgcgtatcatctgcaccgtactgctgccggaggccagcgccgggttgctgcgcggcctcaccatcacgctggtcagcctgattggctactcggcgatggcggggatcgtcggcggcggtggcgtgggggatctggcgatccgctatggctactaccgctacgaaacccaggtgatggtggtgacggtgatcgcgctgattattctggtgcaggtggtgcagatgctgggcgactggctggccgcgcgggcggacaagcggggccgccactgattacccctgtagcagccagccgttgacctcctgccatgagccgcgaaagacgatcttcgcggctttcttttccagctgatagcggtacatcggatcgtaatactccttcagtaacggcaccagccaggcattatgaccttgcgtgtcgccgtgctgccgctggctcgccagcgccgtatcaaggtgcgcgctgagttcggcaaagcgctgcaagcccagacggcgacgaatggcgtacagcccgtgatgcaggtattccgcataggccagccagcccgcgtcttcgccgtacgtcacggtaaaatcgcgctgcatccgcacaaaatattcctcatgcagacgcgccacccgcaggtcgaacggatcctccaccaccgcgatgggcgactgcgccatgcgatcccgcaggcactccggcagatgattagcgccgatcatacggccttcatcttccagcacccagcgcgccgcatcccgcttaagcagtttcaccgccagggcgttctcaaagctcgcctgggaaagttgcggcctgagcgtgcggccaaatgacgaaccgcgatggcgggccagaccttccagatcgatgccgtccgcatgctggcgtaccagatccgtttttccgctgccggtgcagccgccgatcagcaccagcggacgctgtacgcgctgctctgttgcctggatcgccgcctggcgcagcgccttatagccgccggggatgagcggataatcaatgcccgcctcgcgcagccactgttgggtgatatgagagcgctggccgccacgggcgcagcacagatagccatcaggatggcgcaggcaggcatcacgccaggcctgtatgcgctgctcgcgcgcgacgccggataccagttgatgcccgagcttcagcgcggcttccgggccctggcgtttataacaggtgccgaccgccgcgcgctcttcgtcgttcatcaggggaagattgagcgccgacggcattgcaccctgggtaaattcaaccggggcgcgcacgtccagcaggggcgtatcagcggcgaggatcgcgcaataatccatgccagtgttcatgggacttccttctgcacatcaaagggcgacgttttacgtcagatcgccgtattttacgctttcatttgtgcggtggggaaaaaattgcggggctgtgttgccgggtggcggctgcgccttacccggcctacgggggggactttgtaggcccgacaagcctgcgccgccgggcgatagcgctacgctaatttcgactgcgcccaggcgataccgctggcgtattccggcggcagtagcgggagcagggcttcgagggtggcgctcaggcgatcggtgtcggcatcattgagattcagatgtccgaccttacggcccgggcgcacctctttgtcgtaccagtgcagatgcaccagcggcagcttcagccagtcataattgagatcgctgccgatcaggttgatcatcaccgacgggctgttaatcaccggttgcggcatcgccagcccggtaatggcgcgcagatgcagttcaaactggctgatggacgcgccgttctgcgtccagtgcccgctattgtgcacgcgcggggccagctcattgatcagcagtccgccaggggtgacaaagcactccatcgccatcacgccgacgtaattgagttcattcattaccgcgctgagcatggtttccgcctgcgtctgctgggcggcgttcgcctgcggaaaggccacgctggtgcgtaaaataccgtcctgatgcaggttgtgtgtcaggggataaaataccgtgctgccgtcatgcccgcgcgcgccgaccagcgatacttcgccggaaaaattaatgccctgctcaacaatgcattcaccgtagcagtcgtccggcagctgatcggtatcgtccgcacgcagacgccactggccgcgtccgtcgtaaccaccgacgcgacgtttgacgatcgccagctcgcccaggcggtcaaacacgccagaccactcatcgcggctggccagcaactgccagggggcggtggcgaggccgagggtatcgaacagctgcttttgcgtcagacggtcagcgatgatcgggaacacgtcgcggttgacgaacgccgggtgacgggccagctcgcgggtgagggcggtttccggccagcgctcgatttcagcggtgatcacgctttgcgcgaaaggcaccgcttccggctccgcatccagtcccaccggccataccgcaatccccagcggctcaccggcctggcgcagcatccggcccagctgaccgttacctaaaatacagacctgtttcatgcttcgctccgcggatccgggttatccagcacttcatccgtctggctttgtcgccactcgaccaggagctgatgcagctcgcgatcctgagtagcgaggatctgtgccgccagcagcgcggcgttggcggcaccggctttaccaatcgccagcgtgcccaccggaataccgcgcggcatctgcacgatggagtaaagactgtcgacaccgcttaacgcggcgctttgcacgggcacacccagcaccggcaccagcgttttcgccgcaatcatgcccggcagatgtgcagccccccctgcgccggcaatgatcacctgataaccgttctgctctgcgctttcggcgaagctgaacagtttgtcgggggtgcgatgggcggagaccacttcaacatggtaagaaacgtgcagaagatcgaggatttcagtggcgaactgcatggttgcccagtcgcttttggaccccatcacgatggcgatacgcgccggattattgcgggaagacatgcgccttaaaactcctgtgggtgtgcttcagactgcttttaaggccacagagaatagcatggataattagcaaggaaaacggttgcgtaacgcggtaaaggtcaaatacaggcgttttctcagaagggaaacgcgatcagttcaatcttgtcagcggttactttcaccattgagccttcactgtgccaggcacccagtacataacgacaggcgggtttaccgttggcggtcagcgcgtgaatatccgggcgatgggtatgaccgtggatcagatgctgcacctgatgcttttccatcaccttcaccaccgcctgtgggttaacgtccataatcgcctgagatttggtgcggttggcggatttgctgccggcgcgcattttcgcggcgatgcgcatgcggataaacagcggcagggcgaggaacagcttttgcagccaggcctggtgaactttggcgcgaaacgcctgatagcccgcgtcatcggtacacagggtatcgccatgcaggatcagcagccgtttaccgtacagttcaaggactttttcttccggcagcagcctcatgccgctttcccgggcaaaacgctggccgagcagaaaatcgcggttgccgtgaatgaaatacaccgggacgccggactccgccagcgctttcagcgcggcggcgatctgccggtgcaggggattgggatcgtcgtcgccgatccaggcttcaaacagatcgcccagaatgtacaacgcgtccgcttccctggctgtaccggccagaaaacgcagaaaaccggcggtgatcgccggttcttctgtttgcagatggagatctgcaataaagagtgtcgccaccgattactcgctgacggtcacgcttttaatgattacgtcttctttcggaacgtcctggtgcataccgctgcggccagtagaaacggctttgattttatcaaccacgtccatgccttccgccacttcggcgaatacgcagtaaccccagccctgcaggctttcgccgctgaagttcaggaagtcgttatcaaccacgttaatgaagaactgcgcagtcgcagagtgcggcgcctgagtacgggccatggccagcgtgccacgggtgtttttcagaccgttgttggcttcgtttttaatcgcctctttggtctctttctgcttcatacccggttcaaaaccgccgccctggatcataaagccattgatcacacggtggaaaatggtgttgtcgtaaaaaccttcgcggcagtagtcgaggaagtttttaacggtttcaggtgctttatcatcaaaggttttgattacgatatcgccgtgattagtgtggaaagtaaccattgttgcatcctgttctgtttggtaagtcgcgtagacccggcaatgggtcagagataatcgccttttatagcataaccctgaggttcgatcaccttgcaaagggtgctgcttcgctgccgaaatatggttatgataagaaagatattctccacacacgtctaaacggaatcttcgatgcttaaaatttttaataccctgacgcgccagaaagaggaattcaaacctatccatgccggtgaagtgggcatgtacgtgtgtggtatcaccgtttacgatctgtgtcacatcggccatggccgtacctttgtggcctttgatgtggtggcgcgctatctgcgtttcctgggctatcagctgaagtacgtgcgtaacatcaccgatattgacgacaaaatcattaagcgtgccaatgaaaacggcgaggaattcgtcgcgctggtggatcgtatgatcggcgaaatgcatgcggatttcgacgcgctgaatattctgcgtccggacagcgagccgcgcgccactcaccatattcacgagatcatcgatatcaccgcacgtctgatcgagcgcggtcatgcttatgtggctgacaacggcgacgtgatgttctcggtacccaccgatccgaactacggcaagctgtcgcgtcaggatctggatcagttgcaggccggtgcgcgcgtcgaagtggcggacatcaaacgcaacccgatggatttcgtgctgtggaaaatgtccaagccgggcgaaccgagctggagttcgccgtggggtgaaggccgtccgggctggcatattgagtgctcggcgatgaactgcaaacagctgggcaaccatttcgatattcatggcggcggcgcggatctgatgttcccgcatcatgaaaacgagatcgcgcagtccacctgcgcccacgacggcgaatacgttaactactggatgcactccggcatggtgatggttgaccgggaaaagatgtcgaaatccctcggcaacttcttcaccgtgcgcgacgtgctgaagtattacgacgcggaaaccattcgctacttcctgatgtccggtcactaccgcagccagcttaattacagcgaagagaacctcaggcaggcacgttccgcgctggagcgtctgtataccgcgctgcgcggcaccgataaaaacgtggctccggcaggcggcgaggcctttgaagcgcgctttatcgaagcgatggacgacgatttcaacaccccggaagcctattcggtgctgttcgacatggcgcgcgaggttaaccgcctgaaagcggaagatatcaacgccgcgaacggcatggccgcgcagctgcgtaagcttgcgggcgtgttgggcctgctggagcaggatgcagaacagttcctgcaaagcggcgcgcaggccgatgatggcgaagtggccgagatcgaagccttaatcaaacagcgtctggatgcgcgccaggcaaaagactgggccgccgccgatgcggcgcgcgatcgtctcaatgagatgggcatcgtgctggaagacggcccgcagggaaccacctggcgtcgtaagtaagtcagtaacgcccggcgccgcgttgcttgccgggcctacaaattgtcttgtaggccgggtaagcaacgcgcacccggcaattacggctctgtgttgtaggccgggtaagcgtagcgccacccggcaattgcggttctgtcttgtaggccgggtaagcgcagcgccacccggcaacggcaaatcacgcggactcccgcgccactaactggccggacagggttatccgctgggtaagcagatccggctctttcagtttacgtatgatcagcgccgccgcctggcgtccggtctcttcactcgctgacgacacgtaggtgaaggacggtgacgtcagattcacatgcagcatatcttcaaatcccaccagcgccacctgttgcgtcagaaacacatctttacccaccgtgcgcccgacctggctgatgccggacaaacagccaatcaccgcatcaggcgaatggcacagcagggcagtgatcttattgttcttctccagcagctgacgggtggcgtggctggcggcatgggtgccgtcgcagcaggccggggtaaactcttcccgcgtcaccagcccgtactgggttaaggcgctgcgaaaaccgagcagccgctgctggcgaataagattattttcactgccgccgatataggcgatattacggtgaccgcgctcgataagataacgcgtggcaagattggccgcctgacggttatcgcgcatcactaagtcgcagggctcgtccagcagggattgcgacaccaccaccagcggcagcgggcattcccggatctgctgtggtacgttcgcccgcgaggcatccgccgccagatagatcacccccgccacgccctgctgtttaaacgacagcagacagcgctcaaggtgttcctcatcgttgagcggctggccgagaaagaccataaaaccctgtttctccagctcctgcacaatgctggccatcactttgatagaaaaactgtcgctgaaatcccgtaaaattaggccaataagattggaggtactggagcgcagattggctgccgccacgttgtgcacgtagccgagcgtggtgatggacgcctgcactttctcaatggtcgcagccgaaattttccctttctgacgcagcaccagcgaaacggtcgaaacagaaacccccgcatgccttgcgacatcaataatgctgaccttcttcaaacgcgctccctgaaatcaccggataatcagccaaatatgacaacgtctcctgcgcgggcagaagacgttatcaccttaacagcttcgggttatctgcccatcataccggacatggtttgtgcgataaattgtgcgcgcgccccaaaaatcacctgtacgccctgatcgccgacgaacaccacgccccgtgcgcccagattgttcagcccgtctttatccaccagcgtgcccttcgccacttccagacgtaaacgtgtgatgcaggcgccgaccgagctaatgttctgctcaccaccgagcagggcgatgatttccgtggcgagttcgtcatcggttttatcgctgacgctggcggtgatttccgtgcggcccggcgttttgacatcaaaacgacggatcacgaagcggaaggtgaagtagtagatcaacgccatcggcacgccgacgataatcgcgctcaggaagttggtctggaagccgttgaaagacggcaggatgccgaacgacaggtagtcgataaagcccgccgagaaggatttggcgatatgcgcatgcagcagatacatacacatgtacgacagacccgccatgatggcgttaaacacgtacagcaccggcgcgacaaagataaaggtgaattccaccggctcggtgatccccgtcaggaagcaggtgagggcggcggagaacagaataccggcggcaatctttttgtttttggtctgggcttcgtgatacatcgccagacaggccgcaggcagcgcgaacagcatcagcgggaactcgccctgcatgaacttaccggcgttctggtaggtgtcgctgctgaaggatttcacgccttcttccagcattttaaaccagatggtctggtcgccatggatcacctggccggcctgcgtggtgtaatcgccgaaggagtaccagaaagagggataccagatatggtgcagacccagcgggatcagtgcacgttcaaccagcccgaagataaaggttgaggccgcctgattatcgccgttcaccaccaccgacagcgcatcgatccctgactgaatgtgctgccagacatagggcagcaacagaccgagcaggaaggagagaaacgcggtggcgatggctacaaaacgtttacccgagaagaagccaaggaattccggcagctgcaacgtatggaaacggttgtagcaccaggcggcgaggatgccgcagataagcccgccaaacacgcccatctgtaaggtcggaatgccgaccaccatcgcatacttaccgccctgcgaggccatttccggcgtgatcgacagcaccgtacctatagtgatgttagtgacaaacaccgacaccgccgccgatagcgccgcaatacccgattccgacgccagacccaccgcggaaccaatggcgaacagcatcggcaggttatcaaagataacgcccccggcattcatcatcagcggcagctggaatttatcaccgaacgccagtaacagaccggcggcgggtaataacgaaattggcagcatcagcgcgcggccaatcatggacaattttgataacgacttaatgaaacctgacagcatagtcatgccttatcccccgaatgcagacgccttttttgggcgcttatttttgtgagtataacgttctactaaaacgttatacctaatgtcagataagcgcggttttaccgcaactgaaatcacgtggcacgtcagaggattttgttattcttttgaagtcgatcggttaatgaccatggcgggcgcggggagaagggcggtttttaccctctccggcggagagggtaaagcgggatcaggcggtgatggtgatgctctgcccgttaaagctcacggtctgaccggcgacgattttgcagcgcttgcgggtttccacctcgccgtccaccgtcaccagaccgtcggcgataaaaatcttcgcctgcgcgccgctttcgctccagccttccagcttgagcagatcgcagagttcaacatgcggatgtttgcccagggagaatgttgccatcttatgcttccttaacgtcgtgatattcttcgcacgcctgtagcgtgttctggatgagtgtggcgaccgtcatcggcccgacgccgcctggtactggcgtgatgtacgcagcgcgcgcggcggcgtcttcaaacaccacatcgcccactactttaccgctttcaagacggttaatcccgacatcaataacaatcgcgccttctttgatccactcgccggggataaagcccggtttgcccaccgcgacgatcagcagatcggcgttttccacatgctggcgcaggtttttggtgaaacggtgcgtcaccgtggtggtgcaaccggccagcagcagttccatgctcatcgggcggccgacgatattggaggcgccaatcaccacggcattcaggccgtaggtatcgatgttgtagcgctccagcagcgtgacgatgccgcgcggcgtacaggggcgcagacgcggcgcgcgctggcacagacgacccacattataggggtggaaaccgtccacgtctttatccggcgcgatacgctccagcacttttacgttgtcgatgcccgcaggcagcggcagctgcaccagaatgccgtcgatggcgctgtcggcattcagcctgtcgataagcatcagcagttcggcttcggtggtggtttcaggcagatcgtaagagcgggagataaagcccacctcttcacacgctttgcgtttactgcccacatagatttgcgaagccgggttgctgccaaccagaacaacagccagccctggtgcgcgttttcctgcagccagacgtgcctgcactttttccgcaacttcagagcgcacctgctgcgcaatcgttttaccgtcaataatctttgctgccatcagagagaagattccgtctgtgaatagaagagtggggatggctatattttgtcagaagcgggaggcgctgtcagttaacctttatgaaattcacctgcggcagcgtcgtgaagcagttcagggtgctcatttaccgcgcatccggatgcaaagccattgactcaatggaggttgaccgtataatccgaggcgtttccaccataaaaggtgtgacatccgcgtaacgcgcccttagctcagttggatagagcaacggccttctaagccgtaggtcacaggttcgagccctgtagggcgtaccattctgctttcgctcacgcccttcgattaaatttcttccctgatacgttttatccgttttggcatttagcgtcgtcgaccgacgtaaaaaaaaccgccagcgtttcccctgacggtttgtttatcagcccccggtttacagcccttcagtgctctcttttttcgcttccatcgcttcgacatcacgataccagcgcgggtgatgcttctgcgcccagcggcggctcaccttgccgacaatcatgcctttgatggagcctttgacccagaacgccatatacatatgaataagaatggcgtggatcaaaataatcgccgtggtggcatgaataagcaggctataacgcaccactttgatcgggaaataatcggcaaaccacggacgccagataataacgccggttaccagcagcacaaaaatcatgctcataatggtccagaacatcatcttctgcccggcgttatatttgccgacccgcgccactttatgctcgttgcctttcagcacctcgacaatacctttcacccacggaatatcgtgtttatcgggaatattgtgatgcacaaaacgcacgaacataaacatcagcgcgatgaagatcagcaccccaaaccacgggtgcagaatacgacccatctgcggcgtaccgaaggtttccgtcagccattgcagcgtcgggaagaacagcgcgatgccggagagtgccaccaggaaaaagcaaatcacgaccgtccagtggcaggcgcggtcaatgaatttcgtcctgacgatcatcctgctctgcttaatcatggtgttcctcctcgtcttcgtccacttcctcgttcggcccgacgcccacatagtggaagatcagtccggcgaaggtggcgataaaacctgccgccgacagcggtttcagcagccctttccacagggagatcggggtgtcgatgtgcggatcgttcggcagattgtgatacagctccggctgatcggcatgatgcagcacatacatcacgtgcgtgccgcccacgccctgcgggttatagacgcccgcgtgcggatagccgcgcttttgcagcttcgccacgcgctcgtccgccacctccagcatctcttttttggtgccgaaatgaatggcccccgtcgggcaggttttcacgcaggccggctcctggcccacgctcacccgatcaacgcacagcgtgcatttatagacgcggttatcgtctttattcaggcgcggaatgttgaacgggcaaccggcgatgcagtagccgcagccaatgcagtgttccgactgaaaatcgacgatgccattggcgtactgaatgattgcgcccgccgacgggcaggctttcaggcagcccggatcggtgcagtgcatacagccgtccttacggattagccactccagcctgccgttctgcgacgtctcgctaaagcgcatcagcgtccaggatttggcgctcagatcggcgggattgtcatacaccccgacgcagtggcccacgtcgtcgcggatgtcattccactccgagcaggccacctggcacgctttgcagccaatacagctggagacgtcaatcagcttcgcgacctcttctttatagtcgcgggcgcgaggcggcggcgtcatgccgttcgtcgctgaacggcggataatatcctgagattgcatggacataatattgctccttacgccttctcaatgttgaccagaaacgccttgtactccggcgtttgcgagttggcgtcgccgacggacggcgtcagggtattggcgagataacccttacgcgccgtgccttcaaagccccagtgcagcggaataccgatggtttccacctcctggccgcccgcatagagcgtgcgaacgcgtggcgttaccaccgcgacggcgcgaataaagccgcgtttgctgctgaccttcacgcgatcgccattggcaatgcctttggctttcgccagccgctcgctgatttccacaaactgttccggctgcacaatggcgttcagccgcgaatgcttggtccaggtgtggaagtgctccgtcaggcggtaggtggtgccgacatacgggaaagcgtcgcgtttgccgatgcgtcgggcatccgcggcgtacagacgcgctgccgggttcgacaccaccttcgggtgcagcgggttggtgcccagcggcgtttcgaacggctcgtagtgttccgggaacggcccctctgccattttgtcgatggcgaacaggcggcccagaccttccggctgcatgataaagggcccgacgccgctgcccggcggcgcggtgttgtagtcaggaatatcgttgccgacccattttgtgccgttccatttgatcaacatgcgtttcgcgtcccagggtttcccctgcggatcggcggaggcgcggttgtaaatgatgcggcggttcatcggccatgcccaggcccagcccagggtgttacccagcccggacggatcgctgttgtcacggttcgccatctggttgcctttcgccgtccagctcccggcgtagatccagcaggcagacgccgtggtgccgtcgtcacgcagcaacgcaaaggagtccagcaactgaccttttttcgccaacagattgccattggcatcaaagagatcttccagcgcgtagccgttgttctcccgggccacttcggccgattccggatgatccggctgatcgtagtcccagcccattttcagcagcggctcgacgcctttcccgccttcggcgcgatacatttcgcgcagccggtggtacaggcctgcaaggatctcgccgtcgtttcgcgcttcgccaggagcgtccgcgcctttccagtgccactgcaaccagcgcccggagttggcaatggagccatcttcttcggcaaagcaggtggacggcagacggaacacttcggtctgaatagtggccggatccacatcgttcatctcgccgtggttctgccagaagttcgaggtttccgtgaccagcgggtcgatgatcaccagatacttcagcttgctgaggctggcgactactttgtttttatccgggaaggaagcgaccgggttgaagccctggcagatatagccggtgacctgctgacgatccatcatgtcgaaatacttcagcacgtcgtaagactgatcccacttcggcagccagtcgaagccccagttattttcccgggtcgcagcgtcgccatagaaggctttcatcaggctgacgaaaaatttcggatagttgccccagtagttcacctggcccggcagcgtggctttcggcgtattggccgccagataactttccagcgtggtgtgtttttccgacggcagggtcagataccccggcaggctggtggagagcagccccagatccgtcagcccctgaatattggagtggccgcgcagcgcgttcacgccgccgcctgccatgcccatattgccgagcagcagctggatcatcgccatggtacgaatgttctgcgcgccgacggtgtgctgcgtccagccaagcgcatacaggaatgtcgtggtgcgatccgccgcgctggtggaggccagcacttcgcacactttcaggaaatcagccttcggcgtgccgcagatatgttccaccacctccggcgtatagcgagaaacgtgctctttcagcaggttccacacgcagcggggatgctggagggtatcgtcgcgcttcgcataaccgttttcatcgaactgatagttccagctggttttgtcgtactggcgtttcgcctcgtcgtagccgctgaacaggccgtcttcgaagctgaaatcatcccgcaccagcaggctggcgttggtgtagtgtttaacgtattcggcgttgattttgttatgggaaatcagatacaggatgacgcccgacaggaaggtaatgtcggtaccggagcggatcggcgcatagatatccgccaccgaagcggtgcgggtaaagcgcggatcgaccacgatcagcgtggcatcgttattgtttttggcttccatcgcccagcggaaaccgaccgggtgggcttcagcggcgttaccgcccatcaccatcaccacgttggcgtttttgatatcaacccagtggttggtcatcgcaccgcgaccaaatgttggagcaagacttgctaccgttggtccgtgtcagacgcgcgcctggttatcgactgccagcatgcccagcgagcgggcaaatttttgcgtcagcatcccggtttcgttactggctgccgaggcacacagcatgccggtggagagccagcggttaaccgtgacgttctgttcgttcttctcaatgaagttagcgtcgcggtcatctttcatcaggcgggcgatgcgggtaaaggcctcgtcccagctgatgcgctgccatttatcagagccaggcgcgcggtattccgggtagcgcaggcggctgtcgctgtggatataatccagcagtcccgcgccttttgggcacagcgccccgcggctgaccggatgatccggatccccttcgatatggaaaatactggatttggcatttttcgcgccgtcacccatgctgtacatcaataatccacagcctacggaacagtaagtgcaggtattgcgggtttctttcgcgcgcagcagtttgtaattgcgcgtttccgcaagtgcaacggtgggggcaaagcccagcatcgccgccgtggttcctgccattccgccggcgcagattttaaagaattttctgcgactgacgtccatcatatccccaatgttttgacttgttatgacgtgttttcggcggcgaaaataacaggacagcgagcagggatattgcgtgaaatcaattcactatggattgacgggcgactcacctcttatggggtaggtagggcaggcagggcgataatccctttgaggcgtgtatgtccggaccttacgatggcggggacgtgatacaaatgaacgtccctgcccggatgccataaaggtcggcactgcctatcaggcgtaaccgcaggattcaagtgcggcgcctgacaaataaagcgtttttatcaaaagtggaacgcgtctggaaaatagccttgtccaaattgcaggtgtgatgacgcaggcgtactattggctcaaaggttatcgtctttgttcagcagcaatttaccggagatgagagatgacaaagcatggatccctggcgcgaggaccggtcagtaatcggccatctgcgaagcgtcgtgaggttcgtctttctcgtggctcgttagtgggccgcagtttattaatcaatgacactgatgaaaatggacttatgttgcgcaaagtggctattttaatgaaagataaacgatattctctgctcagacggccacaaaccgttgcgcgttcagaaaacgcgctaaaaattaaatcaatttctgctgaagcttcgtcagaactgtccttccgcatgctcagtactctggatattcggatgaaagaagaggactttgatgctttcgagtgagtatagcggtggaattattcccactggcgaattcaaaactgacgattttttaatttctttaaaagaagcattcaagagtcactggcgtaaaggtcatcatccagatttaggcaaagatacgctttttgaaaggcctgacggagcgctttcttttcatttgcgaaaagtgcatgtcaatattcatcagtatgcaaattactcctatagctgcactgaaaagtgctgggataattgggcatttgggccagttgacgaacaggggaatcaccgtccaaagcctgccagtaatgcttatttaatttatgcagttaatgatcgccgagatgcggcgcttctggcgtactgggatccaccagcccatacaaaagcgaatgaagcagtctggatgaattctgttttaaatttcacaaaattatttcatgaaaaaacgaaaaccagtcccctgcccaggcatattgatccatggcactactctttcaaaaataagaagtcagtatagtgagcttttttgtgaatattactggttattagtacgtgctcatgatgatgctatttatattaaatatattttattataattgttcatcgtaaatcgagcattaagcataatgtgacagacatctgttcgcgtagcggcgaagccccttaaatacctgtttctgacagttatctttttaccagcagcggggcgcgaaattactgaaaggcgaaatgacgtggccgcagtaagggaccagcaggggtaacataagggggcttgcgcccccttaatattttagcgatgcgcctcttcatccataatcagcaccactttgccgatatgtttactgtcgtccatcatctgatgcgcctcaccggctttttcaaacgggaaggttttgcatacctggggtttgacggtgcctttttccagcagcggccagacgttctcggtgagcgctttgatcagcgcggctttctcttccggtgaacgtgaacgcaacgttgagccgatatgcgtcaggcgcttgctgagcatcgggaacagattcagctctttggcggcgccgccaattacgccgatctgcacgattcggccattcatcgccgccgcgtcatagtttcgcgccacgtaatcgcccgcgactatatccagaataatgtccgcgccgtggccgtccgtgacctctttagtgacttcaacaaaatccgcttctttatacagcactgcggtatccgccccgagcttcaggctggcttcgtgatgctcttctgatcccacggtggtgatgatttttgccgcgccgaacgccttcgccagcatggtggcggtggtgccgataccggacgcgccgccgtggatcagaataatgtcgcccgccttaaactggccgcgctcgaacatattgagccataccgtcataaaggtctcgggcagggcggcggcctcgatcaggcttaagcccggcggcagcggcagggcgttggtttcatgggccacgcaatactctgcgtaaccgccccccggaatcagcgcggccacatgatcgcccaccgtaaagcttttcacatccgcaccgactgccgccacgatccccgagacttccagtcccggaatatcagacgcccccggcggcggcgcatactggcctttgcgctgcatgatgtcagggccgttaacgcccgcggcgaccacgcggatcagcacttcatgcggctgtggcttcggcaccgggcgggtggtgggctgtaaaacctccgggccgccgggctgcgtgatctcaactgcggtcatggtgtcgggaatggttgtggtgtgttcagacatctttttcctcctgcattcagtgtctttagtatggctgcgatcggtgggcttgtggcaaagaagggtaactgaatgtgaggtaattcaatgctgttctgtttacttccacttcggaggggaaattttcagaataaaactcgcaagtgagagctgttagggtaaatacgtcgaaaagcagtgaggcattttaccaggatggtcaaaagggaaggggatatatgcaactatcaacattaaccactaacgctctgataatacttaacagtgacgccgataagaaagacgagattattcgcacgctggcccgaaaactttttgaaagcggaaaactgacgtcggaagaagcatttttgcaggccgtttatgcacgggaagcgctgggcgaaaccggaatgggagcaggcctcgcgctgccccatgggaaatgcgccgccgtgaaagaagcctgttttgccgtgatgaccacaaaaaagcctgtcatggactgggaatcttttgaagaagatgacggtgttcagcatatttttatgctggcgatcccggaaagcgaagccggtagtatgcatctggcgctgctggcagaactgatgcaaaacatgggcgatgaagaatacagcgagcgcttattttcctcccccacccccgatgcctttattcacaatcttgatatccctgtcgccgccgccgatcagacggcgcagtgccagaaaacgctgctggcggtgaccgcttgtcccgcgggcgtggcgcatacctatatggccgccgacgcgctggtcaaagccgggaaggcgctaggggtcactgtccgggttgaaaagcagggggcgaacggcatagaaggtaaacataccgctgagcaattacgtgaggctgacgcggtgatatttgcggtgtcggtggcggtaaaagaggccgaacgctatgaccatctgccgcaggtaaaagtatcagtgtccgatcccatcagggatgcgcaggctgttattttacaggcgctgaagcaggcggaaacgcaaaagaaaggcgagaatatcccccgggatgctgttaacacggcaggtaaagagaaatcgactatcggcaaactgctggacgacgctaaaagtcatttaatgaccggcgtctcttttatgctgccgtttgtggtcgccggaggcttaattctgaccctcggcctgttgctgggcggcggcgatcaaaaaaccggctttgcacatatgactgtacagactggcgtgctgatattttcgttaatggtgccggttatcgctggatatatttcttattccattgcggataaacctggcatcgttgcgggcatggcggggggcttaattgccagagaaattggcgcaggctttttgggcggcatagttgccggatttgtcgcaggctttattgttaatcaactaaaacgcatccccatgcatgcttatctgacgcagcttaagccgattattattattcctctgctgggatcggggctggtggcgctggtgatgtatacggtgggcgttcccattgcacaattatctgttttactggaaaacggactgaaatccctccagggcggaaatttgattgtgatgggcatgatcatcggcgcgatgatggcgattgatatgggtggcccgattaataaagtggcctttgctttttgcgtcggcatgctggcacagggagtttatgcccctatggccgcctgctggatcggcattatgacgccgcccgcaggactggcgctggccacccgtctggcacccaaaaaattcagcgtggctgagcgaagcagtgccattgccaccgcaatcatggggctgaccggcattacggaaggcgcgatcccctttgcggtggccgatccctggcgcgtaattttatccattgtcaccggatctgcggcaggggcggcgctggccctgggaatgggcgtagaagcgtccgtgccgagcggtggcatattcgtcgtgcccttcttccggcacccgttattatttatgggcgcttttctttttggcgttgcggttaccgcgctgtgcgcgattaccctgaagaaagaatttatcgaacggacaaacgcgtaataaacagaggacgttattatggatttctatattatttcgcacacgcactgggatcgtgagtggcataaaaccttcgaagaataccgggtccggttggtgatatttttcgataatctgatcgagctgttagaacataatccgcattatccctcttttatgatggacgggcagaccatcgtgcttgaggattatctggcaattaaaccgcacaaaaaacagcagttgcagcagttaattgcccacaagagaattatcgtcggcccctggtatattcagccggatgagttcattcccggcggagaattccagatccgcaatctgctcatcggtcagcgcattgcagccgctttcggcggaagtatgcaggtgggttatctgccggactcctttggacaggcggcgcaactgccgcagctgctgcaggggtttgacattgactacgcggtgttctggcggggcataacagaagatgaatgccctgatgtggattttatctggcgaagtgcggatggctcgtcggtaaaaaccacggtactggcggaaggatatggcaacgcgcgcctgctgaatgacgatcccgataataacgtcagcatcataaagaataatcttgctgccctgtacgccagatccgataagcgcaacatgctgctgatgtgcggttttgaccagcgcaatgcaaacccactactgccggagatcgtgaaacagttgaatgctgacctgcctgagcataatttccgcatcggcgcgcttacagattatcttgcggcggtatttaagcagggtgataaaaaagtggtggagggggagtttcgcaaaggaaaatatatgcgggtgcatgtcagcattggtatgacgcgccttgatattaaaattacgaattatcatacgcagacgcagctgcaacggatggccgaaccgttgatgagcatgagcgctctttttggtcaaccttaccagcaggaacttatcggccaggcctgtaaatatattttacaaaatcatgcccatgactccatttgctgcgtctgcactgacagcacccatgcgcaaatgatgcagcgttatcataatgcgcagcaaatttctgccatgctgttacaggatgcctccgaatacatcggtgaccatattgcgtataaaacgcagggtacgccgctggtgctgtttaatttttccggatcggcgcggagtggctatgaaaatgtctcttttgtcacgcccgctgaagatttcacccttatcgacagcgaagggcagcctgttgatttcgcaatcagcgctgtcagcgccattaaccagaatgatgcgcagatcgaaatcgggcaaaaaaaccaggatcgtctgctttaccgttatgagatggcaattaaggtcaggtttccgggcttcggctatcagacgctgtatatgatcccacgatctatgccgcaaagcgaagcaaagggtcagcctttgtttaacgagaataccgcgacctttaccaccgacttttttactctgaccgttcagcaaaatggggcattaacctataccgaccgggcaacgggcgaacagtttgcggatcttaattatttcatcgagaacggaaatgccggtgatgaatatgactattcgccgccggtcagcgatcggctgtgccatccccatcatggcctgccggatattgaggtgctgcataattcctcgctgtcggcagcggtcagacttatttttaatttcgccgtacctgccgatacgggtgccgataaacgcagcgatgaaacccttgatcagcgaatagcatgtattctgcgcatcagtaaagactcacgacgggtagatttttgtaccactctccataatcaggcccgcaatcatcgggtgtgcgttacttttcctgataaccagccgggcaggggacattttgctgaacaacagtacggtatgctttatcgggaaaacagcgttccggatcccgatgcctggcagcgcgaaggatgggaagagcgctattacgccctgtacccacagcaacgctatatgggatttgaacacgccagcggcaaagtgctgatttttaataagggactcgtcacctatgaaataaacagtgacggggctacgccggtcgtttcggtgccgctgatttgcaccatggattatatgggcaagcaggatctggtggatcgtccgggacggcgctcggggctgcatgtacctgtgccggacagcctgatgcccggcgaccatacccttgagtatgcatttatgtatttgccatcgtccgagggcgatattgcggccgaggcagatcgctggcagttgccgctgctggcggcgacgccgcgcggcaagcgggggagcctggcggacgcaatgacgttatttgcggttgaaaccccgaacattagcgtgatggcctttaagcgctgcgaaaaggggccgggttttattctgcggctggtcaatcagttggcggataaagcagatgacgtgcagctgcggcttaacaccacatgcttcaaccgtgtcagacgcgcgacgctcaacgagcaggaaatccccggcgacgtgagcttcaatgcccttaccggcgtgattagcgtcgggcggttacagcccaatgagatcgttacctttattgtggatgctttctgaaagggataaacagatgaacattgccattgcacaaattacgccagaaaccgccaacaaaaatgccaaccttgaaaaaatgacgcgctttgttctggaggcagctcagcagggggctgagctgatagtttttccagagctcgccttgactggttatcattgcggcgatcgtttttttgaggtggcggaaacgctccccggcgtgacaacggattatttcacgcagcttgcccgtcagcatagcattcatattatctggggcatggtggaaaaaacgctgcccggcatcctgtataacgcagcagcactggtggggcctgaaggttatattggaggctggcgaaaaaatactttgccgggccatgccactgataatggcggagcgggtgcgttccccgatcgacgttatttcagtcatggaggtgaacttgaggtctataacactgccattggccgcattggtgcgttaatttgttacgacatcttcttccctgaactggcacgattacttacgctgaaaggggctgatgtcattgtgggtatatcaggttcacctgcctttgagaaagacatttttgaaccaatcgtgaaagcccgggcgatggagaatactgttgattttatctacaccaatctggtggggcaggagggtgaaacaacctactggggtggcggttgtattatcgcagcaggcgattgcggatctaaaatcccgggcagtccggtgatttgtaaagcgccttatgaaggagagtgtataacgctcggcaagacagacattcaaaataaagcaatccggccattattccctgtgctgcgcgatgttacggcccggatgtatgaaaacctgaaacaggcgcatcaaaagcacagataaccatgccggctgcgttaatttccatggaaggggggcgtgcagtgatgctatttccttatcagcgactggctgaactgtatgagacgatccaggcagaaaccctgccgcaggatgagttagcgacgcgttttcaggtgtcggcgcgtacgatccgcaccgatatcgggatactcaatgatgccctccaggattatggggcgcatatccattatgagcgggggacgggctatcgcgtgattgttgacgatcaacgcgcttttgccgccttgccgcagaccgcagggcggaaaaaaatcattccccgcagcagtaaagatcgcatacatcttttgctgctgcgctttctgacccaggctgcgcctgtcaaacttgaccttatcgctgatgaatggtgtgtcagccgtggcacagtgcatcgggatatgaacgaggtaaaagacgctttaaaaaaatatcagctcgcgctggaaacacgcccctggtctggatcccgcgtcagcggaacggagcctgcgatccgcaacgcgattgccgatgttatctggcagatgagcgtcgccgccaataaaccgctgatgaccatggcggtgcaggaattcctgatgaatatcgatctgcatcacctggctaaaattctgcaaaatagcgtggatcgttttgatataaagctgagccacgatgcgcttcactatttgagcatggtgtgtgcggtatccatagtgcgcatcacctccggccatgaaatcatccatctcacagcctgcgatagcgatccggtgatagacaaagccagccaggatattgcgcagggattgtcgttttttctcggcagtgaatattcagccgccgagctggcctggctgcaaattcagattgccgcccggcggattattggatccgctgatgagctgaaaaccgaaatcaatagcgcggaactggtggataatatgcttaattttatccacggcacctataactacgatttacggcacgaccgccagctgcgtgacgatctcacgacacacctggtggcaatgctgacccgggtaaaatatcaggtcagtacgcccaatccattgcttgctgatatcaaaacctattatccctttgcctgggacgtgaccctcagcgccatatcgaaaatggccagttgcgtgccttacaccatcaatgaggatgaggccggttatctggcggtgcatattggcgtcgggctggagcgtaattacagttctggttttgaacgccatccgagggtgattatcgtcagtgattccggtatttcagtactgcgcatgatcgaagaaaagcttctgcgccagttcccgcaaatcgtcgtcgaacgcgttattgccctgcgtgactacgagcaattgcctcacgttgaggaagatttcattatctcgacgctgcgcctgacccagaaaaataagcccgtggtccgcattgccctgtttccgaccccctggcaaatagagcagattggccgcctggtaatagttgatcgcacgcgtccatggatttttgcccgttttttcaatgaacgacgttttatgcggattaacgggccgatgacacaaggagcattatttaaacgcgcctgcaatctgctgaaagagcaggggtttacagcggatgatttttatccctcgctgcttgagcgtgaatccattatgtccactctgctcggcgacggcattgctattccccatgcgctgggcctgcgggctaaaaagaccgcggtggtgacgatcctcgtaccggacggcgtagcctggagcaataaaggtgaggtggcacaggtgattttcttactggcgatcagtaaagaggatagcgacgaggcggtgagaatttacgatctgtttatgacgtttatccgtgaaaaagcaacccgacgactggttaacagcgccagcttcgatgatttccaggcgatagccacggactgttttggccggagtgcataagaaataaagcgcttaccctctggtgcagagggtaagcgcaggggcggcatcaaccaggaataatcttttcctgcttcagtttatcgaacagcgtagtgaaggaatccagcgtgctgcgatagccggtaaagcctgctttgcggcttttgctcatgtcggtgaaggcttccatcggacggcccagatcggcgtcggtatgccaccaggagaccagcttattgatgtcctgctcgcgcaactggtgctgcgcggcgatggtctgccaggcggctgcggcctcctgcatacggccttccagcggcatcatctgcgccggataatctgcggcttcaatgccgaagtaggcggcaagacgtggccacagccagcgccagcggaatacgtcgccgttcacggcgttaaaatcttcgttcgccgccgtcgggctggtggccgcccagctgagctgttctgccagcaggcccgcgtcggtgacatcgctcacgccgttccactgctccggcgagccggggaaaataaacggccagcctttttcacggcacagggtcgcgtagaccgccagcgtctggcccatgttcatggcgttacccacggcatagccgacgatggtgtggggacggtgaacgctccagcgatagccgtacttctcggcaccggcaaagagttcatcttcctgggcgtagtagaagttatccaccggctgacgcccctgttcttcgcggaatggggtaacggcggcgctgcctttgccgtagttctcgaacgggccaaggtagtgtttcaggccggtgaccagcgcgacatgcgcgccgtggaggcgctcgcccagcgcgtcaatcacgtttttgatcatcgcgccgttgacgcggatattggctttttcgttttcctgacgcgcccagacgctgaaaaataccgcgtcaggtttgaccgatttcagcgcttcgctgaccgccgctgcgtcagtgagatccgccgtcaggctggtgcagcctgcgagcacctcgccgcgcccgcgggacaggccggtcacttcccagccgtcctgcaataatttctctgacagcgcgcggccaattacgccgctgataccgacgatcaatgcttttttagtcatctgtgtttacctcgtaacaggggatatatacagactaatagagaatctcattcccggctctggtataaattcacaagatccttaacctgaggtcatcaattcgtgcacgaccagcgtctgaaagatattgtcccttttgtcaccagcgtcgaaaaaggcagctttaccgccgcggcggaatacctgcacgtcaccggatcggcggtgagtaaaagcgtcagccgcctggaagcgcgcctcggatcgcgcctgctggagcgcacgacccggcatctgcaactgaccgacgccgggcacgcgtattatcagacctgtatgcgcattctggaggagctgtcagaagccgagtcggtgctcgccgcccagcgcaccattccctccgggcgtttacggctggcggtgcccaatacctacgggcggctggcggtaatgccgctgctgatgccattttgtcagcagcacccggaaatcgagcttagcctgacgttttccgatcgctttatcgacctgtttgatgagggcatagacgtggcggtgcgtattggcggctcggtggatctgcccgcgtcgctgggctgtcggctgtcggggcgcgagaaaatggtgttttgcgccgcgccggattatctggcccgcgagggctgtccgcgcacggtagaggaattaataaagcaccgcgccattctttacgagcgggtggatggcagcaccaagccctggctgttcactaccgccgacgggcatcagaactggcgaaacgtgccgtaccgcatggcgctgggggatgtggatgcccagcagcaggcggtggtggcggggctgggcgtggcgcaaatgcccacctggctggtgcgcgccccgctgttgcgcggggagcttaaagtgattatgccggaattgcagcccgacggtctggcgctgtcgctggtctggccgcgccgcaagcagtggctgccgaaagtggatgccctgcttaacgtgctgagccagctggacattaccgcgccgctgaatgcgttagccgtttaacagcgccagcaccatttgcggcgtctggttagctttcatcagcacctgcgcccccgcctgttgcaggatctgcgccctcgacatcgctgagacttccgtggcgtagtcggcatcttcaatacgcgatcgggcggcggcgatagttgccgtcgcgccgctctgtaaattttgtacagaagagaggcgattggccaccgcaccgagcttcgtgcgctgcgcatctaccatgctgatggctttatcgagggtggcgagcgggttatccggattgcgtaagcggatctcatcgcccacttccgcaatgctcatggtggtggcgttggttgacgcatcggtggtcgcactgtaagtggtggcgaaatagatctgcacatcgcccacgccctgcagggttttcagcatcagcgtactggcggcatcattctgccggaccagggttgcggttttccccgtggtggagcctgacgcgtccataaaatagttgccgtcggcatcctgacgcagcacatcattggtggaacggccatcggcatcggtataacgcagctcgacgttagcgcgatccatggttaccactgagataccgttaactgaattcaccgccatgaaagcgttctggctggtggcgctcagggcgctgacctgcatgctggtggtggtgccgttcgatgtcgcggtcaccgaagcgttgtaatactgtatgttgccgccgccgttatcgacttccatcagatactgactgccgttcttcaccagccgggccgcgcctgccaccgggttgccgctggcatcggtaaagcttgcggtgctggcattggcgaagggtgtgctggtcaccgccgtcggcagggtggcaaaatcggtatccagcaggccggtcgcgctggacatttgcgcgctgaccgcaccggtcgggccgaagcttaccgtggcgggataccaggtattattctgctcaatataatactgaccgctatccatggtcagcgccgggggcgggctggcacttaaaggcgtgccgctgatgtcggtaaaattcacggacggaatagtgcgggcgggcaggctggcgaccgggctgtacagcggcgaggtgctggtggtgcccacggaaaccgtaccactgccggtggcggtgtaccagctggcgttgtaggttgccgggaaaaaggtcgcctgaccgttgctgtcgttgccctggatatagagctgattattgacggtgctgcgcaccagttgcggggaggtgatcccggcaggggtggcataactcacgctcgccgtgccattggtcagggaaatattattggcgatgcccgtgacggtgttctcatcggtcactttaccgctgatgccgcgaatgatcagatcctttaagcccagttcatccacgctgaagcccggtgatgaaaggtcgagatcgattttttcgttatcgtaagcgccgacctggaaaccgagtttaccggcgctgccatccagcagattgataccgttaaacgtggtcgctgtggtcaggcggtcgatctctttcaggttgaggttgatttctgcctgaatggcgtctgaatcctgctgattccaggtgtcgttaagcccctgaaccgtcaggtcacgaatgcgttgcagcctgccgttaatggcgctcatcgcgccttccgccgtgtccaccagcgacagcccatccccggcgttacgctgtgcctgcgccagcgcgtgttgctggctggaaagccggttgctgatggcctggcctgcggcgtcatcgctggcgccgttaatgcgcagcccggaagataaacgacggatcgcctggtcgagcgacgacgcgcttttgctgagattgtttccggcgttcagtgaaaacacattggtttttagacttatcattaccctgctcacgaatggcatccctgagaggaattatcggcaggcgggaattttctttagggacaaattatggcgtagtgaaagttctcgggcgctcagggcaaatttctggtatttactgtgggataagtcgttttttatcaggttttatgctgctggccgcgacattaaacgaagcggccagcagcattaactgcgatctacaaactctggtaggtgggcttactgctcgcgcctgccttcctccataaagtcatcgtccagctcgtcaacgttgccctgatgatctttaccggagagtaaattccagcaggcgataaagagcgcggcgatcagcgggccgatcacaaaaccgttgatgccataaatttccatgccgccgagcgtggtgataaggatcagatagtccggcattttggtgtctttgccgaccagcagcggacgcagcaggttatccaccagaccgacgatcaccacaaagaagccgacaataaagaagccctgccacatctgcccggtggagaagaggaaaatcgccgccggaacccagacaatcgccgagcctactgccgggatcagcgacaggaacgccatcagcgcgccccacagaatgctgccgtcgatgccgacaatggagaagccgatgccgccgagcacgccctggaccacggccaccaccacggtgccttttaccgtcgcccgcgaaacggtggcgaatttggcgaatagatgatgtttaacgtagcgggagaggggcagcgcctccagcgcctgatgaacgatcaccgggccatccttcagcaggaagaatagcaggtagagcatgacgccaaagctgatggtaaagccaaaggtccccttaccaataataaaggcgctgcccgccatatattgcccgcccttcagcgccacgccggagagcgcctgctggatctgtgtggcgttattcagttcatgttccgcaaggaaattgcgcgcccagtcaggcagatggcgcagcaaatcggcaatcaccaccgggaactgggtgttgttctcctgtaacttgcggtacacaacattaatttcaaaggccagggatgacaggatgatggctaagggtgtgaaaacgataaggcagatgattaagacggtgataagcgaggcgataccgtttttatccgccatcttttcgcgcagcttgttcttcagcggctggaagatcaccgcgaggatagtggcccacaaaatcgccgagaaatagggcgacaggacatcaaaaaacgccagcgtgacgacaaacaggatcaggatgaaaaatcctttcgttagtcccttaaatctcataactacaactcccgatatgcattctgtttccgaaatatagaaggtactggcgagaatacaataaagcctggctacgcttaaaaaatcattagccgctggagtgttgttatgccggaaatttcttacccgaatgtcgaagtgttgctgctggaggcccatgactgggtgccgaacaatccccgcctgccggtgctgctatatcgtggcgttttcacgccgggcgcccaggccatcgccgatgtggaacggctgtttgccgataacggctggccggcgcagtgggtggacggcattttcaattatcaccattaccacagcgaagcccatgaagtgctggctttcacgcagggggaggcgcaggtcatgctgggcgggcctggcgggaccttagtcaccgtgcatgcgggagatattgcgttgctgcctgccggaaccgggcactgtaataaaggcagcagcgatgactttacggtggtgggggcatatccgccgggacagagtgcggatatttgtcgggctgcgccgtcgccggagatgctgaaaagcattgccacgacgccgtttccggcatgcgatccggtgtatggcgcaaaagggcctttattaagtcactggctgggaagcgaacgggaagatgcaaagcagggagggtgagacgaagaaagtcggtaaggcgacatcgaatcccctaccgacaaaaatttcgttcatctgtaaaccgatgtttcaaaagcggacaaatagtaaccacctctgaaacctggagcaagtaaaacttgatcgccatcactatatttacattaccttaagaataccttaagacagcaatcattagtgatgcttattttgtattaagcaaaaattaaacttaatgattataagactatttagctctgccgttgcgcatgtaaattggcgtaattttcaggtaattattctctgtaaagtccgaaaaagaggaatggctgacgcagttggactataaaaataatatgtgacaaaaaaaacagacccgcctgaggtaccgctatgcaaataatttatttcaaagctgaatgcccttttcctgaacttttaccgtcgtcgcccgtttccttacaggaagtgatcctcacccgcgatggtgaaataatttcaagcttctcggatttaaaactgaaaacattgcctttttatctttttcatctggttccgattggttttcgtaaaattgaacatcaggtaagtggcgccagcgacagccatttgcagttctcatccggctatttgcaaagcggagagtatcgggtggaaacgccggatggcgataaaacaatgcgttatgatgcgctgaccgccttgtggaagccggatgcgaatatcgagcgttatctgacgactaatgatttcactgcggaaaattactgcatattgcgaccgctaaaattattttatcgcaatcgccgggacatcatttgctgaatgggattaaccctactaagctcaggtatcaggtgcacggatgtaccgacattttatttttgtgccagagccttcagcgttaaaaataacacctcaaataagtgttgctttcccaaatcagacgtgcgttaatggatcagtcggtttgatacgcagacattatctcgggtagttaactaaagcagtcctcatttctcagtgtatctttgatacctcttctttgagcctccactttttaagcgctgattaaactctgtatttcagaccatctctggccaaaaggcccacagaaaaggttaaaatactcaatgacaacaacttctatgcacttcacctgtccgcgttgccacggttcgcagtacaggacatcaccttttgacatgaccgaaagcaacccgtatggcgcaaaatgtatattttgtaaatcagcgatgatggccagaacggtggtttatacgccggacgttcatgcagacaaacgcctggtcggggcgcgttaatcccgacccgaagagagccttgcagcgatgtgaggcttttttatgcccggacgaaaaaaatcctcatgcagcgccacccggttacggccacgccttttcgcgtcatacagcgccgtatccgccgccgaatagagggtttcaaaatcgctattacgcacccctaaactgacgccaaagctggcggtcacgtaccgatccggcagacattccagcggcgaagcgttcagtgatgcatgcagataaccggcgatcagcattgcctcttcaatgcgcgcgcggggcagcaggatcgtgaattcttccccgccgacccgcccgattgcggcgtgatccggtagcgcacgccgcacccgtgacaccagcgagcagatcacccgatccccggtcggatggccgtactcatcgttaatgcgcttgaaatgatcgatatccagcaggatcagcgccacgtcgccggtcagcagagatttatcgatctgattaataatggcgctgcggttgtataccgcggtgagcggatcgtgcgtcgcttcatattccagcctggccgccagcttttgcagctcctcgttgatgcgggttaactcccgctcggcgcgatcgctgcgggagatgaggcggtaagattcacggatcaaacgctgataatgcttcgcgatggtccacagcttttcgcggcagacctccgcaggcagctgcgcattggcggcggcgatccgggcgtcttccagaacgttatactcttcctgaaaaagctcgttaatatctagcatgcgctcaggtccgcttttaaaaagacggcgattgccgggaaatccatgctcacctcctgcccaaactcttccgagatgtcatcgtccgcgtcgtaataccagtgcagctcgcaggctgttccctgcagggcgaaaccgttcagcagttcgaaaaactcaaacagcagtttggtgctggagctgttgaaatagctgagcgccacatgcagttgcaaaggcgcggtattggccgattgttctcccagccaggtttccaccgccagcaatagcgggcggaaaaaggccgcggcgttttccggccaggattcgcctttcagcaccagacggcgggccgcgaaatcgaaattcacttccggggtggcaggggtggcggccagcacgatagcaggcgtcagtgtcatatcagtcatgggcgaaagtggccttaagatgaaaagcggacaacgtgctggccgctaaaggatggatgcgatattccagcggttcgctggtctcccgcgccatggtcaacaatccaatatttgcgcccttactgctggcaggcgcttcactgcgtaagccttctttccaggcctgtttaatttcggcctgcgtcatggtgcgcagcacgtcgagattgttttgcagtaaggaagaggcttcatgcccgaccaggttggcggtctccagataatagttaccggcatcggtgtgaaagcacagcgaaccaaaacgccgctcatcagccccgcagccaaggtagcgttcatcgcaggagtagcgcacgatgttctggcccatctcgataaataccgaaaacagacggcggcgtagcggcagcgaggcttcatgtttatccagccacgcccgtaccacatcgcccatcgacacaatgtgcgcctgggaaaaatagccggtgtaaaacagttcgacggcgctttgccgttgcagactaatcagcggcagcagcaccgcctctttggcctggaggtcattaaatttcatctcatcactcaccagcgaaaaccaaaccatgtaatgtcgtcccgcgacaactcctgtccctgccatgtctgcaacgccgagcccagcgcgcgggagagatcctgcatcggcaggtgtctttcctgcagcagaaccgactgaatgcgttttttgccgagcataatgccccgctcgccgccgatctgatcggtcagcccgtcggtgactatcagcacctgatcgcccttaacgagcggacgttgatagcgacgccactggtgatcggacggcgtatcgctgtagcccaggcctttgcgatctgcttccagcacgctgacttcttccgcctgcgcccccagcacaaaggcgtgcatttgcgcgttcgcccataacatctgcgcattctggttatcgacatacagggcgatggcatcacagccgtcgttggactggctgagatcggcgctggggtgcagctggctgagcgtctgtttgatatagcggttgatgatggcaagcaggcgctccggctcgtgcggcgcggccagggtctgcgctttttccagcgccgaggcgaagataaaggtcataaaagcgccggggacgccgtggccggtacagtcggcgatcaccgccagccagccctgttcatcacgacggaatgcataaatatcgccgcccacgcagtcgcgcggctgccagaacaggcaccagtcgttaagggtttcctcaatgctctgccgtgaacgggaaagcatcgactcctggatcacccgcgcatattcaatgctctgcataatctgaaaatgctgtttggcctgtaaatctgacacggttttgatgagatcgatgcccagcccgatgccgatgtactgcccgtcttccgtcaggataaagccttccgtcaccgctttatcgccggtttccaccacctggcctgccagaaactccagcccggcgctggcctcgacgatcagcggcgtcttatccataaacgcaatacagcttttttgatcgtaaagctcatgaaagaacgggcggctcatctgtgagagaaaaatatggcgattgatcatgccgaccgggcgattattttccagcaccggcaggccaatcaaagacttatgttcgttaaacagcgccatcacccgcagattggtggaatcgggtgtgacatgtggaacgtcaatacgcaacattcctgcgttaagctgtcgggaggaaagaggaatatccatgaaaatccgcgtgttccctgagataagaattatctgaatcctacagggcatgtatgacggttttatttcagtgacagggcagcggtggggcgtttgcgcaaaaaaaagcccgcacaaggcgggcaacataatactggaagcaatgtgagcaatgtcgtgctgaatacctgagtgttttgctcaactattcagtaatgagaaagataatccttatcatctgaactatcaaccccttctttattgcggattttttccggaggttttgccgcctgttaccgctgctgacaattcgttaaggattgtggcaaatgatcttgcttgcagaaacataatgcgtatagttctcattctctttattgttatggcgcatgagcgctacctccctgactattcgcattgaaggcaaaggattttccacatgaaaatgaaaacgtctgcactggctctgctggttgcggttgccctgagcgggtgcagcgcgccgcatagctccgacgcaaaaaaaccggctgaagcgccgaaaacccagaccaccgctcaggctgacagcagtgtggtaaaacgcgtgctggcggaaggcgtgtacgaactggcgctaagcccggcgggcgatgcgctctatgtcgccagcgcagaaggcttcaaagatgtgcagggcgggatggtctacaaacttgatccgaaaacgctgaaaaccctcggcgtcacccataccgatctgaaaaacttcggcgtggatatgtcggcagacggcaaaaccctgtacgtcaccaactcgctggacgcggggatcagcgccatcaataccgccgacggtaaagtcatcgaccgcgccctgttcccggagcgtaatccggaaggcttcccttacggcgcgcgtcaggtgttgctgcacaacggcctgctgtatatcggcgcggtcgccgatccggcgctgatctgggtcgtggatgcgaaaaccatgaagctgaaaacgcgcatcaaaaacaccggcaaatggatgaccggcctgcattactcagaaaaaaccgggcgcatctatgccgcaaacggcggcggcgagatcctggtgatcaacccgcgtaacaaccgcgtcgaaaaacgctggaagccgctcggcgaaaaagaggcgctgctgctgaatatcgcagaagacagcgccaccggccgcctgttcgtcaccgataactcgaaggcgaaaaccacgctggtgctggacatcaacaccggcacggtgatcaaacagctgccggtcggcgattcgctggctgtgaaattcaatgccaaacgcaacgagctttatatttcccagcgtgattccggcaaagtgctgagcctcgacgccaccacctacgcggtgaaaaaatcctgggatctgccgccacacccgaacagcctgctgctttccgctgacggccagacgctgtttgtcaccgtgaagcaggcgtttaataaagatcactccaccaaaggcccggacagcgtggtccgtattgacctgaataaataaccgaaccggcccggcgacgggccttttatccctttctcataaaagatgaccatgaacagtactgctcctttgcataagacgttgctggcgctggcgatcggtgccgtaacccataccgcgacggcggaaacccagcccccggcggcgacggaagatacgatagtggtccaggcggcgggtagtgattttaccgctggcggcgaccagctggttcccgcgtacttggatggacaggtggcgcacggcgggcgtctggggatgctcggcgagcaaaacgcaatggacgtgccgttcaacgtcatcggttacaccgcgaaagcggtgcaggatcagcaggcgaaaaccatcgccgatgtggtcagcaacgacgcgggcgtgcaggcggtgcagggctacggcaacttcgcggaaacctaccgcattcgcggctttaagctcgatggcgacgacatgaccatgggcggtctgccgggcatcgtgccgcgtcaggtggtggatacgcagatgctggaacgtgtggagatcttcaaaggtgcgaatggtctgctgaacggcgcggcggccagcggcgtgggcggcatgatcaaccttgaacctaagcacgcggaagacacgcctgtcacccgcgttggcgtggattacgccagccaggcgcagatcggcggctcgctggatctggggcgtcgttttggcgatgacaaccagttcggggcgcgggttaatctgctgcacagggaaggcgagggggcagtggatgacgatcaccgtcgcaccacgctggccgccatcgggctggattatcgcggcgagcgtctgcgcacctcgctggacgtgggctaccagaagaaaaccttccacggcagcaacgttggcatcaaaatcagcaaggtcgatttcattcccgatctgccggatcctacgcacaactacagccagcagtggggctacagcgacatcgaaaacgaattcggcatggcgcgtgccgagtttgatgtgacggatgcctggacggcgtacacggcgttcggcggccagcatgcccatgaaaccgggctgtacagctcaccggagatcatcaataagcagggcgatgcgtggatcggccgtctggataccaaccgtatttccgactccttcagcggcatggcgggtctgcgcgggcagtttgataccggcgtggtgtcccacaaggtgaatgccggttattcggcgctgaccaaaaaagacaacaccgcctggcgatccaccgccgaagcgaaccgtccgctgatcaatatctacgataccgacagcgtatcgcgtccgggttataactccgtgggcggtaactatttcgatccgctgaccaccagccgcaaccgcacccagggctggctgttcagcgataccttaggcgtgctggatgaccgcctgcaactgaccgtcgccgcccgtcatcagaaagtggtggtgcgtaactacagcaacgccaccggcgcggaaaccctgaccgcgcgctataccgaaagccgctggatgccaacctatggcgtggtgtataagccgtgggaacaggtatcgctctacgctaaccatactgaatctttacagccaggcagcaacgcgccgaaagacgccgccaacgcctttgaatccgtcggtatcattcacgcgaagcaaaacgaagtgggcgtaaaggtcgactatgggcgtgtcggcgggacgctggcgctgtttgaaatcaaaaagccctccgccattctggacagcgccacaaaacgttacgggctggacggcgagcagcgtaaccgtggcgtggagctgaacgtcttcggcgagccggtacttggcctgcgtctgaacggcagcaccacctggatcgatccggaaatgacccgcaccaaagacggcatcaacgacggcaaagacgctatcggcgtaccgaacttcttcatggtggtgggcgcggagtatgacatcaaaccgatcgacggccttaccgccaccgcgcgcgttaaccacaccggttcacagtacgccgacgccgccaacaccaaaaagctcgacagctacaccaccctggatctcggcatgcgttaccggatgcgccttaacgaggcgcagaacgagatgatctggcgcgtgggcgtggataacgtcactaatgagaaatactggtccggcgtggaagatctcggcacctatattttccagggcgaaggacgcacgctgaaagtctctatgagctacgatttctgatcccccgcacctcgttatgacgggcagggacgcccatcataattgccacctccggcgctaaatgttaaaacgtgccccttcaaataaaagacacacaggggaaagacgtgaaaaacgcgtcacaagtcgcgccggaaaccgggccgacgctgcaacggggcttaaaaaaccgacatattcagcttatcgccctcggcggcgctatcggtaccggactgtttctcggcattggtccggcgatccagatggcgggcccggcggtactgctcggctacgcgctggccgggatcatcgcttttttgatcatgcgccagctgggtgaaatggtggtcgaagagccggtatccggatctttttcccatttcgcctataaatactggggcccgttcgccggcttcctctccggctggaactactgggtgatgttcgtgctggtgggcatggcggaactcaccgccgcgggcatttacatgcagtactggctgccggacgtcccgacctgggtgtgggcggcgaccttcttcattcttatcaacgccgtcaatctggtgaacgtgcgcctgtacggtgagatggagttctggtttgcgctgatcaaagtgctggcgattattgcgatgatcggctttggcctgtggctgctgttctccggcagcggcggcgagcgtgccggtatcgacaacctgtggcagcacggcggctttctggccaccggctggcacgggctgatcctgtcgctggcggtgatcatgttctcctttggcgggctggagctgattggcattacggcggcggaagccagttccccggaaaccaccatcccgaaagcggtgaaccaggtggtgtaccgcattctgctgttttacatcggctcgctggtggtgctgttagcgctctatccgtgggtggatgtgaaagccaacagcagcccctttgtgttgattttccacgatatgaacagcaatatcgtcgcctcggcgctgaacttcatcattctggtggcctcgctgtcggtgtttaacagcggcgtttactccaacagccgtatgctgttcggcctgtcggtgcagggcaacgccccggcgtttttaacccgcgtcaacaaacgcggcgtgccggtgaactccctgttcctgtcagcggccatcacctcgctggtgatcctggtgaactatctgctgccgcaggaagcctttggtctgctgatggcgctggtggttgccaccctgctgctcaactggctgatgatctgcctcgcgcacctcaagttccgcgccgccatgcgccgcaagggacgtgatacccagttcaaagcgctgttttacccggcgagcaactacctgtgcatcgccttcctggtgatgatcctcggcctgatgtgcaccatggaaagtatgcgtacgtctgccattctgctgccggtgtggatcctcttcctgtttgtcgcctttaaggtaatgcgccgccctaaagcgtgatccttttcccctcatcccacggtgaggggagtccctgattatttatcgtgatccgcctcgcggatcccatacgatcaccatgcaccttattttgtaatcgattactttttagctgacggcaatttgtaatcgattacttttttcaggtgaggcaataaaatggtgtcaacaaccgaaagtagcggaagcaatctggcgcagcaccggttactcgtaccgcggctgtcgctgatgatgtttttacagttttttatctggggaagctggtcagtgaccctcggtctggtgatgacgcagcacaatatgtcgctgctgattggcgatgctttttccgccggtcccatcgcctccattctctcgccctttgtgctcggcatgctggtggatcgctttttcgcttcgcaaaaagtaatggcggtgatgcacctcgcaggggcggtcattctctggtttgtgccgcaggcgctggtggcggaaaacggcgcgctgctgattggcctgctgtttggctataccctgtgctacatgccgacgctggcgttaaccaacaacattgcctttcacagcctgcgcaacatcgataaaaccttcccggtggtgcgcgtgttcggcaccatcggctggattgtggcggggatctttatcggcgtcaccggtatcgcctccagcaccagcatctttatggtggcggccatctgctcggtggcgctggcgatttacagtctgacgctgccgcacacgcccgcgcctgccaaagggctgccggtgaaggtgcgcgatctgttctgcgccgatgcctttgcgctgctcaaaacccgccacttctttgtcttttcgctgtgcgcgatgctcatttccgtgccgctgggcacctattatgcctataccgcgtcttatcttgccgacgccggtgtcgcggacgtcagcaccgccatgtccttcgggcagatgtccgagattttcttcatgctggtgatcccgctgctgttccgccgcctgggagtgaaatacatgctgctgatcggcatgttcgcctggttcgtgcgctacgccttttttgcgctgggcgtcagcgaagaggggcgcttcctgctctatctcggcatcctgctgcacggcatctgctatgacttcttcttcgtggtcggctttatctataccgatcgcgtggcgggggaaaaggtgaaaggccaggcgcaaagcatgatcgtgatgttcacttatggtatcggcatgctgctcggctcgcagatttccggcgcactctataaccgtctggtggccgggcaaagcgtgccacaggcatgggtaacgttctggtggatcccggcggtcgccgccgcggtgatcgcgctgattttcatgttgtcatttaaatacgacgataaagaacaggcttaagttgtgggagaagttatgaaaaccattaagggaccgggtattttcctgtcgcagtttattggcagcgacgcgccatttaacacgctggacggcctcgcggcctgggcggcggaacgcggttataaagcgctgcaaattccctgtcaccacccgacgatttttgacgtcgcgcaggcggcggaaagccaggcctactgcgacgatattatcgcaaggctggcgggccacgggctggtcatcagcgaactttccacccatctggaaggacagctgatcgccgtgcatcccgcgtacgatgcggcctttgacggtttcgccccgccggaggtgcgcggcaagcccgtggcgcgtcaggcgtgggccgtggagaagcttgagcaggcggcacgggcgtcacagcggcttggtttaacggcgcacgccaccttttccggcgcgctggcctggccctatttctatccctggccgccgcacaacgcgcaactgctggaggaagcctttcatgaactggccgcccgctggcgtccgatcttcgacgttttcgatcgccacggggttaacgtctgctttgagatccatccgggggaagatctgcacgacggcgcgacctttgagcgctttcttgagttagtggatcatcacccgcgctgcaatatgctctacgatccgagccatctgctgctacagcacatcgattatctggcgtttatcgatcgctatcatgcgcgtattaaagcctttcacgttaaggatgcggagttccgcagcaacgggcgcagcggcgtctacggcggctatcaaccgtggatcgaccgcgccggacgctttcgctcgccgggcgacgggcagatcgacttcggggcgattttcagcaagctgacgcagtacggctacgacggctgggcggtgctggagtgggagtgctgcctgaaaacaggcgatgcgggtgcgcgggaaggcagcgagtttatccgccgtcatatcattccggtggcggatcgcgcctttgatgacttcgccgccagcgcgtcggatcgcgccagcgtgcgcaggatgctgggactgggagacgccttatgatcagggtcggtatcatcggcagcggttttatcggcccggcgcatatcgaagccctgcgccgtccgggcttcgttgaggtggtggcgctgtgcgacagctcgctggcggccgcgcaggagaaagcggcggcgctgaacgtgccgcatgcctacggcacggtggcggattttctggcgcatccggggctggacgtggtgcacaactgcacgcccaatcatcttcatgcggacattaaccggcagatcctgcgcgccgggaagcatgtcttttccgaaaaaccgctctgcatgacgccggaggaagcgcgtgaactggtggcgctggcacaggcggcgggcgtagtgcatggcgtcagcttcgtttaccgccagtttgcgatggtgcagcaggcggcgagtatgcagcgccacgggcagacggggcggctgttctcggtgtacggcagctatttgcaggactggatgctgctggaaaccgactataactggcgggtggacgcggcgaagggcggcctctcccgcgcggtggcggatattggttcccactggtgcgacacggtgcagtttgtcaccgggcggcgcatcaccgaagtgatggcggatctggcgatcgtctggccgacgcgcaaagcacgcaccgacggcggggcgaccttcagccagggggatgaggccgcgcagtatgaggataaaccggtcaccaccgaggacggtggcgcggtgctgctgcgttttgacgacggcagcaaaggttgtttcagcgtctcgcaggtcagcgccggacgcaaaaatcgcctcagctttgagctgaacggcagcgcctgctcactggcctgggatcaggaagtgccgcagcagctgtggatcggccatcgtaaccagcctaatcagatcctgactgacgatccgggactgatggcgcgggacgccgccgccagcgcccattttcccggcgggcatatcgaaggctggccggacgcctttaaaaatatgatgctgcacttttatgaggcggtgcgcgccggaaaaatgcccgatgccggaacggcggctttcgccacctttgaggatggcgcgaacgtgatgtttatcattgatgcgattataaaaagccaccagcagcagcgctggatccgcgtggcatcctgaactacagcccggttcgccgggcagcaaatttgtgatagcctgcaaacattgcattgcgtcaaccgcaggatgtgtcctcgttatgtcaattcagaaaatcgcccggctggcgggcgtttccgtcgccacggtgtcgcgcgtgctcaacaacagcgactccgtgaaagcgaaaaaccgcgaacgggtgctggcggctattcaggaaagcaattatcagcctaacctgctggcccgccagctgcgcaccgcgcgcagctatatgatcctcgtgctggtttccaatatcgccaaccccttttgcgcggaagtggtgaagggcattgaagaagaagccgagaaaaacggctaccgcattctgctgtgtaattccggctctgacgtggcgcgttccacctcggcgctgaaattgctctccggcaaaatcgttgacggcataatcaccatggacgccttcagcaaattgccggaactgaccgccatgattggccaggccccctgggtgcagtgcgccgaatacgccgattccgggaatgtctcctgcgtcggcattaacgacgttgacgccgcccagcacgtgatcgggaaactggtggccggtggtcgccagcgcattgcgctgatcaaccacgatctcagctataaatatgcccggctgcgcgagcgcggctataaaaccggactgcatcaggccaggctggactataacgccgtggaatatgccagcgaactgagcttccgcgcgggcgttgcggcgatggaaaaactgttgcaggccgacgtgcgcccggacgcggtctttgcggtatcggatactctggcggcaggggcgatgctggcaattgctaacgccggactgaaaacgccggaagatatcgcggtcgtcggctttgacggcacagccctggcggagatggtttcgccgccgctcagcaccgttgagcagccttctcaggacattggccgcaccgcggtcgggttactgctgaataaaattgataacccggacgcgcccgcccagcgggtgatgatggactggcactatatttctcgcctgagcgcgtagttttttaagggagagttaccggtgaaccggcaacgacaagctgatctttttctcgtcctgaccaccatgatcgccgcctgcggctggatcttctcccgtgaagccattgccgggatgccggtattcgctttccttgcgctgcgtttttgcggcggtgcgctggtgctgctgccgttctgccgcggccagcgcattgcccgtacccagctgaagccggtgatcatcagcggtttatggatggcgctcaacctgtgcctgtggatctggtcagtgtcggtgacgccatcgctgggggagggggcgtttattatgagcctctccatgctgttcgtgccgctggtggcctggggtatgatgggcgtgcgcccggcgcgggcctactgggagtgcctgccgctggcgattatcgggctggcgctgttaagcctgcacgtgcccatcacctttaacgccagccagggctggtttttactcaccgcctttgtgcagtcgatctccttttgctacaccagtcgcgtcgcccgcgacgtgccgctgatcccgctcaccaccgcgcagctggccatcaccggcctgagcgcgctgttgatctccgcgttgtttgagccctggacgcagggtatcagcctcagcacctttggctggctaatcgccagtattttcatcgccactgcgctgcgctttggcctgcaattgcaggggcaaaaacacgccgccgtcgccagcgccgccatcattatggtgctggagccgctgctgacggtgatcgccgcctcggtgtggtacggcgaacggctgccgctgcagaagatcatcggcggcgtgctgatcctcgtggcgcaaatctggttccgctggcggatggtgaaacggctgcctgcgtagggttactgtttgtcggtgcagaccggcatcaggtgctgacgaccgcagaccgctgccgtcgccagcgccagcatcatcaccacttccacggcgagaaagccgctcagcgccgacgaataatttccctggctgcgcgccagcagatgcaggaacagactccctaacaccgccgggccaaggccgagcgtcgcctgttgcagcgtgctgagaatggcgctgcccgctccggcatcacgggcggcgatatcccgcatcccgatacgataaaagctgttcacaattaacgcctgtccgtagccaatcagcgccgtggacggggccagcgccagcgcgcccaccacccggccggaggcggtcagcgtggcgatcagcgccagcaggccgagcacctgaatggcgatgccggtcagcaaaatggtgctggtggcgtggcgggcaatcagtctgggggcatagcaggcggaaacaaaataggcgacgccgagcgcgataaaactgtttcccgactgccacggcgccatgcccatgcccgcctgcatcgtcagcgccatacagaacataaagccggaccaggcgctgaaaaacagcagggcgataagaataccgaaacggatgctggcgagcttcagcaggcgtggcggcagcaacggttgcaggccacgctgttgctggcgcgcggcatcgctgcgcatccacagcgccagcgggatcaccgccagcagcgccgccgttgtcggccacggccagtgcagttccgggccgagggccagcgggaacagcagacaacagaggatcagcgccagcagcagcgtgccgcgccagtcgatacgtgacggcgcatcgctgcgggtttccggcacgtaacgaggcgtcatcgccagtaccagcagacagatcggcacgttaatgaaaaaggcattacgccagcccagcccggcgatatccgccgacaccagccagccgccgcccatctgcccgatgataaaggcgatgccgccaatgccgccgtacaggctgatggctttcgcccgcgcgctgcccgacagcgtaacgtgcagggtagcgagaatttgcggcacgatcagcgccgcgcccatgccctgcaacgtgcgggcagccagcagcgcgccaaccgagttcgccatgccgcacagcagcgaggcgaggccaaaagccgccacgccccacataaatacccggcgacgaccaagattgtcgccgagcttactgcccatcgccagacagaccgcaaaggccacgccgtacagcgcgacgatcagctccagctgggtggcgctggtatgcagcgagccggtaatggaatcaagggccacattggtaatagaggtgtcgatcagcggtaacatttgtccggtcagcaggacgatcagcgccgcccgacccggcgaaacagcagaggtatgcatggtaactccattgcgtcattcatcagatggacgtagcatcgcggaatcattaaacgggtaccagttcttgcttatactggtactggcactaccatgctggggatgattatgacgatgctggttgaccgggcggcgacgctgaccattcaggatgagaaccgcaaacagcttggcgcgttcttacgtgcgcggcgggaaagccttgatccgcagcgtctggggctgccgcgcagcggtcggcggcgcacgccaggcctgcgacgcgaagaggtggcgatgctcgccgatgtcggcgtcacctggtacacctggcttgagcaggggcgggaggtgaatccctcggcaacggtaatgcaggccattgccactgcgctgcaatgttcccccaccgaaacccggcatctgtttgtgctggctggcttaacgcctggtgaaatcccgccgttgtccggctgcgaactgatcagcgacggcacacgccgactgctcgacagtctcaatccgcagcccgccagcatccagcgcccgagctttgacatcgtggcgtggaacgacagctttagccgtctgatgggcgttgatttcgcgctgatccccgacgatgagcgcaactgtatctatctgtatcttaccaatcccgtctggcgcagccgcctgggagtaagtgatacggtgttgcagacctttgtggcctatttccgcgcggcgatggcggaacaccggggcgagccgttctgggagaataaactggcgcgcttttttgccgtctcgccggaattcgaggcgctgtggcataaacgctatgaggtgtctggcgtagaaaataaaataaaaaccttcagccatccgcagctgggggaattcaccttgcagcagatgtactggtattccgcgccgcgtaacggctcgcggctgctggtttatctgccggtcgatgcggcgggagagcaggcgctggcatttctggcgcgcggctaagcagcggcagtattattccgggcgaatacgctgacgcgcttttttcggcaggcggtccaccaccagatgccaggcgtcgaggatcagatcctccaccaggccttcgctgatatcctcgcccgcgtagattgagatccagtgttttttattcagatgccagccgggctcgatgctcgggtagatctgccggttgagcagcgatttttgcggatcggctttcacgctgaccagcggacgcccgcgggcggtggcggtcatcatgaaaatcttaccgttgaccttaaagacgtcgatgtcaggaccaaagggccagcagtgctcggtaaaggggagttccagcgccacgcgatgcgcgcaggcctgtagggttttgctgtccattattcttcctcaatggacagggcgcgccacatcgcttcaaagccgtgggctttaatatcaaccgcccgctcaggctggcggctggcgaattccatggtggtttccgccagcgataaaaacaacgcatcgccgaatgcgcgaaattcttccgtcataaataccggcaacaatgaacggcgacacagctgacgcagttccgggaacatgtcttccacgatttgcagcgtttcgggggtgatcttttcgctgacggcgagctggcggatcgccccatggccgttgagattacaaatgccccagtcgatatagcgattccagatatggcgggtaaaacgctttggatcgctctccgaacggtcgagatccgccagcattgcctggcagagatcgcttttcagatgcacatagagggcgtttaagaggtcgtctttcgtggcgaagtagcgaaacaaggtgccttccgccacgcccgctttacgggcaatgagcgcggtggacgccgtgatgccggattgcgcaatagcttctgtcgccgcatccagcagggcctgcttcttatcttcacttttcggacgagccactacagatttcctcacattgggcaaaaacgctgattgaatcatgccagacgcgatgtcgcaacgctctgtgtcaaagatcgaaaatcgacttgacgactttcgatgcctttctataatgagtgcttactcactcataatcaagtttgcacttatcgttccagcggacaggagcgattttttttgagccaggatatgaaacgactccttttcagcgtggttattgtcatgttagtcgcagcaacggccagtttaccttttgtcctgaatgcgggcttcggccagccgccgcagggcgcacagcttactgaagtggaaaaatcgccgcactatcgtgacggtcagtttcataacgcgctgcccacgccgggttttaccggtaagaaaaatatgctggcggcgtggtgggagtttctggttaccaaacgcgagaacgcccgtccggcgcagccgctgccgatggtgaacaccgatctggcgggcctgccgttgcaggaagacaccgtcgtctggctggggcactcatcctggtacatgcagctggcaggcaaacgcattctcatcgacccggtgttcagcaattacgccgcgccgttttcctttatcaataaggcctttgccggagagtatccgtggcgggcagagacgatgccggacatcgatctgctgattatttcccatgaccattacgatcatctcgatcacgccaccattaccgcgctgctgccgaaagtgaagcgggtggtgacgccgcttggtgtgggatcgcatctgcgctactggggtatggatccggcgattatcacggaagccgactggaaccaggcggtgcaaatcagcgaagatctgcgcgtgcacgtgctccccgcgcggcatttctccgggcgcggcctgaagcgtaatcagacgctatgggccagctttatgctggaaaccccggcgcgcaaggtttactacagcggcgataccggctacggcccgcatttcagggcgataggcgagcagttcggcagcgtcgatctggcgatccttgagaacggtcagtacgacgaagactggaaatacattcatatgatgccggaagaaaccgcgcaggctgccgttgatctgcatgcccgcgccgttttacccggtcacgccggacgctttgtgctggcaaaacacacctgggacgacccgtacaaacgcctggccacagccagtgagaaccgggattaccggctgcttacgccgcgcctgggcgaacctgtacatgccgccgacgcgctacagcagttcatcgcctggtggcggtaatccatcctgatataactttcgaagagcagagggggagaaaaatgactatttccgctcaggttatcgacactatcgtcgagtggatcgacgacaatctgcatcagcctttgcggattgatgacatcgcccgccacgcaggctactcaaagtggcacctgcaacgcctgtttatgcattacaagggtgaaagtctggggcgttatattcgggagcgtaaactgcggctggccgcgcgggatctgcgcgacaccgatcagaaggtttacgatatttgcctgaaatatggctttgattcacagcagacctttacgcgcatctttacccgcactttccatcagccgccgggagcctatcgccgcgagaatcacggcgtcacgcattaagatccagagcaggggcggggcttagacccagtccctgacctgaataaactcgctcagtgccgcttccgggctgccggtttccggctgatagttatattcccacgccacctgcggcggcagcgacatcaggatcgattcggtgcggccgccggtttgcaggccaaacagcgttccgcgatcccacaccagattaaattccacataacgcccgcgacggtacaactgaaaagcgcgctcgcgctcgccgaacggcagcgatttgcgtttttcgacaatcggcagataggcgcgggtataaccttcgcccaccgcctgcataaaagcaaagcactgcgcaaagtccggggtgttcagatcgtcaaagaacagcccgccgatgccgcgctgctcgttgcggtgttttaagaagaaatagtcgtcgcaccattttttgtagcgtgggtagacgtcttcgccaaacggcaggcagagttcccgggcggtacggtgccagtgcacggcgtcttctgcaaaaccgtaaaacggcgtcagatcaaaaccgccgccaaaccaccataccggatcggcgccgggcttttcggcaatgaaaaagcgcacgttggcatggctggtgggcacatacgggttatgtggatgcaccaccagcgagacgcccatcgcctcaaaagagcggccggccagctccgggcggtgggcggtggccgaggcgggcatggccgcgccataaacgtgggaaaaattcacgcccgcctgctcaaacacgccgccgttgcgtaacacgcgggtacgcccgccgccaccggcttcgcgctgccagttatcttccagaaagtctgcgccgtcgacggcgaaaagctgctgacagatctcgtcctgtaattgcagcaggaaggcttttaccaggttagcgtcaggtgtggtcattaacgttttctcgaatgcgctttctggttatcgaaccagttgaagtaactgatgacgcctgacgcaatggcgctggcgatcttctgacggaaggcggcggtgccgagcaatttttcttccgccggattggtgatgaatgacgtctccaccagcaccgagggcacggatggcgatttcagcaccacaaacgccgcctgttccgtgtgcttactgtgcagacggtgcaccggtttaatctgcttcagaatatgcgagcccagcgtcaggctgtttttgatggtgtcggtctgcaccaggtcgaacagcacctgctgcaaaaggtgatctttatcggtggcttttttaccggccagctcatccacggcgttctcgcgctctgacaggtatttcgccatcgcgctactcgcgccgcgattggagagagcgaacaccgacgcaccggcggcattgggattagtaaagccgtcggcgtggatcgacataaacagatccgcgccgtgcttatgggcaatctccacgcgatcgtagagcgggataaaggtgtcgccggtgcgcgtcagacgggcatcaatgcctttgctgcgcagaatggagcgcacgtttttggcgatcgccagcaccacatgtttctctttcgagccgttaccgccaatcgcgccggtatcaataccgccatgaccgggatccagtaccacgacacggcgtgcgccgctttttttcgccttcggctggctatgactgttggcaaccttcagcgacgcttcttctttggcgagggcttttgacatgccggacagcgtaagaacggccagaccggctttgagcacctggcgacgcgaggtgagtgtttttaagggtttgaatgtgttcatacggcctgaactgtaaaaaaggggtccgtggtgttatatcgtatcgtgttatccgttacgacactcgttgttaagaattgttttacttttcatttcaatacgtgacagagtcctagtatgccattttttcgcgctgacttcgccggatattggtttccccggcacttcacgccataatcaacgttttagcctgaaaagagtaggtcaaaccatggagatacgcgtatttcgccaggccgatttcgaagaagtcattaccctgtgggagcgttgtgaactcctgcgcccgtggaacgatccggaaatggatatcgaacgtaaggtaaatcatgacgtcagcctgtttctggtggcggaagtgaacggggaagtggtgggtaccgtaatgggtggctacgacgggcatcgcggttcggcctactatcttggcgtgcatccggaatatcgcgggcgcggcatcgccaatgccctgctcaatcgtcttgagaaaaagctcattgcccgcggctgcccgaaaattcagattatggtgcgtgaagataacgacgtggtgctcggcatgtatgaacgtctgggctacgagcatgccgacgtgctcaatctgggcaagcgcctgattgaagatgaagaatattgagtttttacccgccgattttgaccagcacggacgcttacgcctgcccctgatgctctggtgcgtgctgttattacaggcgcgcacctgggtgctgtttgtgatggcgggggcatcccgtgagcagggcagcgcgctgctgagcctgttttatccggaccacgatctgttctggtgggggctgttaccgggtcttccggcagtgctgacgtttttgttcagcgggcgtcgtcagcactatccgcgcttgtggccgctgttgcgtggcctgttgatcctggcgcaactggcgctgctggtctggcagccgctgctgtggctgacgggcgaggacatcaccggcacgggattaaccctgcttgcgatcgacagttttgccctctggtggttgctcaccgaccgccgcctgcgcgcctgcttcacgccggaggcgtaatcacggcactttttgccgttctggtactccaactggcgttaactgaaataaaaaggaagtcatcatgaaatcgctgcgtttactgttatgcgctacgccactgctgcttaccggctgctccacgctcagcaacgttaactggtcggcggcgaatccgtggaactggtttggctcgtcactggaagtcaccaaagagggcgtcggcgatctgacgggcagcacggcgctcaacgaagacgccatcaacgcggcgctgggcggagattatcgcctgcgcagcggcatgaaaaccgaaaacggcgccattgtgcgttatttcgaagcgctgaaaggcgacgaactggcgatggtgatccagggcgagcaggggacggtcagccgtatcgacgtgctggacaaagatattgaaaccgccagcggtaccgccatcggcacgccttttggcgatctctatgacaaagcctacggcaactgtgaaaaagccaccggcgacgacagcaacgccgtagaatgccgggcgaaagagagccagcacatcagttatctgttcagcggaaactggagcggcccggaaaacctgatgcctgccgatgacgccctgaaaaactggacgctgacgaaaattatctggcgtcgctaatttgcggcggatcatctgtccctgagaaaaaacgggtacaatacgcccatcaatgccacggtcgcgtggcatctttttttcaggagcgatcgatgtctcaggtacagagcggcattttgccggaacattgccgtgcggcaatatggatggaagcgaacgtcaggggcgacatcaacgccctgcgcgcaggcagtaaaatttttgccgataaactggccacctttcaggcggcatacccggacgccgccctcggcgcggtggtggccttcgggcataacgtctggcgcgagctgagcggcggcgtgggcgcagccgaactgaaagatttcgtgccttacggtaaagggctggcccccgcgacccagtacgacgtgctgatccacattttatccctgcgtcatgatattaacttctccgtcgcccaggcggcgctggaagccttcggcgatgcgctggaggtgaaagaagaagtgcacggtttccgctgggtggaagatcgcgatctgagcgggtttgtcgacggcaccgaaaacccggcgggcgtggaaacgcgtaccgaggtggcggtgatcaaagacggcgtggacgcgggcggcagctatgtatttgtgcagcgctgggaacataacctgaaacagctgaaccgcatgagcgtgccggatcaggagatgatgattggccgcaccaaagtcgccaacgaagagattgacggcgatgcgcgcccgatcacctcgcacctgtcccgcgtcgatctgaaagagaacggcaaggggctgaaaatcgtccgtcagagcctgccttatggtaaggccagcggcacgcacggcctttacttctgcgcctactgcgcccgcctgtacaacattgaacagcaactgctgagcatgtttggcgacaccgacggtaagcgcgacgccatgctgcgcttcacccgtccggtcaccggtggttactattttgcgccatcgctgtcgcggttattagcgctgtaaaagctctgttgattcgcaggccgggtaagccttagcgctacccggcaatttccctgctgccttattctcttttcaacttgcaaatcaccaaacggtatataaaaccgttactcctttcgtactgcttataaataaactgtgatccgaacagtctttctacttataagggtgcgcaccgccatgaccaaacttaaaaaaggatatctgacgcttgcagcatccctgttgctggtggctcaggcgcaggcaacagaactgcttaacagctcctatgatgtctcccgcgagctgtttgccgccctgaatccgccgtttgaacagcagtgggcgaaggacaatggcggcgacaaactgaccatcaaacaatcccatgccggttcttcaaaacaggcgctggcgatcctgcaaggcctgaaggctgacgtggtgacctataaccaggtcactgacgtgcagatcctgcatgataaaggcaagctgatcccggcggactggcagagccgtctgccgaataacagctcgccgttttactccaccatggcgttcctggtgcgcaaaggtaacccgaaaaatatccacgactggaacgatctggtgcgttctgatgtgaagctgatcttcccgaatccgaaaacctccggtaacgcgcgttatacctatctggcggcctggggcgctgcggcaaaagccgacggcggcgataaagccaaaactgaaaaattcatgacccagttcctgaaaaacgtcgaagtctttgataccggcggacgcggcgcgaccaccacctttgtggagcgcggcctcggcgatgtgctgatcacctttgaatcggaagtaaacaacatccgcaaacagtatgaagcgcagggctttgaagtcgtggtgccgaaggtgaatatcctcgcggaattcccggtcgcctgggtggataaaaacgttaaggccaatggcacagaaaaagcggcgaaagcttatctgaactggctgtacagcccgcaggcgcagaccatcatcaccgattactactaccgcgtgaacaatccgcaggtaatggaaaaactgcaggataaattcccgcagaccgacctgttccgcgtggaagatcagttcggcagctggcctgaggtgatgaaaacccacttcaccaccggcggcgagctggacaaactgctggcggcggggcgtagctgatgtttgccatgtcgacccggcgcgtgctgccgggctttaccctgagtcttggcaccagtttactgttcgtctgcctgattttattactgccgttaagcgcgctggtgatgcagctggcgcaaatgagctgggcgcagtactgggaagtgatcactaatccgcaggtggtggcggcctataaagtcacgctgctgtcggcttttgtggcgtccattttcaacggtgtgtttggcctgctgatggcgtggatcctcacccgctaccgttttccggggcgtacgctgctcgacgcgctgatggatttacccttcgcgctgcccacggcggtggcgggcttaaccctggcgtcgctgttttccgttaacggcttttacggccagtggctggcgcagttcgatattaaagtcacctatacctggcttggtatcgcggtggcgatggcctttaccagcatcccctttgtggtgcgtaccgtacagccggtgctggaagagttaggcccggaatacgaagaagccgcgcaaaccctgggcgcaacccgcttacagagtttccgcaaagtggtgatgccggagctttccccggcgttgctggcgggcgtggcgctgtcctttacccgtagtctgggggagtttggcgcggtgatttttatcgccggtaacatcgcgtggaaaacggaagtgacatcgctgatgattttcgtgcgcctccaggagtttgattatccggcggcgagcgccattgcctcggtgatcctcgcggcatccttactgctgctgttttccatcaataccctgcaaagtcgctttggccggcgtgtggtaggtcactaatggcggacgttacccaattgaaacgctttgacgcgccccgtattaactggggcaaatggtttttaattggcaccgggatgctcctttctgcgttcatcctgctggtgccgatgatctatatcttcgtgcaggccttcagcaaagggctgatgccggtgctgcaaaaccttgccgatccggacatgctgcacgccatctggctgacggtaatgattgcgctgatcaccgtgccggtgaacctggtgttcggcattctgctggcctggctggtgacgcgctttgattttccgggccgtcagctgctgctgacgctactggatattccgttcgccgtctcgccggtggtcgccggtttagtctatttgctgttttacggctccaatgggcccctcggcggctggctggacgcgcatgatatgcagatcatgtttgcctggcccggcatggtgctggtgaccatctttgtgacttgtccttttgtggtgcgcgagctggtgccggtgatgttaagccagggcagccatgaagatgaggccgccattttgctcggcgcgtccggctggcagatgttccgccgcgtcaccttacccaatatccgctgggcactgctctatggcgtggtgctgaccaatgcacgcgccatcggtgaattcggggcggtgtcggtggtatccggctcgatccgcggtgaaaccctgtcgctgccgttacagatagaattgctggagcaggattacaacacggtaggctcctttaccgccgccgccctgctgacgttaatggctattttgaccctgtttttaaagagtgggttgcagtggcgtttgcacaatcaggaaaaacgcgcgcaacaggaggaacatcatgagcattgagatcgccaacattaagaagtcattcggacgcacccaggtgctcaatgacatctcgctggatattccttccggacaaatggtggcgctgctggggccgtccggctccggtaaaaccacgttgctgcgcattattgccgggctggagcaccagtccagcggccgcatccgttttcagggcaccgacgtcagccgtctgcatgcccgcgatcgtaaagtcggcttcgtgttccagcattacgcgctgttccgccatatgacggtgttcgacaatattgcctttggcctgacggtgctgccgcgtcgcgagcgtccggatgccctcgccatcaaagcgaaagtcactaaattacttgagatggtgcagctggcgcatctcgccgatcgttacccggcccagctatccggcgggcagaaacagcgtgtggcgctggcccgcgcgctggcaccggatccgcagatcttactgctcgacgagcctttcggcgcgctggatgcgcaggtgcgtaaagagctgcgccgctggctgcgtcagttgcatgaagaactgaaattcaccagcgtgttcgtcacccacgatcaggaagaggcaatggaagtcgcggatcgcgtggtggtaatgagtcagggcaacatcgagcaggttgatgtgccggagcaggtgtggcgcgaaccggcgacccgctttgtgctggaatttatgggcgaagtgaaccgtctgaaaggcacggtacgcggcgggcagttccacgtcggcgcgcaccgctggccgctgggttatacgcctgcccatcagggggacgtggatctgttcctgcgcccgtgggaagtggacatcagccgtcgtaccagtctggattcgccgctgccggtgcaggtcatcgaagccagtccgaaagggcattatacgcagctggtggtgcagccgctgggctggtatgacgaaactttagccgtggtgatgcgcggagatgatgcgccggtgcgcggcgaacggctgtttgtcggcctgcaacacgcgcgtctgtaccacggcaatgagcgaatcgaaaatcacgaagaacagccgctggcggaatccgcgtgaggacgtaatgcccggtggcgcttcgcttaccgggcctacataatggctccttacctgtaggccgggcaagcgaatgtgccgcccggcaaaaaaacacaaccctgtcgcttttttatttcctccacacactcgaaatgcaggtaaggtcacactgactttcattccactgccatttcctcataatgacttgtcattcattatgcgctctaataaaacccataaatggtaatacctgttatcaggagcgccagcatatggatattaaattaagtcaggattttttcctgtcggacatccatgccttttgtctttttaaattaaacaatcaggccatggcagatattcacgggcatgaattcgatgagttggtaattgtatgtggtggctgcggatttcatgtcattaacgatcaggttgagttaattcaccagggtgattttttttacgtgtcggcaaatgatgtacattattataatcagactagtcatttgtcacttatcaatatactgcttcacaaacagcgtccgtttcattttattcatcatgtagatgatctgctggtaatggtaaaaaaacacactgtaccctttacgcagcactatcagccgcttggtgaaaatgaactccggcaggtgatcgccgaggcggcagcagtaagcgcacgacgcgatgacagctatgactgcgcctattttgcgcatactgaatcgcggctgctggggatcttctccacgctgtatcagtgtatcgaacagtcggcgcatcgcaccgctccgggcggcaacggtgtcctgtatttactgaattatattcgtcataactatccgcagcagattcactggcagagcttatgcgaaatggcggggctttcccagcgcaccatgtatcgagcttttcacgatctgaccggagttactccgcaaaaattccagcaaatttttcgtttattaaaagcgcaggagaaattgcgtaccaccgatttgccagtgaaaactattgccacgcattgtggctttattaatgccccgcatttaaccgaaatgtataaaaaacacttttcacgtacgcccacacaggagcgccagttaagccgttcggtcagcgaaacatgatcctctaatgggtggtcaataataaggaaatggagtgaatgttatggataaaaatacacaaccgaatgcctggtatgtgggcgtcgtttcgggcatggcgtcttatatcgactcagcggccattgtttctaatggcactgcgctggttatttatcagaaagcgatcggcaccacagcgacagaaattggcattttgtcgggcatattaaccttatgcatcgcactgggtgcctgcgtcggcgggcgtctgggggatcgcctcggcaggcgtaacgtctttatcaccaccatggcgatgatcgtggccggtacgctattactggcgtttggcaaactcttcccgctgttatttatcggcacagtactggtggggctggcgaccggggccgatctaccggtatcgctcgccaccatcgccgaagccgccagcgatacgaatcgcggcaagatcattggcctgtcgaatttgctgtggacgctgggcattggcaccaccatggcgatctccgccgtggtgggcggctggggggcgacgggggcgcaaatcatgtatctgcatgtgggcgtggtggcggcaacgctgctggtgctgcgctggtcgatccctgaatccccgctgtggctgacggcgtgcgacgagcgattacgcggcgtgagtacggtacgggcgcaaaaagttgcgtttaaagatctgctgcgcggcaaatacgcatggccttttttcgcgctgtgtctgttttattccttcaccaatctggcagcaaataccggcgggcagtttggcacctatgtggcggttaatgttgtcggcatcagcgtggagcaaaattccttgtggaacctgctcatcatgccggtcggtatggtatccggcctgttgtttatgaaagtcgtggatacggcgcaccggatgcggatttttgtagtgggtgcctgtttttttgctggcggattttttatgccggtgctgctgagcttctcgccgctgtcgtggttctgctgtctgttgtttaccggtatcggcagcggtctggcgttcgagggcatcatgaaagtctggtcgcaggagtctttccccaccatgctgcgttccaccgcgcagggcgctattgtcggcctgtcacgtctctcctgcggcattctcgcctttgttaccccggtgttgctcgatgccgggcctgttgtgctctacaccattttatcttctatcgtcgcctcggggttgttgatcggctggctgtgcttccatggccagcagcgcaatgaattcagccttgaggccagcgaattacaggacgaatttaaacaccttcagcaataaggagtcagaattatgctggcagtaagcaagatcaccctcaattatgaacccggactgtgcggcgtggacgcatttccgctggtgggctggcaaattgtcagcgatcggcaaaacgtctatcaacaaagctggcggctacagtgcagtacggacgccgcgttttcacagcttcactatgacagcggtgtggttacggataacgcgtcggcgaatatcacgctgccggacatcccgctattgccttcgacgcgctatttcctgcgcgtgtgtatcagcgataacgatggcgaacagagccgctggagcgaggccgcagaattcgtcactggtatgctaaatgccccctggcaggcggattttatctcggcggaaacgccggaaaatcgccaccagtcgaacggcaccttgctgcgtcataccttcaggctggcagataaagctatcgcggtggcctttgtccacgtcaccgcacttgggctttaccatctttatctcaatggccaacgggtgggcaatgatgaactggcccccggctggacaagctataagcagcatttgctgtatcagacctgggatgtcacagcacaactccgtcagggcaagaatgccattggcgcggaagtaggcgcaggctggtttaaaggggacatgggctttatgcggcaccgcaatttttacggtgagcaaacggcgctgctctgccagctggtggttcgctatgacgacgggacacagcaggtgatcggttccaatgacggctggcgcacggatgcctcgccgatccgcttttccgaactctacgatggcgaagtgtatgacgcccggctggtgcaagatggctgggcgaatacggagtttgacgatcatgggtggcgtccggccagcgtggtgacttttaaccggcaggcgctgaccgctcagggcgcaggtaaggtgaaggcgcaggaaacgctgttgcctcaggctatcatcaccacgccgcagggcgatacggtgattgatttcggccagaatatgagcggctgggtggcgttttgcgttaacggccagcgtggcgacagggtggtattgcgccatttcgaaacgctggacgctcagggaaatgtctatctggacaatctgcgcagtgcgcagcagcgcatcgaatacatccttagcggcgatggcgaagaaacttaccatccacacttcacctttcagggctttcgctatgtaaaagtggagcagtatccgggccggattgaggctgagaattttaaagccattgtgctgcattcggatatgcagcaaaccgggcgatttagctgttcacacgcaggccttaatcagttacatcataatattttatggggactgaagagcaatttcgtcgatgtgccgacggactgcccgcagcgtgacgagcggctgggatggacgggcgatgcgcaaatcttctgccgcaccgccagctacctgatgcaaacgcgcaactttttcgccaaatggctggccgatctgaaaattgaccagacgccggagggcggcgttcctcatgtgatcccggatatactgaccgggcactgcgaggctgaccgttttttgtccgctgggggaactcattcgtcatccgcctgggccgacgcggcggtggtgaatccctggacgctgtacctgatgtacggcgatacccgcattctggacacgcaatatgacagtatgaaagcctggatcgactttatgcatgctcacgctgacaatcacctgtggcgttacaaattgcagttcggtgactgggtggcgctggataccgccgaaggtagctattttggcgccacgcccgattcgctgatttgtaccgcctggtatgcgtattccaccgggcttttcgcccgcgcggcggcagtgctgggtcgccatgatgatgcggcgaattaccgggcgttatatcaggccattgtgcagcactttcacagcgaatttttcaccgctgacggcgcgatgaccgccagaacccagacggcgcatattctggcgttgtatttcaatcttgttcccgatgcctggcgtcagcgcacggtagatacgctggtggaattgttggcggaacaggagggacatctggtaacaggcttcgtcggcacaccctatttttgtcatgcgctgagtcagaacgggcggatcaacgaggcatgggctttgctgatgaaagacgatttcccgtcatggctgtatcaggtgaacgccggggcgaccaccatctgggagcactgggacggcatcagaccggatggttcaatgtggagtcctgacatgaactcctttaatcattatgcctacggagcggtaggggagtggttatatcgtgcggtggcgggtattgaggtcgacgaggcacagcccggctttaagcacgtcattatttccccgctgccgggcggtgaggtgagttttgttgatgccggttatcagtcactgtatggcgaaatcgccgtgcactggtgtcgtgttgatgggcgcatccgactaagcgtgcgtattccggcaaacactaccgccacgctgaaactcgccgcctgcgagattattgtggcgggcgggctggcgtttacgccacacggttcgcaatggtgtgcaacaaccggctcgggggcgtatcaggtggaatatctgcctgctgacgataaggcataagggcttttgccgggcggcgcattcgcttgcccggactgggttggtttgcatgcccggtaatcatagcgccatcgtgcaacacagaaacgtcacagtgaatatagacctgaccgggcgtggctgataagttatcgccatcttgtttttgccgggtggtccaggtctgggttatgcatgtaagcccggtaagcgaagcgccaccgggctttttattggacagcgtttgtgaatacattagaagacactatcggcaatacgccgctggtgaaactccagcgcatgactccggataacggcagtgaaatctgggtcaagctggagggcaataacccggcgggatcggtaaaagatcgcgcggctttatcgatgatcgttcaggcggaaaagcgcggtgaaattaaacccggcgatgtgctgatcgaggccaccagcgggaataccggcattgcgctggcgatgatcgccgcgatgaaaggctaccgcatgaaattgctgatgccggacaacatgagccaggagcgcagggcggcaatgcgcgcctatggcgctgaactggtgctggtcagcaaagagcagggtatggaaggcgcacgcgatctggcggctgagatggcgcagcgcggcgaaggcaagctgctggatcagttcaataatcctgataacccttacgcacactacaccaccaccgggccggaaatctggcagcaaaccggcgggcggatcactcactttgtctccagcatgggtaccaccggcaccatcaccggcgtatcccgttttctgcgcgagcaggaaaaagcggtgaccattgtcggcctgcaaccggaagagggcagcagcattcccggcatccgtcgctggcccgctgaatatatgccggggatctttaatgccgcgctggtggacgaggtactggatattcatcagcgtgaagcggagaataccatgcgcgagctggccacccgggaaggcatcttctgcggcgtcagttcaggcggcgcggtcgccggggcgttacgcgtggcaaaggccacgccgggcgcggtcgtggtggccattatctgcgatcgcggcgatcgttatctctccaccggcgtgtttggtgaagagagttattctcagggttcaggcatctaaaggaggcaacaatgaacatggtgttgttcaacgataaaaccagagcgttacaggcggatattgtcgccgtgcagtcgcaggtagtttacggcagcgtcggtaacagcattggcgtgccgaccatcaaacgtcaccatctcaatgtgatcgccgttccgacggtgctgctcagtaataccccgcattacgataccttctacggcggcgtgatccccgacgagtggttcagcggttatttacaggcgttgcaggagcgggatgcgctgcgccaggtacgcgcggtgaccaccggttatatgggcaatgcgtcgcagattgctattctggcgcgctggctgacggcgctgaaggcgcagcatcctgatctgctgatcctggtggacccggttattggcgacatcgacagcggtatttacgtcaagccggagctgccggacgcctatcgccagcatctgctgccgctggcgcaggggctgacgccgaacgttttcgaactggaagtgctgaccggcaaaccgtgccgcgatcatgacagcgccattgccgccgccaaagggctgctctctgattccctgaaatggattgttatcaccagtgcgccgggcgttgccgacagcgacgacatgcacgtggtgctggtcacggcagacagtgtggaagtgatcacccatccgcgcgtggcgacagatttaaaaggcaccggcgatctgttctgcgccgagctgaccagcggcatcgtaaaaggcttaagcctgagcgacgcggtgaaaaaggcgggaacgcgggtttttgaggtgatgcgttatacgctggataccggccgtgatgaactgctgctgccgccagacctggtctgaacgcaaagtgacaggcaaaaaaaaggcaccctgaaggtgccttttttatgtgcggcaagaattacttcttgatgcggataaccggggtttcgcccacggtcacgctaccggacagtttgatcagctctttgatttcgtccatgttggagataacaaccggcgtcagggtagacttggctttctcttccagcagtgccagatcgaactcgatgaccgggtcgccaactttaacgcgctggccttcttcggcgatacgtttgaaaccttcgcctttcagttcaacggtatcaataccgaagtgaacgaacagctcaatgccgctatcggattcgatagagaaggcatggttggtttcaaagattttgccgatggtaccgtcaaccggtgccaccattttgttgccggttggtttgatagcgatgccatcaccaacgattttttcagcaaacactacatccggcacatcttcaatattgacgatctcgccagacagcggagcgataatctcaatggttccggtatctttcttatcgtcagaaaccagagatttcagtttatcgaacaaacccatgatcttctcctaagcagtaatttgggccgcatctcgtggattagcagattgttttttcttcaatgaacttgttaaccagcgtcattaactcgtccgttgtcggttgagcaagagcctgctctgctaataccttcgcatcttcgaagttcgtgttacggataatcttcttaatgcgcgggatagaaatggcactcatactgaattcatccagacccatccccagcaacagaagtgtagcacgttcatcgcctgctagctcaccacacatgccagtccatttgccttcagcatgagaagcatcaatgacttgcttgataagcgtcagcacggacggtgacatcggctggtaaagatgtgaaatcatatcattaccacggtcaactgccagcgtatactgcgttaaatcattggtaccgatgctaaagaaatcaacttctttcgccaggtgacgggcaatggtcgctgcggcaggggtttccaccatcacgcccacttcaatgctctcgtcaaaggctttaccttcgtcacgcagttcctgtttatagatctcgatctcttttttcagcgtgcgcacttcttcaacagagatgatcatcgggaacatgatgcgcagtttgccgaaggcggaggcgcgcaggatggcgcgaacctgatcgcggaggatctctttacgatccatagcgatacgtaccgcacgccagcccaggaacgggttttcttctttcgggaagttcatgtacggcagctctttatcgccgccaatgtccatggtacggacgataaccgcttgcgagccacaggcttctgcaacggctttataggccgcaaactgctcttcttcgcttggcagagagtcgcgatccatgaacaggaattcggtacggtacaggccgacaccttccgcgccgttacgctcagcaccgtctacatcgcggacagtaccaatgttggcgcacacttcaacctgatggccgtcgagcgtgattgccggcagatctttcagcttcgccagttcagctttttcgctggcgacctgttcctgcacggcacgcagtttttcgatctcttcgttggtcgggttgacgtaaaccagattgtttacggcatccagaatcagatagtcgtcgtttttcacctgcgaggtgacgctaccggtgcccacaatcgctggcagctcaagggaacgcgccatgatagaggtatgggaggtacggccgccaacgtcggtgataaagcccagcaccttcttcaggttaagctgtgcggtttcggacggagtcagatcggcagcgaccaggatgacttcatcctgaattgcgctgagatcgataatcgccaggccaaggatattgcgcagcagacgtttaccgatgtcacgcacgtcagcggcgcgttctttcaggtattcgtcatccagctcttcaagagcggtggcctgaccttcgataatttcgtgcgcggctgcatcagcagtgacgtgcttatctttaatcagggctatgatttcctgctcaagctcctcatcttcgagcagcataatgtgcccttcgaagatggcttctttttcttcaccgaaagtttcgccagctttagtcttaatggcttccagttgcgctgatgccttggcacgaccgctcagaaaacgttcaacttcctgatcaaccttgtcggcagaaatttttttccggtcgatgacgatctcgtcttctttcagcagcaatgctttgccgaaagcgatacccggggatgctaaaatgcctgaaatcataaccctaccttacttgtgactgatttttaaaagaacccgtgaacttactcgagttcagccatcagtttaaccagatgctcaacggctttctgctcgtcttcgccttctgcggacagcgtaaccacagtaccctgagtcagacccagagtttgcagtttgaacaggcttttagcactggcgcttttgccattggaggtcacagtgatctcagaggagaagccttttgcttctttaacaaactgagcagcagggcgggtatgcagaccgttcggagcggtaatggtaacttcttgctggaacattgtatttccccaacttataggtttagtgttgtggaactaaagtctagcctggcggcttaactttagcctgtattgttagcgccgagagtaacgggacgcgatacagaagcgtgttgacgcaaatccgggccggaaacttctggccgttaaggtttcgtccgtcattaatcattatgccgcgaaagcgagacctgaaccaaatgattaaatcgattcagctggcacaaagtcacaattcgattaatttcgcgcttcgaaataaatgtggtgcttaaataccagacctgcaggggcgaagcaatgctgtgcgagcggaaactttgacgtgcgccacaaaaaagcaccctgacaggtgcttttttgcgcgattttactgtgcggacattactgttgcagttctttttcagtgaagagatcggcaaacagcgcagtgctcaaataacgctcacctgaagaagggagaataacgacaatattcttgttggtaaaggtttcgtcttcctgcaatttcaatgctgccgctacggcggctccggaagagatgcctgccaggataccttcttcttccatcagacgacgcgcggtgtcgatggcttcttcgttagtgatggtgaccactttgtcgataagcttaagatccaggttgccaggaataaagcctgcgccgataccctggattttatgcgggcctggcttcagctcttcgcctgccagcgcttgcttgatcaccggggagtcggtcggttcaaccgccacggtgatgagatccgttttgcctttggtatttttaatataacggctcacgccggtcagcgtaccgccggtgcccacgcctgcgataaacacatcaacctgtccgtcggtatcttcccagatttccgggccggtggttttttcgtggatttccgggttcgccgggttgctgaactgctgaagcagcaggtatttggatggatcgctggcgacaatttcttccgccttctggatcgcgcctttcatgcctttcgcgccttcggtcagcaccaggttcgcgcccagcgctttcagcagcttgcggcgttcaatgctcatggtttccggcatggtcagcgtcagcttgtaaccgcgcgcggcagccacataggccagcgcgataccggtgttgccgctggtcggttcaaccagttcaacgccctgtttcagcacaccacgtttttcggcatcccaaatcatattggcaccgatacggcatttcacgctgaagctcgggttgcgggattcaaccttcgccaggatgcgtccattgccgatgcggttcagtcgaaccagcggcgtatgaccgatagtcaacgagttgtcttcaaaaatcttactcatagcccgtccttaactgtatgaatttgggaacgtcatcagcatacgcggttaagaatgatgcggaagtaaggatttcgcatatctatatgctgatgagaaataatgacaacaagtatggaataagaagaggaataatccactcacttccacagcgcgtgttttggccgataacagtccacccacatcgccgttgcgccgcataccgccaccggcatgatgaccaggttaaggaacgggatcagcgtaaacaggctggtcagcgcgccaaactgcatatttgtgaccttttgctggcgtaacgcctcgcgcatggttttaaagggcactttatgattatcaaagggataatcgcagtactggatcgccagcatccaggcgctgaacaggaaccacagcacgggagcgaccgtctgaccaatgccagggatgaaataaagaagcagcaacaccagggcccgcggcagataccacgccagtttctgccattcacgcttcatgatgcgcggaatgtctttcatgatggcggcgatccctgcatccggcggcgttgcgccggtcagacgcgcttccagctgttccgccagcaggccgttgaagggggccgcgatccagttggcgagggttgagaagaaatagccgaacaccagcaccaccgaaatgaccaccagaggccacagtaaatagctcagccactggagccagtcgggtacgtgggacataagttgcgggatccagctgtcgagctgtaaaaagagccataaaaaagcggcgcccatcagcagaatattgaccagcagcggcatgatcacaaagcggcgaatgccggggagggtgatgagcttccagccctgagaaaagtaccagacgccgctacgaggcgcggttgcagatgataaacccatatcaggccagactcctttattaacagccagggaaagtgcacggctatattagcggtttacgcgccgctggctagttcggaaatgttcgaaaaaacagcaaaaagcacgattttgttcatctttatgcagtgaaagccatgtgtgcacttgcacttgcgggaatcggcaaatactcttagtgagtaaatgtttgccgtggtggcaaggtgttagaacaacagagaatataatgatgcaggatttgcgtctgatattaatcattgttggcgcgatcgccataatcgctctgctggtacatgggttctggaccagccggaaagagcgctcttctatgttccgcgatcgcccattaaaacgcatgaagtcgcgtcgcgatgatgaaccttttgaggatgacatcgacgaagacgccgacgatggcgtaggtgaagttcgggttcaccgggttaaccctgcaccgggaacagcccctgagcaggatgccccgcgttcgcctcagcaccagtatcagccgccttatgcgtcggcacagcctcgcccgacggcacccgtgccgccgcgtgacagcgcgccggtggcttatgaggagccgccgcgtcagccggtacagcagccgcagcagcctgttcatcaacagccagtgcatcaacaaccggctcagccgcaacccgtacatcaacagccagttcatccgcaaccggctcaacaacagcctgttcaccagcagcctgtcacgcatcaaccgcagcctgcgccgcacgtcgagccgcagtacagcgcgccgcagcagccagaacccgctccagcgcccgtcgttgaagagccggttatcgcgcctgaaccgccgaagcgtaaagaaacggtgatcgtgatgagcgtagccgcgcatcagggtaccgaactgaacggtgatgtgctgcttaacagcattcaacaggctggctttatgttcggcgacatgaacattttccatcgtcacctcagcccggacggcagcggcccggcactgttcagcctggcgaatatggttaatcctggcacctttgatcctgaaatgaccggcaacttcaccacgcctggcgttactatcttcatgcaggtgccgtcttacggcgatgagttgcaaaacttcaagcttatgctgcaatctgctcagtacattgctgatgaagtcggcggcatggtgttagacgatcagcgccgtatgatgacgccgcaaaagctgcgtgagtatcaggcccgcattcgcgaagttaaagaggcaaacgcataaactgcgtatggctgttctaaccccttcctgaacccccgcctgtcgggggtttttattattgatggtgtgttatggaatcaatcgaacaacaacttacagaactgcgaaccacgcttcgccatcatgaatacctgtatcacgtgatggacgcgccggaagtgcccgatgccgaatacgatcggctgttgcgtgaactgcgtgaactggaagcgcagcatcccgacctgatcacccccgactcgccaacccagcgcgtgggcgccgcccctttaagcgcctttacccagatccgccacgaagtgcccatgctgtcgctggacaacgtctttgatgaagagagctttctggcttttaacaaacgcgtgcaggatcgactgaaaagcaccgacgcgctgagctattgctgcgaactgaagctggacggccttgcggtgagtattctttatgagaacggtgtgctgatccgcgctgccacacgcggcgacggcacgaccggtgaagacatcaccaccaacgtacgcaccatccgcgccattcctctgaagctgcacggtgacaatattccggcgcgcctcgaagtgcgcggcgaagtgttcctcccgcaggcgggatttgagaagatcaacgaggaagcccggcgcactggcggtaaaatttttgccaacccgcgtaacgccgccgcgggctcgctgcgccagcttgatccgcgcatcaccgccaaacgcccgttaaccttcttctgctacggcgtcggtattctggaaggcggcgaactaccgcgcagccatcttgaacggttacagcagttcaaacgctggggactgccggtcagcgaccgtatccgcatttgcgacacgccgcaggcggtgctggatttttatcacaaggtcgaagaagaccgcccgcagctgggtttcgatattgacggcgtggtgatcaaggtggactcgctggatctccaggagcagctcggctttgtcgcccgtgcgccgcgctgggcggtggcctttaaattcccggcccaggagcagatgacctgggtgcgcgatgttgaattccaggtggggcgtaccggtgccatcacgccggtggcgcgtctggagccggtgcatgtcgcgggggtgctggtcagtaacgccacgctgcataacgccgatgaaattgcccgcctggggctgaaaatcggcgataaagtggtgatccgccgcgccggggatgttatcccgcaggtggtgaacgtcattgagtcggagcgtccggcgaatacccgcgaagtagaattcccgacccattgcccggtctgcggctcggatgtggagcgcgtagaaggcgaagcggtaacccgctgtaccggcggcctgatctgcggcgcgcagcgtaaagaatctcttaagcactttgtctcgcgccgtgccatggatgtcgacggcatgggcgataaaattatcgaccagctggtggagaaagagtacgtccatacgccagcggatctgttcagactcaccgccgggaaactcaccgggctggatcgcatggggccgaaatccgcgcagaatatcgttaacgcgctggaaaaatcgaaagagaccacttttgcccgtttcctgtacgcgctgggcattcgtgaagtgggtgaagccaccgccgccgggctggcagcctatttcggcacgctggacgcgctgatcgccgcctccatcgacgaactgcaaaaagtgccggacgtcggcattgtggtcgccacccatgtgcgtcacttcctggatgaagagagcaacagggacgttatccgccagctggtggaagaagtggggatccactgggcggcacctgtggtggtcaatgccgaagaaatcgacagtccgttcgccggtaaaaccatcgtgctgaccggcagcctgagccagatgtcacgtgatgatgccaaagcggcgctgctggcgctgggggcgaaggttgcgggcagcgtatcgaagaaaaccgatctggtgatcgccggcgaagctgccggatcgaagctggcgaaggcgcaggagttggggatagaggtaatcgacgaggcggagatgatccgtttattgggtgcgtgaaatggataaagcgcagctgattgaaatcgccaataccgaaatgccctttgggaaatacaaagggcgcaggctgattgatttaccggaagagtatttgctgtggtttgcccgtaaggatgaattccccgccgggcatcttggtcagctgatggcattcaccctgctgatcaaaaccgaggggctgacgcagctggtacagcccctgcgacgtccttaaccctgcgtggcgtcggaggcggccgcctcctgcgcctgcaacacttctgtctgatgcttatagcgtcgcgccatcaccgcacagaccatcagctggatttggtggaaaatcatcagcggtaacaccatcatgcccaccgccgacgcggggaagagaatgttcgccatcggaataccgttggcgagacttttcttcgagccgcagaaaacaatagtgatctcatcagccttgttgaacccgaagcggcgggcggcaaagatattgatgccgatgataatcgccagcagcacaatgctgacgacgacaataaacagcagcgagcctgcgcccactttatgccagatgccgttcaccacggcctcgctgaaggctgaatagaccaccagcaggatcgacgtctggtccgttttcgaaatccattttttatgcttagtcacaaagcctgcggtccacggacgcgacaggtggcccagcacgaacggcagcagcagttgcagcataatttttcctacctgctcaaggctgccttccgcgccatgcatattcatcaccaggcccaccagcagcggcgacaggaaaatccccagcagactcgacgctgacgccgaacagacggccgcggccacgttacccccggcaagggaagtaaaggcaatggcggactgcacggtggcgggcagaatgcacagatacagaaaaccggtgtatagctccgggctgacgttaaccggcgcccaccaggcaaacaggacgcccagtaccgggaacaccacaaaggtgctgcacatcacccacagatgcagccgccagtggctgccgccggcgatgatggcttcgcgggagagttttgcgccatgcataaagaacagcagggcgatggcggcggtcgtcagtccctcaaaaaagggcacaaagccaccgcgcgccgggaagaacgacgccagtaataccaccgccaccagcgttaaggtgaagggatcgagaatgcggaaaattttcataaacactcctgaagtcagtatcgttattctgcgtttttctctctgcgaaataaaagtcatttctgtcattcatttatgaaacagataggttaaggatccgatacgtgcaattcagaagagtaaaaaaggcagggcgggggaaaggcccggcggaaagccggagccagatgcagttgcgcggttaaatataaatatcgatcttgtggtcgtcagacgggttgttgacgccttcggcctgggtcagctgtttttgctcttgtttcttttccgcttctttggcctgctcgttttgcagctgcgccagctgcgcctggagcatctggatctgcgcgcggatctgctcctgctgcttttgcttttcttcgacagtgcctgagccgttcgccacttctttcagctgcgcggtcagtttgttgattttctgcgtcagacggctgatctgcgccgcggtgtcgttccctgcgctggacgagccagcgctgccgccggtttgcactgacggggtggtcgtcgagatggtggtcatgatgaactccttgtttgccataaaattgttttatcggcatttttcagcagagcttgagactcgcactctttaccattgccagcgtaaataattctgaggacattttgctgacccccgccattgatacagaggcgctatcaataggcaccgaaaagtgtattggtcaggaaagccgatgactcgttataaagccagagtacccgcggaaccctctccgcatggcaatacataacgattaaggacgcgccatgacctcttcgcatttttcagatcatccttttacctgtgctgacatcatccgcgcacgcaaacccaacttcaccccacgcgtggcctttattttaggttccgggctgggcgcgctggcggatcagattcaggatgcggtagccatctcttatgaagacttaccgggcttcccggtcagcaccgtccacggtcacgcgggagagctggtgctcggtacgctggcgggcgtaccggtagcctgtatgaaaggccgcggacacttttatgaaggccgcggcatgacggtgatgaccgatgcggtacgtacctttaagctgctgggctgcgaactgctgttctgtaccaatgctgccggatcgctgcgtccggaagtcgggccgggcagtcttgtcgccctttcagatcacatcaacactatgccgggatcgccgctgtgcgggccgaacgatgaccgcttcggcgaacggtttttctccctggcgaacgcctatgacgcggattaccgcgcgctgctgcacaccgtggcgcaggaagcgggtttcccgctcagtgaaggagtgttcgtctcttactccggcccgaacttcgaaacggcggcggagatccgtatgatgcagattatcggcggcgatgtggtgggcatgtccgtggtgccggaagtcatttccgcccgccattgcggaatgaaagtggtggcggtgtcggccatcaccaacctggcggaagggctgggggaggtgaagctttctcatgcgcagactctcgcggcggcggagctgtcccgccagaacttcatcgacctgatttgcggtttcctgcgcaagctggcctgataatcacacctaccgctccgctggccggggcggtttgtccttctgcgacaaggaaaagactatggggatcacggttcgcttaaaaatcatgtcgtttttgcagtatttcatctggggaagctggctggtgaccctcggttcgtacatgatcaataccctgcattttaccggcgcaaatgtggggatggtctacagctcgaaagggctggcggccattatcatgccgggcattatggggatcatcgccgataaatggctgcgggcggagcgggcttacctgctgtgccatctggtgtgcgccggggcgatgttttacgccgccagcgtcagtacgccggatctgatgttctgggtgatgctggtcaacgcgatggcctttatgccgaccattgcgctgtcgaacagtatttcttactcgtgtcttgcgcaggcagggctggatacggtcagccattttccgccgatccgcgtttacggcacagtgggctttattatcgccatgtggacggtcagcctgatggatctggaactgagcagcgcccagctctatatcgcctctgcttcatcactgtgccttgcggtctactccttaacgctgcccagaatcccgacggtggcgaaaaaagtgtcgcagtcgtggagcagtaagctcggccttgatgcttttgtgttgttcaaaaatccccgtatggcggtgttttttctctttgccatgctgctgggcgcggtgctgcaaatcactaacgtgtttggcaatcccttcctgcatgactttgcccgccagccggagtttgccgacagcctggtggtgagatacccgtcgattttgttgtctgtatcgcaaatggcagagatcggttttatcctcaccatcccgttttttctgcggcgttacggcataaaaacggtgatgctgatgagcatggtggcgtggatgctgcgctttgggctgttcgcctttggcgatccgtcgccgttcggctgtatgctgctgctgatgtcgatgattgtttacggctgcgcttttgatttcttcaacatttccggttcggtgtttgttgagcaggaggtcagttcagagatccgcgccagcgcgcagggcctgtttatgaccatggtcaacggcgtcggtgcgtatgtcggctcaatcctgagcgggctggcggtggattatttttccgttgatggcgtgaaggactggcagaccatctggctggtgtttgctggctatgccctggcgctggcggtgatcttttatttcgcctttaactataaacatcaacctgataagcgcgcagatgtggtacgttcagaggtttaatgatcctcgcaggcgtgcgaatctgatggaaccgctgtacaaaatcgacctgaaactgctgcgctattttctggctgtggcagaagaactgcacttcgggcgggctgcggcccgccttaacatgtcgcagccgcccctgagttttcacatcaaagacctggaaaaccagctggggacgcagctgtttgtccgccattcccgcagcgtggtgttaacccatgcgggaaagattttgctggaggagtcgcgccgtctgctgagtaacgtcaaccaggcgctggcgcgggtggagcagatcgggcgaggcgaggcagggcgcatagagttgggcgtggtgggcacggcgctgtggagcggcatgcgtaacgtcctgtatcgctttctgaaggacaatccggacgtcgaggtgcggtttcgtgagaaatcacccggaaggcagcagacgctgctggagcggcgggaactggatgccggtatctggcggatggcgcaggatctgcccgccgggctgacccgccagcgggtgcagcaggcggcgtttctggtggcgatgccggatgagcatccgctgacggcccgctcatccattccgctgtcgctattgcgcgatgaacattttgtcacgctgccgtcggtgcattctgactgggcgttcctgcaacgggtctgccagcgggcgggattttcaccggtgatcgtgcgcgaagcggtggagccgcaaacagtgctggcgatgatcagcatggggatgggcatcaccctgatggcggacagctacgcgcaaatgcagtggcccggcgtggcatttcgcccgctcgaagaacgtattcccgcggatttgtatgtggtgtatgaggaaaaacaggtgacgccggtgttagcgggtttactggcggcgctgacgcatcaagcgtaactcatgcccggcagcgcaggcttgccgggcatgggcgcggttggatcttgtaggccgggtaagcgcagcgccacccggcaaaaaacgcatagcaaaaaggcgcctttagggcgcctttccacattggtgggtcgtgcaggatgactcgcttcgctcgcccttcgggccgtcgccgccagcggctccgttgtctcgcttcgctcgacccgaacctgcggcaggttctcatcctgcatttcacgcatagcaaaaaggcgcctttagggcgcctttccacattggtgggtcgtgcaggattcgaacctgcgaccaattgattaaaagtcaactgctctaccaactgagctaacgacccgaaatggtgggtgatgacgggctcgaaccgccgaccccctccgtgtaaaggagatgctctaccaactgagctaatcacccatttcggtactgctgttgataaggtgagatatggtgggtgatgacgggctcgaaccgccgaccccctccgtgtaaaggagatgctctaccaactgagctaatcaccccacgtctcaagtcttatctgcactgcgggtctacctttaagtagatggtgggtgatgacgggctcgaaccgccgaccccctccgtgtaaaggagatgctctaccaactgagctaatcacccccgctgtgtggagtcgcattatagggagagttgaaaatgagtcaacgccttttctaaagattttgtttgttcgtcgtaaaattaaacaacgtggcgacaaagcctgcattcgcgcatgatttctcaacaaaaaacggatttgccgcgcccatggcggtaacaacattgaggaatcagcctggagtgatagaatattgcccactcgattttccaggacttgccggttatcggcatctttatcaacgtaaggccaattcatgaaaattaaaactcgcttcgcgccaagccccactggctatctgcatgttggtggtgcgcgtaccgcgctctattcctggctttttgcacgtcatcacgacggtgagtttgtgctgcgtattgaagacaccgatcttgagcgctctacgccggaggctatcgaagccatcatggacggcatgaactggctgagcctggagtgggatgaaggcccgtatttccagactaaacgtttcgatcgctacaacgcggtgatcgacgacatgttaaaagttggcacggcgtataaatgctactgctctaaagagcgcctggacgcgctgcgtgaagaacagatggcgaagggcgaaaagccgcgctacgacggccgctgccgtcacggtcatgagcatcatgctgacgacgaaccctgcgttgtgcgttttgctaacccgcaggaaggttcggtaatttttgacgatcagatccgtggcccgattgagttcagcaaccaggagctggacgatctgattatccgccgtacagacggttccccgacctataacttctgtgtggtggtggacgactgggatatggagatcactcacgtgatccgcggcgaagaccatatcaataacaccccgcgccagattaacatccttaaagcgctgaatgcgccggtgccggtgtatgcgcacgtatcgatgatcaacggcgacgatggcaaaaaactatccaaacgtcacggcgcggtcagcgtcatgcagtatcgcgacgacggctatctgccggaagcgctgctcaactatctggtgcgcctcggctggtccagcggcgatcaggaaattttctcccgtgaagagatgatcaagctgttttcactcggcgcggtcagcaaatccgccagtgcgttcaacaccgaaaaactgcagtggctgaaccaccattacatcaacaccctgccgccggaatacgtcgccacccatctgcaatggcatatcgagcagcagaacatcgacacccgcaacggtccgcagctggcggatctggtgaaactgctgggcgagcgttgcaaaaccctgaaagagatggcggagagctgccactacttctaccaggacttcgaggagctggatgcggatgcggcgaaaaaacacctgcgtccggtagcgtgtcaaccgctggaagtggtgcgcgacaagctggcggccattaccgactggacggcggaaaatgtgcatcacgctattcaggctactgcagacgagctggaagtggggatgggcaaagtggggatgccgctgcgtgtggcggtgacgggcgcaggccagtctccggcgctggacgttaccgtgcatgccatcggtaaaacccgcagcgttgagcgcatcaataaagcgctggaatatattgccgcacgcgaaagccagcagtaattctttcaggtcagcataaaaacgaacggcaggtttatcctgccgtttttttatttgcctgcggcgtccctgtcatggatgtcgaggcggctcagcatgtactgcaatccttccctcttcaacagacgatccagttgcgtttcttcggaagacgtcattgtttgtaaaacgctgacgatctgacgcagtgctggcgatatattgccataaggggcaggggcttcagccagtaaacgaccagctgcaagatgacgaaattttggcagcttcataataaaagcccgcaccttattatcgataaggatctgccttcctcgtccaccttttacgccggggatcttttcggtgtgccagccgtatctgcggatccagcgattcaccgtctgttttgtcatgccaacataatcagccagctcttcagtggttaatctatcaggtattttcatcatgttagttctggtcgcgcagaccgagccgttgtaataagccgctgatgccctcgcgtagcagcaaggaagtcagctgtttttgttctgccggggtcatttccttcgccagcgtcattaaaagcgcttccagcgagggctcaaggccgtacgcctcgtcaccggtactgtcatcgatcgcgcggcgcgcattgcgtataaattcgcgcacctgctcattgatatgcaccagacgggcttttccaccctgaacgcctggttttggcgaggtaacccagccttctttacgcacccatttattgatggtctggcgactgtatcccgtgagcctggcgagctcatccggcgtcatccgttccttgatcatgcaatttcctgacgagatgtgggggttagtggttcatcttatagcaccctttaacaggaaagtgtgacgggtttaactaacgtctgcgagcaggctcgcaatgtcattcatttgactgctttttcagcgattgagcggcgctttctgattttgccgttgacacctcgcggcggaattcatattatgccgcccgtcaacacgacacgctttacgcattggggctatagctcagctgggagagcgcttgcatggcatgcaagaggtcagcggttcgatcccgcttagctccaccaaattctgatcccaacagatttggtgcgtaaataacattgtggggctatagctcagctgggagagcgcttgcatggcatgcaagaggtcagcggttcgatcccgcttagctccaccaaaatttgaaccctcgcctgtggcgggggtttttttatgtctgttgcaaataccgcttcctgttatgtcagttttcttctgtttatcctggataattcctgtaaacctctgtttattgtattgccgcgctaatatcccgcgcttagcttgcctgatattgagaatgaacttattattccggctcggattaacgcggttggtgagattaaatcagtaaacataatgaaaattaatatttataaacacgcaacactatttatacttgcattcattatttgtctcgcagccgttacaacttcccgaattctttcaccaacagcgctggtccaggcgggggatgcttttctggcctggttacccttgagcgcgatgctgtccattattctgctctttggtcgacgaagtatattgccgatcgtcgtggccttcgcgttaataaatcactggctgatggatctctccttacgtgaggccgtgttactgctcttttgccagatcgcgccggtactgctggcctgcgcccttgtgcgatggcggctgggcagccgctggcgttacgcctttccggataaatacatgggtgtccggatattctggttaggatttttcgcgcccgccggtattaaactctcaatgtatttagcgaatgaatggttcgattatccggtttccctttccaacttctcggatcccacgtcggttatttataatattattgatttgcagagtcttatctgcgccgtgctaattttcacccccttgttttattatccgctacgcatgctggtgaacccgcactatgcccgtactttctggcgtcgcagtattattccgattttttctttgcgtaaacgtatttttactgttagctggttgttggctttaagttttattctgatcgttctttgtagtcccatcgaagcgaaatatatcgccggttacctggtgccaatcgtattcatcctgtttatggtcgccgtgcgggaattcacgccgccgctgatcgcgttaagctgggggatcgccgcgtggttcctggtggcctacaatcgcaattttctgcatggcgtcggcacagactattcgctggcttttgtgctgtcggtgctcatcgcggtgacaatctgtattctctatacggcgcatatttatcaccgtagcgagtggctcaggcgggtatggaaatctcaggcgcttaccgacccgctgaccggcctgcccaatctgcgtgccctggagcagcatctggaacagcatccccacgtggtcgtgtgctgtctgcatttgcaaaacctggaatttttaagccgtcactacggcatgatgatgcgcgtgcactgtaagcgcagcattgcccgcgacctgcaaccgctgatgctggcgcatgagaagctgttccgcctgccgggaagcgagttattactggtgctggatgggcaggagccagaagcgcgtttgcagcatatggtggattatctcaacagccggaaaatcttctggcacaacacgccgattgagattgaatttggcgcgtcctggggcgttatcgaaggcgcgggcgaaaacctgcaccatacgctgggacagcttagctggctttccggtcaggccagcacgacacagcgcgtactggcgctgacgcaaagtatcgacagagtcaccgaccagactaccgggcaggtgctgatgttgaacagcgtaaagcgcgcgctggaagaggggggactggtgctctacgcccagccggtccggagggcggatggcagcggctaccacgagattttaacccgtctgcaatgcgacggcgaaatcgttaccccggatcgttttatcccggtgatcagccgttttaatctcagtccgcgctttgacatgctggtggtcgaaaccctgttgcgctggctacgggcgcatccggtcccctgcgacggggcgcgtttttccgtcaacctgatgcccatgacgctgatgcaaaaggcgtcggcgacagaacttatcgcgctctttacgcgttacggcgtgtcgccacagtgcgtgattatcgagatcactgaagagcaggccttttcccatgccgaagccactttgcataacattcagcaactgcgtgatttcggctttaaaatcgccattgatgattttggaaccggctacgccaattttgagcgcttaaaacgtctgcatgcggatattattaaaattgacggcaccttcgtaaaagacatcgagcgtgacccgttagatgcgatgatcgtgcaggcgatttgcacgctggcgaaagcgaaatcgctgacggtggtggcagaatttgtggaaacgcaggcgcagcgtgagctgctgctggagctgggcgtggaatatttgcagggatatttactgggtaaaccgcagcctttaggcgactaaataaaaaaaccgggacaagcccggtttttattaacaccgcagaattacagtaccagcgcggcgattgatgcagacaggatactcaccagcgtcgagccgtagaccagtttcaggccaaagcgagagaccacgttaccctgttcttcattcagacctttaatcgcaccggcaatgataccgatggacgagaagtttgcgaaggaaacgaggaacacagacagaatgccttctgcgcgcggggagagggtgccggcaattttttgcagatccatcatcgccacgaattcgttagataccagcttggtggccataatactgcccacctgcagggcttcatgagatggcacacccatcacccaggcgaccgggtagaagatgtagcccagaatgccctggaaagatataccaaacacggtcgcaaacagagcgttcagcgcagagatcagcgcgataaaaccaatcagcatcgccgccacgataatcgccactttgaagcccgccagaatgtactcacccagcatttcaaagaagctctggccttcgtgcaggttggccatttgcagattttcttcgctctcatcaacacggtacgggttgataagcgacagcacgataaaggtgctgaacatgttcagaaccagcgcggcgacaacgtatttcggttgcagcatggtcatatacgcgcccacgatggacatggacacggtagacatcgccgtggccgccatggtgtacatgcggttacgggacatattgccgaggatgtctttgtaggcgatgaagttttctgactgccccagaatcagcgagctgacggcgttaaaggattccagtttgcccataccgttgacttttgacagcacggtaccaatggcacggatcacaatcggcagcacacgaatgtgttgcaggataccgatcagcgcagaaatgaagacgatagggcacagcactttcaggaagaagaatgccaggccttcatcattcattttgccgaagacgaagtttgtcccttcattggcgaatccgagcagtttttcaaacatttcggagaagcctcttacaaagcccagaccgacatcggagttcaggaagaaccaggccagtaaaacttcaataacaagaagttgaataacaaagcgaatgcgaatttttttgcggtcgctgcttaacaacaaggcaagcaaggccacaacggcaagcgccagaacaaagtgaagaacgcgggacatatttgctccaaatatgaggcaggtttaatttccgtgcacattctatgcaacaagcgtaaagaaaacgagatcaaaaacacactatagtaactacctgtgacgaatctcaaaaatagtgatcaaacatacatttctgttatgttacgtaaagatgagaaaaggctaatattgctgctaagcttttaacaaattgatgaggcaaatgttaagagcgcctttccacctgcacattccttccggctatcgctccgggctatcagaacaatcagtttaaccaaatcaggtgatcttgataatcattctcattttgttagcatgaaacatagcaaaggctatatcaggggcataaatgaacgacagtcgcgttgagagtaacagtggtcgtgcggcgcgcaagcttaggttcgcattaatgggacctgcgttcgttgccgctatcggttatatcgatccaggcaactttgccaccaatattcaggcgggagccagttttggctaccagctgctgtgggtagtggtctgggcgaacctgatggcgatgctcattcagatcctgtctgccaaactgggcattgccaccggtaaaaacctggccgaacagatccgcgaccactatccgcgtccgctggtgtggttttactgggtgcaggcggagatcatcgccatggcgacagatctggcggaatttatcggcgcggccatcggctttaaattactgctcggcgtatcgctgctgcagggcgcggtgctgacgggtatcgccacttttctgatcctgatgctgcaaaaacgcggccaaaaaccgctggaaaaagtgatcggcggcctgctgctgtttgtggcggcggcctatatcgtcgagctgtttttctcgcaaccaaaactggcggcgttaggtaaagggatgctgatccccagtctgccgactaccgaggctgtgtttctcgcggcgggcgtgctgggcgcgaccattatgccgcacgtgatctatttgcactcctcgttgacgcagcatctgcatggcggatcgcgcaaagagcgctattcggccaccaaatgggatgtggcgatcgccatgaccatcgccggttttgttaatctggcgatgatggcgaccgcggcggcagcgttccatttcagcggtcacaccggcgtggccgatctcgatgaagcctatctgacgctggagccgcttctgagccacgcggcggccaccatttttggccttagccttgtggcggcagggctgtcatccaccgtcgtcggcacgctggcgggacaggtagtgatgcagggctttatccgcttccatattccgttatgggtgcgccgtaccgtgactatgctgccgtcgtttattgtgattttgatggggctggatccgacgcgcattctggtgatgagccaggtgttgttaagcttcggtattgcgctggcgctggtgccgctgctggtctttaccagcgacagcaaactgatgggcgagctggtcaacacgccgctggtaaaacgcattggctggctgatcgtgttgctggtggtggtgctgaatatgtggctgctggtgggaacagtaacaggtctttaattcgtgattaaaaagcccggcaatgccgggctttttttgtattaatgatgatggccatgaccatgcccgtgacgaccgcgtccaccgtggtcatcgcgatcgcgccagccttcacgatagccgcgctcgtaggctttacgtttgtcccagccgcggtgatagccgcgatcgtgtggacgccagcggttttcacgccattgatagtgatgatgccagtaatcacggtcgcgccagcggccgccgtcccagtagttaccgtaattatcacgatcgccaatttgtaattttattgagggcagcagggtgatttcgccggcatttgccaccagcggggcagaagccattaaaacagctgccagtatcagtgacctgaacatacttatctccttcacgatcggggccgaaacggcctgttaatgcaatattacggggctgtaaagccccggtgcattggtttaactcttaaatcatgaagggcagcattatttgctaaaagtgctgttattccgggctgttcagtatgtggtcgatggcggtacattcatccgcgctgaagtggcgatttgccagcatgccgaccgcatcgtcaatctgcgccactttacttgcgccaatcagcacggacgttactttatcgtcacgcagcacccaggccagcgccatctgcgacagcttctggccgcgttgctgcgccagatcgtttaactgacgcaccttacgcagttttgcttcggtgagctgatcggggttgaggaaacggctaccgctggcggcgcgggaatccgcaggaatgccctgtaaatagcggtcggtcagctgtccacccgccagcggcgagaaagcaatgctgccgacgcctttctccgccagcacatccagcaattcatcttccacccagcgctcaaacatcgaatattttggctgatggatcaggcagggcgtgccgagatcgttaagaatatcaattgcctgccgcgccatatccgccgggtaattcgacaggcccacgtacagcgccttgccctggcgtacgatgtgatccagcgcgcgcatggtctctttcagcggcgtttccggatccgggcgatggtgatagaagatgtccacatactcaaggcccatgcgtttcaggctctgatcgaggctggcgataagatatttacgcgacccccagtcgccgtaaggaccctcccacatggtgtagcctgccttcgtggagatgatcagctcatcgcgccacgggctaaaatcttcctgcaggatacgaccaaagtgccgctcagcggagcccggcggcggcccgtagttgttggcgagatcgaaatgagtgatgccgagatcaaaagcccggcgcagcagctggcggctggtttctactagggtggcgtctccgaagttatgccacagccccagcgacaccgccggtagctttaaaccgctctcgccacagcggcggaactccatctttttatagcgctcaggatcggcctgataaaccatgcattaatcctcaattggcagacgtaacatcagtgtatacgtttacaccagctttgagactttgctgaaacggtaaagttattctgtgatgaagctcaataatatacaggcactcgtgctatggtcattgttgttaaagcgccttgaatttacagtgtgccaaagaatttttctgacttcagcggagcagtaaaaagaatgacaaagtatgcattagtaggtgacgtgggcggcactaacgcacgcctggcgttgtgtaatgtcgacagcggcgagatttcccgcgccaaaacctattccgggctggattatcccacgctggaagccgtggtccgcgtctatctggacgagacgggcgcagaggttgaggatggctgcatcgccattgcctgcccgatcactggtgactgggtggcgatgaccaaccacacctgggaattctccatcgcggaaatgaagaaaaatctcggctttgcgcatctggaaattattaacgattttaccgccgtatccatggcgatcccgatgctgaaaaatgagcatctgacgcagttcggcggcggcgagccggtagaaggcaaacccattgccgtgtatggcgcgggcactggccttggcgtggcgcacctggtgcacgtcgataagcgctgggtcagcctgccgggcgaaggcggtcacgtggattttgcgccgaacagcgaagaagaggggattatccttgaagagctgcgcagtgaaatcggccacgtttcggctgagcgcgtgctttccggtccggggctggtgaatctgtaccgcgcgattgtgaaatccgacggacgtctgccggaaaatctgcaaccgaaagacatcaccgagcgcgcgctggaagacagctgcatcgactgccgccgcgcgctgtcgctgttctgcgtgatcatgggacgtttcggcggtaacctggcgctgacgctcggcaccttcggcggcgtatacatcgccggtggcattgtgccgcgcttcctcgacttctttactgcctccggcttccgcggcggctttgaagacaaaggccgcttcaaatcctacgtgcaggatattccggtctacctgatcgtgcacgacaacccgggtctgctgggcgcgggtgcgcatttacgtcagacgctgggctactacctgtaagggttacaggtgcattaactgcctgaactctttgactttgctgcgactgaccgggacctgaaaatcaagatcccgcagtcgcagaatataggtgttgttaaaccagggttcgatttcgcggatcttgtccagattcacacagtatgagcgatgacagcgaaagaaatgcgctgccggtagtttgctgcaaaactccgtgatgttcatcggcatcacaaattcatcgcgccgggtatacacgaacgtcatcttctcatgcgcttccgcatagtaaatatcgtgaatactggtaacgatgatgcgctcatctttaatcagattgatggtatcgttttcacgcaccgccgggctgccggaacctgcgccagtctgctgctgccatgcagtctccagcttttgcagcatattgatgatgcgtgattcctgataaggtttcagaatatagtcaaaagcttccagctcgaaggcttcaactgcatgttctttccacgcggtaataaatacgataaagggtttatgggcaaactggctgatattctgcgccagtaaaacgccgtccagcgacgggatattaatatccagaaacagcgcgtccactttgttgtgctgcaaaaacttcagcacgtccaggccgtcgtcaaaggtgccgacgatctccatctggctgtgttctttgatgagccagctcagctcctgctgcgccaggatctcatcttcaacaatgatgactttcatggtgactctcctgattattgcaacagcgtgaccggcgcgggcaggggcgcgcgatcgtgcggcacgtagaaggcgatttccgttcccggctccaggcggcgaatatgcagcccttcgccgtacagcagttttacgcggtgatgcacattgagtaagccgattttattgccgggcatctcattggcctcgacccgctcaatgacctgcggatcgataccgttgccagtatcgcgcacggcgatacgcaccctgttaccgcactctgccacgctgatggtgaccacgccttttcctttacagggctgaatgccgtgcacgatggcgttttccaccagcggctggatcagcaggcttgggatcacacagttaacttcctcgtcgatgtcataaatcaccgtcagtttgtcgccaaagcgcgcctgctcaatggcgatgtaatccttgatttgatacagctctttcttaatatcaatttgctcatcgtctttcagttcaatgttatagcgcaggtagcgcgataaattgtaaatcagctgccgggcggtatccggattaaggcgaatggaggacgaaatggcgttcagggcgttaaacagaaaatgcgggttaattttgctttgcagggcacgcagttccgctttattggccatctcccgcaactgctcggcgcgggacacttccagctgcgtggaaatgatttgcgacaggccgatcgccatctcctgcaacgacgaagtaatttgatgcgcatggcagtagtagatttttaacgtgccggtgaccacgcctttttcccatagcgggatcaccagcatggagtggatttccggcgtgcgatgcgcctcatcattgtttttaatgatgattttaccggagttgatcgcttcaaaggtggtggggctgataatgtcatcgctgtcccggtagttgttttctccgataccgacgtaggccagcacatgatcgacgttggtaatggcgacggcatcggcatgaatatcgcggcggataatatcgcagacctgacgcagggattccgtattcacatggcggaacagcggcagcgttttgttggcaatatccagcgccagcttggcctgccgtgctgcgctggcctcctgctccccttcgacactctgcaccagcagcacaataaagccgatacatacggtaccgaggatcatcggtataccgattttcgacacgatatccagccccagcgcggtagtcggcgcccagagcaccaccaggatcatggtcagggtttcgcacagcatcccggcgataatgccgatgcgccagtggtgcgctttcggcgttttgaggttgatccagcccgccagacaaccggcaataatactggtgataaaacagggaatggccgtcacgccgccaatatcgatcagatagcgatgaatacctgcaatgatgccggtaataatccccacccaggggccgaacaggatcccgccggacatcaccgcaataatacggacgttgaccagcgacccctccaccggcacgccggaccaggtgctgaacagcgcaaacatggaaaagatggccgttacggccagcagctctttaggcgagtgggcggttttatgcagcagttcgcgaaacaggcgcatgcggatcaggaagaacagacaaatcagcattaacgccgcccgatcaaagaccgccagcagcatgttaaatatttcgtgcacggaaaactcgtgtgaatagcgtggaaaagagatgataaaaaatctgacgccggatgaccagttaacttccgcaaagggttaagaggaaaaaccctgttttcaaaaggggattgtgacggacgggcagtcagcgaatggcccgccgtgaaaaacgtcaatggtgggtaatgctctttttatcatcatgttaacttgctgttttatttgtgccttatatcgtgcagcttgtctggtcagacgaaaaatgccttccgctttttcgtggctgataaattattttccgttgcccctcgacagcgggaatttgttcaggctattttctaaacatgccacgcagtggcagcgtcgctcggacggtccgggcgctaacgttacatcgaggaatctatggctgactccagtccagtacgtcgctttacgcgcatcgaacgtcttcccccttatgtttttaacattaccgctgaactgaaaatggccgcgcgtcgccgcggtgaagatattattgatttcagtatgggcaaccctgacggcgccacgccgccgcacattgtcgaaaagctctgcaccgtggcgcaacgcccggatacccatggctattccacatcacgtggtattccacgccttcgccgcgccatttcgcgctggtatcaggagcgctatcaggtggatatcgatccggaaacggaagctattgtcaccatcggctcgaaagagggactggcgcacctgatgctggccacgctcgatcatggcgataccgtgctggtgccgaatcccagctacccgatccatatttatggcgcggtgatcgccggggcgcaggtacgttctgtgccgctggtggagggcgtggacttcttcaatgaactggagcgcgccattcgtgaaagctatccgaagccgaaaatgatgatcctcggtttcccgtcgaacccgacggcgcagtgcgttgagctggagttcttcgagaaagtggtggcgctggcgaagcgttatgatgtgctggtagtgcacgatctggcttacgccgacatcgtctatgacggctggaaagcgccatccatcatggaggtgcccggcgcgcgcgatgtggcggtggaattctttaccctgtcgaaaagctacaatatggccggctggcgtattggttttatggtggggaatcaggagctggttagcgcgctggcgcggattaaaagctaccacgattacggcacctttacgccgttacaggtggccgcgattgccgcgctggaaggcgatcagcagtgcgtgaaggacattgccgcccagtacaaacgccgtcgcgatgtgctggtcaaagggctgcacgaagcgggctggatggtggaagtaccgaaagcgtcaatgtacgtgtgggcgaaaatccctgaacagtacgcggcgatgggatcgctggagtttgccaagaaactgctgaacgaggcgaaggtgtgcgtgtcaccagggatcggcttcggcgattatggcgatacccatgtgcgctttgcgctgatcgagaaccgcgatcgtatccgtcaggccgtgcggggcatcaaagccatgttccgcgctgatggattgctccctaccaccgccagaccgctcaccgaagacgcggaataaacaaaaacaggagccagcggctcctgtttttcgtatgaacgttgctcagatcatcagggcgaaagtaccggcccatacaatgaccattaccgaaatgcccataaagaaatatttcacttttcatcgctccgcacacacatcgtatgcattcatgaacaagacaggactgattatagagagatgacgccaggccagaatcaaaatgagaattatctcgtttagggtggcggcagcacctcagaattcaggtgtgaatcacaccagacggcgctaatgtacgcttaataaatccgggaaacaagtggcattttcttaaatactttccgtcacttagcttgtgtcggggaacggcgacactttaatttcctggggtaataaattgagcttgagcgacgctttttaccttaatgaaaactccctttttcctgcttgatttataaggttaaattgtgagctacgtctcggttttaacgactttacgatagtgtgctgcaaggcataagtgacaaaaaagtgacaccaccttttgtgctatcgcccacaaaacaaaaatccttcctgatgcattccccggtgtcgccacctttcacggcatgataacaactggttttcagcgcagtaaaaggaacgtccgatgcgtaaagacgatttactcacctttttaatcaaccagactgatttctttgatccgcacgacgtcagcgagattttcactgcccgtcatctggcgcagcgtttcgggttacagcgtaataccgccagccactacctcaatcaactggtgacacagggcgtcctgataaaaattaatacccgcccggtgtactttctgcataaggccagcttcgagcagcaattttttccgctttcccgtacagagtttgccagccttgacgaattgctggcggaaaacgacggcgagcgcgtgcaacaggatcacttctccttgctgatcggtcacgaaggttcgctaaaaaagccgatagaacaattaaagaccgcgttgttttatccggatggcggcctgccactgctgatcaccggcgacagcggcaccggcaaaagttatctggcgaacctgatgcatgattacgccattacaaaggggctaatcgatgccgacgccccctttgtcaccctgaactgcgctcagtatgccaataatccggagctgctcgccgccaatttgtttggttatgttaaaggcgcttttaccggcgcgaccagtgataaacccggggcttttgaagccgcggatggcgggattttgtttctggatgaagtacaccggctgcatgcggaagggcaggagaaactctttacctggctcgatcgcggggtaatttatcggctgggagaaaccgccagcgggcgtcgtgttgccgtgcggctgatcttcgccaccaccgaagacattcacagtaccttcctcaccacttttatccggcgtatccccattcaggtggtgctgccggatctggaaagccgtagtcgaaaagagaaggaagcgctgatcctgcaattcttctggcgtgagagcaaaaaggtggggctggcgttgcgtatcagcccacgcctgctgtccgtgctgacgcattatgtctttcgcggcaacgttggcgagctgaaaaacgtcgtcaaatacgtggtggcctcggcttttgcccggcagggcggcgggcagccgctgcatgtgacaatccatgatttaccggagccggtgatggcccagttgcccgcgctcagcgacgcgacaagcggacagggcgaagaaatatgtctggatgagcataccagtctgccatggctgctccagacgcaaaatgccgggcgggtgctcatccacgatgcgcagctcagcgtgctgacgctgtttgaaaaataccgtacggcaccgcattcatgggatgacatcgagcagcgcatcggtcatgaaatcgaaaatctgttcgatcggctgatcttcgataaccaggacaaaaccagttcacagatgctgatgctggtgaccagtcaggtaagggaggaattttaccggctggaaaaaagttacaacatccagtacaacggcaacggcatctacgccatcgggcattatctggttcatcggtcgaccagtgaaccgtcgcggctgaacgtcgaaatgtgtaaacagctcgatcgttttttagagcagaaatacccgttgctgtacctgttttgcgaagaagtactggcgtcgctggcccgcagactggatctgcgtattcaggccatggatcgtattttgttactgctctggctgaacaaaaccggcgtgcagagcagtcacctggtcaccaaagcggttattctcgcccacggttacgccaccgccagcagcattacgaatgtggccaaccggctactgaaacaaaccgtctatgaatcctttgacatgccgcttgacgtcacgccggaggccatcgcccagcaggtgacgcagtacgtggagcgtaacgcgctggcgagtagtctggtgatcctggtggatatgggatcgctcaatgacatccaccactatttcagccgacaggtgacgatgccggtggtgatcatcaataacgtctccacgcgtatggcgctgtacgtgggcgagcgcattttacagggcgactatctggaaaccatcgccgcagatattgccgccgatgtaccggtagagcataaaatcatctggccggaactgaacaagccaaaggcgatcgttaccacctgcgcaacggggattggcgccgccagcaatttatgcagcctgctgaaagcgagtattccgcacgagctgggcatagaagtggtggcgtatgagtacgacaccctggcagaaaacaaactgcgcgagcccatcttttcacgttttgatgtgctggcgctggtcggcaccctcgatcccggaattcccgatgtgccctggatttcgctggatacgttgatctccggtcagggtaaggaaacactgatgacgctgttcggcgcgcttatcagccccgcggatgtcatacagattaacgaacgcatcgtgaaaaacttctctctgcgccgggtgatcgaatcggtgaccattcttgataccagcaaggtgataaatcaggtcgagcaatttctgacgcgctatcagcatctgacggcgatggccgtggcgaacgaccgtaaagtcgcgctttatattcatgtgagttgcctgattgaacgtctgatccgtcaggcggcgatccacaactacgccgggcaccgcgcgcagtgtcaacgccagcaccttccggcgttgcgcgaagcctttagtgtcattgagtcgagctatagtgtccaaatccctgaagcggagcttttttatattcacgatcttttgcatctgcaaacggaatttcttcagtacgatcaagagttttgacgttttcctgctcctgacattttcacctgatcgccgtgccactatttctggcacggcggttgcaatatctgtattaacaggtggaatttattttcgaggtcaggatgaaacgacactatatttttgccagccatggcacttttgctcacggtattctcaattcggtggagctgatcctcggcaggcaaaataatatccatacgctctgcgcttatattaacgaaggggatgacctgaccgaacaggttgagcaacttattagtgcttttcccgccgaagatgaactggtggtgatcaccgatattttcgccggtagtgttaacaacgaatttatccgctttattaaacgtcccggttttcatcttattgccgggcttaacctgccgctgattatcgaaatgctcatcgcccctcaggacgaggcgctgccatcccttattaccgattccctgactaacgcccggcaaagtattcagtactgcaaccagactcttgatgctgcgctggtggcggataaagatttctaagcgaggatctaaaaatgataacactcctgcgggttgaccaccgtttactccacggccaggtggcgttttcctggacgcaatatattggcgcggactgcattctgatcgccaacgatgcggttatgcatgacgaactgcgcaagaccaccatcaagctggctaaaccgccagccgttaagctggttatgaaaaatattaatgatgcgattgccgctattaaaagcggcgttaccgataaatataaattatttatcgtcgtggagtccgtcgaagatgcctggcgtctggcctgcgcagtaccggaaattaaaagtatcaatcttggcggtattaaagccaaagaagggagccagaatatttcaaaagcaataaacgtcctgccagaggaggtgacaatgctcaatgaactggttaaagcgggtacggaagtggaaatccggcaggtgcctaatgacagaaaactgttattcactgactgtctttgaatgacgagggacgcactatgttagaagcattattactgggactggtggcttttattgcccagtcggaatatgccttaggcacttccttaatttcccgcccgattgtcaccggtttactgacaggactggttttaggtgatgtgcaaaccggcgtcataatgggcgcaacgctggagctggcgtttatcggttcgttctcggtaggggcatccattccaccggatgtggtcacaggcgggatccttggcgtggcctttgccatcacctccggcgccggcaccgaaaccgcgttgctgctcggtttgcctatcgccacgctgacgctggtgttgaaaaatatctatctcgggctgtttattcccacccttaaccagaaggcggacgcttacgccgatcgggctgatacacgcggcattgagcggatgcatctgatcgccgggtttggtctttcgctgatgctggccaccgtggtgaccgtctcctttatggttggcagcggcgcggtgaaaagcctgctggatgccattccggagttcatcaaacacgggctgagcgttgccaccggcattattccggcgctgggcttcgccatgctggcccgcctgctgatcaacaaaaaggtcgccccgtatttcttcctcggatttgtactgatggcctatctgaagatcccggtgaccggcattgccattctcggggccattacggccgtggtgatggtaaacgtgatgcaatttaattccccccgtccgacggcggcgcaaggagtccagaatgacgatgaagacgatttctgaggaaactcaggtggccgacgacgccacaaacaccattacccgcaaagagttgcgcagcgtgttctggcgctcgttccagatggagttctcctggaactatgagcggcaaatgaacctggcctttgtctatgccatgatcccggtgctgaaaaagctctacccccgcaaagaggatctggccggcgcgctcaaacggcatctggtgttctttaacaccacgccgcatatcgtcacgctgatcctcggcattaccgccgcgatggaggagaaaaacagcagttcaaagggcatggacgcggcgtccgtcgacagcgtaaaagcctcgctaatggggccgctcgccgggctcggggattcattcttctggggaacgttgcgccttatcgctaccggtatcggcaccagcctggcgctgaagggcagcattctcgggccaatcctttttctgctggtatttaacgttccccatctggcggcgcgttacctgtttacccgctggggctatgtgctgggtaccggcgtgctgcaacgcatccagaagagcggcatgatggaaagcctcacctacggcgcttccatcatcggtctgatggtggtgggcgcgatgactgcctcaatgatcaatatcactatcccggtgaccttcggcacgggcgaggcgaaaacccatgtgcaggacatcatcaacgacattatgcccgcgctgttgccgctggtgagcttcgggatcgtttactggctgctgggccgcaaggttaaaccgctcgccattctgggcggcatggccgtggtcggtatagcgggatcgtggattgggttattctgaggagaaaatgatgtcaaccatgctggattatatagaccaggagtcagatgcgctcacgcgcataatacaggaatatcctgagaagctcgcgccattagtgacctggctggcttcacggccagtgaataagatcatgatcctcgcaacaggatcatcatggaatgctgcgctgtgcgcccgctattatttcgaaacccatttcggcattctggtagatattaaagagccatataatttcacccattatgaacgaattgatccggcaacggatttagttattgcggtgtcccagagcgggaaaagcgcctcgacgctggatgccatgaaaaaagtgcaggcggaagatattccggtattttgcctgacgtcgggtccgcaaagtccggctgcggtgcaggcggacggcatactcgatattaataccggcattgaaagcgtcggctttgtgacgcgcggctttagcgccactgtgcttaatcttttgcttatcgcgctgctggtggctgaacaacggaggcaaatcgaagaggatgaacgcgcggcaaccctggcgagtctcaaagacgcggcgcaggcgatcccggacgtcattgaaaaaaccaacgctttctttgcccgccaccggtcatactttattcaggcgtcgcgctttgtggcgacgggctacggcgcgctgactggcgtggcgaaagaatttgaaaccaagttcacggaaaccgtgcgcctgccgtccagtggttttgaactggaagcctatatgcacggcccgtatctggaggccagcgccagtcatacgctgttttttattgaggacagtgtccatacgcgtacccgcgccctacgggattatatgcagcccgccgtggatgccgtatttaccgtcacgctgacggaagaaaataatgatccccatacgctggcgctgaattatcccttaaaccatcatttcgcgccgttgttattaattgtgccatttcagcttctcgcctttcatatttccacggcgaaaggcatcgatttaagcgtgcgtatttttgacgatttcgacaaggtgcttaaaagcaaaatttaattacttatcaggagaatagctatgttaggttttaatcaggacgagtacctgaccagtgctcgtgacatcattgctgcgcgcaaaattgccgagcagattgcagaaaatatccatcaggcaggatttattaatatatttttcgcctcggtagggggctcgctggcacccatgatggcaatgcaggaatttgccaaagaggtgaccgcattgccggtttataccgaacaggcggcggaattactctgtaagggaaataaaaagctaaccaaagaatctatcgttattacgctgtccaaatcgggcgataccaaagaatcggtcgctattgcgcagtggtgtaaagcgcagggcatccgcgtggtggctatcaccaaaaacgccgattcaccgcttgccgccgcggccacctggcatattccgatgcagcataaaaacggcgtggaatatgaatacatgctgctgtactggctgttcttccggctggtggcgcttaacggcgaatttgatggctatgaccgtttcgccagccagctggagttgttgccggaaaatctgctgcaggccaaacgccagtttaacgaccgcgccgatgagattgcgagccgttaccataccgcagattacatgatgtggatcggcggtgcggagatgtggggcgaagtttacctgttctcaatgtgtattcttgaagagatgcagtggaaacgcaccaaatccgtcagctctgcggagtttttccacggcacgctggagctgctggaaaaagacgtcccgctgtttctggtaaaaggggaagggaagtgtcgaccgcttgacgatcgtattgaggcttttgcccgtaaaattaccgacaacctggtggtcatcgatccgcaggactatacccttaccggtatcgacgatgagttccgctggatcatggcaccctgcgtcgcctccactctgctggtagaccgtctggccgcccacttcgagcactacaccggacacagtctggatattcgccgctattaccggcagtttgaatattgataaaagtgaaaaaggtataatcgctgagagaatggattatggggatatttcagacgagagttctggtgtcccctgcaggaatcgaacctgcaactagcccttaggaggggctcgttatatccatttaactaaggggacaaggcggcacgagtataacgtcatttccgcactgcgttaagcgcgtgaccgcctgaatgctcaaagtgtcgccacttaagcgttattctgctttgctttcaccttctttttcgcctcgtcggcctgcgctttggcttcagccttacgtttgttgctcatgtcgttacggatctgcgcatggcttaacagggcgaaaataaaggtaccgccgcagatattccctgcgagagtcgggagcgcaaacggccagaggaattcactccagtgtagcgaaccggtaaacaccaggtaaaagatttccaccgcgcccaccacgatatgcgtggtatcgcccagcgcaatcagccaggtcatcagaatgatcaccacgattttcgccgagccggcagaagggaacatccataccatagtggcgatcaaccagccggaaataatggcattggcaaacatctccagcggggtatttttcattacgtccatgccgattttgacaaaggcatcgcgcgtcgggtcgtcaaataccggcatataaccaaacgcccaggcgacgatggcggtgccgatcaggttacccagcaataccacgccccacagtcgcatcagaagaccgccattgccccaggtcggattgtgcataaacggcagtacggcggtgacggtgttctcggtgaacagctgctgacgagccatgatgacaataataaagccgaaggtataaccgagattctccagcacaaagccgccgggaataccttcaaactggacgtggaaaatgccttttgccagaaacgatgcgcccattgacaggcccgccgcaatggctgaccagagcagggccatggcatcacgctccagctctttttccccgtcctgacgaatatgttcgtgtatcgccattgcccgtgaaggcagatgctcctcatccacctcgatttcttcaccgcgatctttttcctcactctcgacttcaatgtcgtcggtgtgcttatctaatttttcgtttttcagttcatccatttttgcttcatctttccggggatcatgataataagcgtagcggctttatgtgctaaagcagcgggcttcttcctaaattgtgcaaagggcaaaaaaggtgataacaggatcgcagagaacgtataaaattgaaggcgaaacgagaagagaaagacaagctatgctcaatgcgtgacagctcgtgctgccgctgacgtgcacatcgttaaacgtgctgatacaatcgcttgcgtattccaggcggaaacctgagcgctgcgcgtttatccgtcacggatgatattttgcgatgaccatttattacagggagacatccatgaaatttcgcctgtcggcgctcgcgctgggaactacattactggtcggctgcgccagctctggtgagcagcaacaggggcgctcggatccgttcgaaggatttaaccgcaccatgtataactttaacttcaacgtgctggatccctatgtgctgcggccaattgccgtgggctggcgtgattatgtaccgcagcccgcgcgtaacggcttaagcaatttcaccagtaacctggaagagcccgccattatggtgaactatttcctccagggcgatccctataaaggcatggtgcactttacccgcttcttcctgaataccttactgggtatggggggctttattgacgtcgcgggattatccaacgaaaaactgcaacgtgtggagccgcaccgtttcggcagcaccctcggtcattatggcgtgggttacggtccgtacgttcagttgccgttttatggcagctttaccctgcgtgaagacggcggcgatatggcggatacgctgtatccggtgctctcctggctgacctggccgctctcagtaggtaaatggacggtagaaggtatcgagtcccgcgcgcagttgctggattccgacggcctgctgcgtcagtcgtccgatccttatattctggtacgcgaagcctatttccagcgccacgactttatcgctaacggcggtcagttaaaacctgacgaaaacccgaatgcgcaggctattcaggacgatttaaaagatattgattctgaataaccgcaaagcaggcaataaaaaaaggtgaaccgaagttcacctttttttatatgacggattgatcagaatgcgtagttaaagttagtgccgaacagccaggctttaccttctgaatggaaggtatacgggccttcattaacggtaactttctgaccgtgcatataagacgcacccacatcaaccgacgcattatcattaaaggcgtaagtcgtaccggcgctcagccacagacggtcctgatccggaatggaaatagaacgtttgccagccggaaccgggctatcgtcataggcgataccggtacggaaggtccagttatcatccatgtaataggtggtacccagcgccaggcggtaggaatctttaaagccttcgtctttatagaacagcgtgcggtcgccatcgccggtggctttcagctcctggaactgactccagctggtgtaggcgatgctgtagtgtacagcccattgtggcgcgacgcggttataaccggacagctcccacatttccggcagatgcaaactcagcgagcctggaatagtctggccgccagtaccggcagggaaagccgtgcccgcgccaggtaagcggttagcgagtgggctgatgccgcttttataatcaccgtcaaagtcaacttttacttctgagcggtaagtaaaaccgtaacggttgtctttatccagctcataaaggataccggcgttccagccaaagccccactcatcgccttcaaggcttgcgattttagaactgtttttcggcaatgccgcggtctgctcgccagaatagcgctcaattttcgcgtcagcgtaaacggcgtcaaagccaagaccaaaactccagttgtcatttaagcgataagcgccgctgaggttgaggttaagggtggttaaatcggttttaccgccgtattcgcccgcgatgtagttatcattaaactctgtcgccagaccataattcgaggttactgatgcgccccagccaaattgttcattaattggcgcaacaaagtgcaggttaggcacccaggcagtcggcgcaatattatcggctcgggtgctgcgaccggtataaggcgaacggccagaaatattcacgtccggatcaatatacaccgcgccgccggaaaaggccgggcggtcgaataaagtaattaatgccgggttacggctgacgttgcctgcgtcatccgcaatagcgccttcacctgaataagcgcggccaaggccagaggaagagaattcgtttaactggaagcccgcagaccaggcttgtgtagagacaattgccactgcaactgcgagtgcagatttggtaaaccgggttttctggctcatgaccataacctcatacatttatttttatgcattaattgttacgtaccgtaacaggagcgcgaagtgtagggtctgaggtacgacttacaaatcagaccagtggcggaagtataggtccgaccagagggaatgttgcaaggatgtttataagatttttcaaatgtgatcttcgaaacgcgatctgcgtggcaaatttgtgcaccgttacggttatcagcaacggcgaattttgttttagatcattttaagctgtgataacggtcactatccggcaattgtgagattaacgactggagccacttttacggggcgcgtaaaataaccacatcgtttatggcaccccgagtgcaaatacagaggaaatctacaatgagtaaatgcagtgctgatgaaaccccggtttgctgctgtatggatgtgggcaccattatggataataccgactgcaccgcctcttacagccgcgtatttaccacacgtgccgacgcagaagcgacgcttgccgcattaacggaaaaggcgcgcagcgtggagtcagacccctgccagatcacctccacctttaccgacgttgaagagggtgtgcgtctggatattgattttgttttcgcctgcgaagcggaaaccctgatcttccagctcggcctgcgttaaattccccttatcacgctcctgatcctcaggagcgttttctccatcatctctgtgtattagctcgcaaaaatcccctcagccagttggctaaatgtaaaaaaaaggttaagactaatatcaggtcagaccactttgcatgatgttatttacaggggagtgttatgagtcaggcattaccgcttgtcacccgtcagggcgatcgcattgccattgtcaccggattgcgtaccccttttgcccgccaggccaccgcctttcacggcatcccggccattagcctcgggaaaatggtggtgggcgaaatgctcgcccgcagcgaaattccgcctgacgtcatcgaacaactggtgtttggtcaggtggtgcagatgcccgaagcgccaaacattgcccgcgaaattgtgcttggcaccggcatgaacattcataccgatgcgtacagcgtcagccgtgcctgcgccaccagctttcaggcggtggcgaacgttgccgaaagcctgatggcgggtaccattcgcgccggtatcgcgggcggggcggattccacctccgtactgcccatcggcgtcagcaaaaccctggcgcgtacgctgctcgacctcagcaaagcccgcaccgcagggcagaaactaaaactcttttcccgtctgcgcccgcgggatttactccccgtgccgcccgccgtggcggaatactccaccggtttacgcatgggcgataccgccgagcaaatggcaaaaacctggggcatcagccgcgaacaacaggatgcgctggcgcatcgctcccaccagctggcggcgcaggcctgggcggacggtaaactggcggacgaggtgatgaccgcctacgtgccgccgtaccgtgatcctgtggtgcaggataataatattcgccacaactccacgcttgctgattacagcaaactgcgcccggcgtttgaccgtaaacacggcagcgtcacggcggccaacagtacgccgctgaccgatggcgcggcggcggtgatcctgatgaccgaatcccgcgccagggaactggggctgacgccgctcggattcctgcgcagctacgcctttaccgccgtcggtgtgcagcaggacatgctgctgggtccggcctggtcgacgccgctggcgctggagcgcgcaggcatcacccttaacgatctaacgctgtttgatatgcatgaagcctttgccgcccagacgctggcaaacctcaagctgatggccagcgaccagttcagccgcgaggtgctgggtcgcagtcaggccaccggcgaagtggacgacagcaaatttaacgtgctgggcggctctatcgcctatggtcatccgtttgccgccaccggcgcgcgcatgatcacccagacgctgcatgaattacgccgccggggcgggggatttggcctggtgacggcctgcgccgcaggcggacttggcgcggcaatggtcctggaggccgaataatggatatgacaactgcattctccctgattgtgcgcccggatcagatcgccgtggtgaccattgatgtgcccggcgaaaaaatgaataccctgaaggcggaattcggcgttcaggtgcgggcaattttgaaacaaatccgcgagaacaaagatctgcgtggcgtggtgttcatttcggcgaaaacagacaattttgtcgccggggccgacatccacatgatcgaccgctgcaaaaccgctaaagacgcggaagagctggcccgtcaggggcaacaggtgatggcggaaatccatgcgctcaccatcccggtgattgcggcgatccatggcgcctgtcttggcggcggtcttgagctggcactggcctgccacgggcgcgtctgtactgacgatcccaaaacccagcttgggctgccggaagtgcagctcggcctgttacccggctccggcggcacccagcgcctgccgcgcttaattggcgtcagcacggcgctggagatgatcctcaccggcaaaatgctccgtccgcgccaggcccgtaaagtggggctggtggatgatgtggtgccggtatccattttgctggacgcggccgtggaactggcgaaaaaaggcaaaccgaccgggcgtcgtttgcccgtgcgcgaacgcattatggctggcccgctcgggcgcaccctgctgtttcgtatggtggagaaaaagacgcagcagaaaacccacggcaactatccggccgcgccgcgcattctggacgtggtgcagacggggctggctcaggggcgcagcagcggttatgaggcagaagcccgcgccttcggcgagctggcgatgaccccgcagtcccgtgcgctgcggcatatcttttttaccagtaccgacatcaaaaaagatccgggcagcgccgtcgaacccgcgccgttacgtgcggtgggcattctgggcggtggtctgatgggcggcggcattgcttacgttaccgccagcaaaggcaaactggcggtgcgcatcaaagatattaaacctgccggtatcaatcatgcgctgcaatacagctggcagcagcttgataaaaaagtccgtcgccgccatatccgtcctcaggagcgtgacaacgacatggcgctgatctccggcaccaccgattaccgtggttttgccgggcgcgatatcgtgatcgaagcggtattcgaagatctggcgctaaagcagcaaatggtggcggaagtggagcagcactgctcgccgcagaccatttttgcttctaacacctcgtcgttgccgattggcgatattgctgcgaaagccgcgcggccggaaaatatcatcggcctgcatttcttcagcccggtggagaaaatgccgctggtagaggtgattgcgcatgcgcaaacctcagagcgaaccatcgctactacggtgatgctggcgaaaaagcagggtaaaacgccgatcgttgtggcggataaagcgggcttttacgtcaaccgcattcttgcgccctacatcaacgaagcgatgcgtatgctgacggaaggcgagcaggtcgagcatatcgatcgtgcgctggtaaaatttggcttcccggtcggcccaatccaacttttggatgaggtgggaatcgataccggcactaaaattatccctgtgctggagagtgcttatggagagcgtttttccgcgcctgcaaaggtcgtttctgcaattttgaacgacgatcgcaaaggcagaaaaaatggccgcggattctatctttacggtgcgaaagggcgtacaagcaagaagcaagtggacccggcgatttacccactgattggcgcatccgggaatgcgaaactttcggcggatcaaatcgcggaacgctgtgtgatgatgatgctcaacgaagcggcgcgctgccttgatgagtcggtgatccgcagcgcccgtgatggcgatattggcgcggtatttggcatcgggttcccgccatttttgggcggaccgttccgctatatggatacgcgcggcgcggggaatatcgtggcgacgctggagcgtctggcggcgcagtacggcccacgatttacgccttgtgaatacttgttacaaatggcggcgcagcgcgaaacgttctggcctgcgaataacactgatcctgtaagttaaggtcagtaaagggtaaatctgtcgttgaatgtgtcggcgctgttcattttataaacagtgattgactatacttacgccattgatgtaaaacacagcgtttcattcaacgaatggataaggcacaatgcccggccattgtctgtttcggtgtaaacatgttgtttcattcgggcggttcaatgcttctggttaacaaaagcggtgcaatatgcaagtttttatcatgcgtcacggcgacgctgctctggatgcagccagtgactcggttcgccctttgacttcttgtggctgtgatgagtcccgtcaaatggcaacctggctgttaagccaaaaagtgaacatcgagcgtgtactggtcagtccgtttctgcgtgccgaacagacgctgagcgaggtaggggagtgcatgaacctgccggacgatgtggagatcgacgtcctgcccgagctgacgcccggtggcgatgtgcgtatggtcagcgcgtatttgcagacgctggctaacgaaggtgtatcttcggtgctggtgatttcgcacctgccgctggtgggttacctggtgtcagaactgtgcccgaccctgacgccgccaatgttttctacctcagcgattgccagcgttacgctggataacgcagggaaaggggtgtttaactggcaaatgagtccctgcaatctgaaaatggcgaaagcgatttaatcccgcctgaccctgtaaaaagagccgctgatgcggctcttgttgtttctggcggctggggttttgtcgggtggcgcttcgcttacccgacctacaactggtggctggttttgtcgggtgacgctgtgcttacccgaccgacgggttacgaattcgtaggcccggcaagcctgcgccgccgggcatcccggcaccgggcacgtgctcaggggagttctggcggctgccactcttccacttcgatcagcaccagcagggccgcatcgccgccgtactctttcggtgcctgatggaaggccatcacgtgcggatgctgcgccagccataatggtgtttgctgcttgagaatatgcttcccgtggccatgcatcacacaggcgcaaaacacatgttcgcggcggcaggcggcaatcagcgcgcccagctcctgcttcgcctgcatctgcgtcaaaccatgcaaatccagaaacagctccggggagtaatcaccgcggcggatcttttttaattcgaaatgactgacgtccgggcgcacatactttgccgggccgtcggtattaagcagcggctgaaactcatcagaaaaatagtggctggcatccgcctgctccgataacaggcgcttcaccggcacctccgtcacttttttacgcagcgggcggtgaacaatggtgtcctgctggattttgcgcgtgcctgtcatgagctgccggaacagcgcctgatcctcctcgctgagcgatgctttctttttcatttttctgtctcatcttttatttccgccagtttacccgactcgatgcggcctgtgtgcaggcaaaacgcatttttccccgccgggcaggtgcgagaatgctgatttatcggcgtcttcatggcaaactagccgccgaatttacagcaatgcatgtcctggaggatagtgtggataaaatttttgtcgatgaagcagtcagtgagctgcataccattcaggacatgttacgttggtcggtcagccgattcagcgcggccaatatctggtatgggcacggtaccgataacccctgggacgaagccgtccagctggtgttaccgacgctctacctgccgctggatattccggaagagatgcgtaacgcgcgcctgacctccagcgaacgccaccgcatcgttgagcgcgtgatccgtcgcgtcaacgagcgtatcccggttgcctatctcaccaataaagcctggttctgcggccacgaattttttgtcgatgaacgcgtactggtgccgcgctcgccgattggcgaactgatcaccagccgttttgcgggcctgatcaaccagcaaccacagcatattctcgatatgtgcaccggcagcggctgtatcgccattgcctgcgcttatgaattcccggaagcggaagtggacgcggtggacatctccccggacgcgctggcggtggcggagcacaacatcgaagagcacggcctgatccacaacgtcacgccgatccgctccgatctgttccgcgacctgccaaaggtacagtacgacctcatcgttaccaatccgccgtatgtcgatgaagaagacatgtcggatctgccgaacgaataccgtcacgagccggaactgggtctggcctccggcagcgacggcctgaagctgacgcgccgcattctggcctgtgcgccggactacctgaccgatgacggcatcctgatttgtgaagtgggtaacagcatggtacatctgatggagcagtatccggatgtgcccttcacctggctggagttcgacaacggcggcgacggcgtcttcatgctgaccaaagcgcagctggtggccgcgcgggaacacttcagcatttataaagactaaaccgcacaactaagccgcacaacaacacaacaaaataacggagccgtgatggcaggaaacagtattggacaactctttcgcgtaaccacgtttggcgagtcacacggtctggcgttaggttgcattgttgacggcgtgccgccgggcattccgttgaccgaagccgatttacaacaggatctggatcgccgccgtccgggcacctctcgctacaccacgcagcgtcgcgagccggaccaggtgaaaattctttccggcgtctttgaaggtgtcaccaccggcaccagtatcggtctgctgatcgaaaacaccgatcagcgctcgcaggattacggcgccattaaagacaccttccgtccgggccatgccgattacacctacgaacaaaaatacggcctgcgcgactatcgcggcggcggacgttcctccgcgcgggaaaccgccatgcgcgtggcggcaggggccattgccaagaaatacctggcgcaaaaattcggtatcgtcattcggggctgtctgacccagatgggcgacattccgcttgagatcaaagactggtcgcaggtggaacaaaacccgttcttctgccccgatcccgataaaattgaagcgctggacgaactgatgcgcggcctgaaaaaagagggcgattccattggcgcgaagatcaccgtagtggccgatggcgtcccggcgggcctgggcgaaccggtgtttgatcgtctggatgccgacatcgctcacgcactgatgagcatcaacgccgttaaaggcgtggagatcggcgaaggattcggttctgttgcgctgcgcggcagccagaatcgtgatgaaatcacacaagaaggttttcagagcaaccacgccggcggcattctcggcggcatcagcagcgggcaacagatcgtcgcccatatcgcgcttaaacctacctccagcattacggtgccggggcgcacgattaaccgcgccggtgaagagatcgaaatgatcaccaaaggccgtcacgatccctgcgtgggtattcgtggcgtgcccattgccgaagcgatgctcgccatcgtgctgatggatcacttcatgcgccagcgggcgcagaacggggacgtcacaaccacattgccacgctggtaactatgaaaaaacgtgtcattgcgctggcggcgctgctcgtcagccagttcagccttgccgccacgccctggcaaaaaattacccatccggtggcgggcagcccgcagtccatcggggccttttccaatggctgcatcgtgggggccagcgagctgcctttacagtcggatacctatcaggtgatgcgcaccgatcagcggcgctattttggtcacccggatctggtgctgtttattcagcgtctggggaaccaggtgcataacctggggctgggaaccatgctgatcggcgacatgggcatgcccgccgggggccgtttcaacggcggtcacgccagccatcagaccgggctggacgtcgatattttcctgcagttgccacaaacccgctggacggcggcgcagctgcgtaaaccccaggcgctggatctggtgtcatccgatggtaagcgtgtggtgccttcgctgtggcagccgcagattagccagctgatcaagctggcggcggaagataatgacgtgacgcgtattttcgtcaatccggccattaaacagcagttatgtctggatgccggaacggatcgcgactggctgcaaaaagttcgtccgtggttccagcaccgcgcccatatgcatgtgcgcctgcgctgcccggcggacagtctcgaatgtgaagatcaaccgctgccgccgccaggcgatggatgcggcgcggaattacaaagctggtttgaacccgcaaaacccccgataacgaagcctgagaagaagacaccgccgccgttgccgccttcctgccaggcgctactggatgagcatgcactttaatggacaactttatcgatctctttatggtgtcgccgttactgctggcggtactgttttttgtggccttactggcaggatttatcgatgcgctggcaggcgggggcggtttactgactgtaccggcgctgctggcggcgggcatgacgcctgcccaggcgctggccactaataaattacaggcctgcggcggttcgctgtctgcttcgatctattttgtgcgcctgaaagtcgtcaatctggcggatcagaaactgaatattctgatgacctttatcggctccacgtcaggcgcgctgctggtgcagtatgtgaagtctgacgtgctgcggcagatcttgcccatcctggtcatctgcatcggcctttactttctgctgatgccgaagcttggcgaagaggatcgtcaacggcggctgtatggcctgccgtttgcactggtcgccggtggctgcgtgggtttttacgacggctttttcggacccggcgcaggatcgttttacgcgctggccttcgtcacgctgtgcggtttcaatctggcaaaatccaccgcccatgccaaagtgttgaacgccacctccaatctcggcggcctgttactctttattattggcggcaaagtggtatgggccactggcttcgtgatgcttgccggacagtttcttggcgcgcgtatgggatcacggctggtgctgagcaaaggacaaaaactcattcgcccgatgattgtgattgtctcagcggtaatgagtataaaactgctttttgacagccatggacaggagatccttcactggctggggatgaactgatgaacacgacgcacacttacgagcaattaatagaaatttttgatggctgctttgccggtgattttaatacccgtctgattaaaggcgacgacgaaccgatctatcttcctgctgatgccgacgtgccctataaccgcatcgtctttgcgcacggcttttatgccagcggcttacatgagatttcccactggtgcatcgccgggaaagcgcgtcgcgagcaggtggattttggctactggtattgcccggacgggcgcgatgccacgacgcaggggcagtttgaagacgtagaagtgaagccgcaggcgctggaatggttattctgcgtggcggcgggcttcccgttcaatatcagctgtgacaatctggacggcgatttcgaacccgatcgcatcgcttttcagcgccgggtacatgcccagctgatgacgtatctggaagaggggatccctccgcgtccggcgcgctttatccaggcattacaggattattatcatacgccgccgctaacggcagcacagtttccgtggccggaagatcttaactgaagccacgatttaaagaggaaagaagatgatcgcggagtttgaagcacgcattctggcgttaattgatgacatggtagatacggccggagacgatgagctgtttgccagcggttatctgcgtggccacctgacgctggccgtcgctgaactggagcatggcgatgaccactccccggaagcggttcacgctaacgtcagcgccagcctgtcaaaagcgattcaggccggtgagctttccccgcgcgatcaggcgctggtgctgggcatgtgggacacgctgtttacccaggcgaaaggttaacgggttgcccctctcacgggtgagaggggattaacctatgccaggcgcggatagccatcggcaatcgcatcgccggtaaactgcgccacccagccttcgggattatcaaaaatacgaatagcggtaaaattcggctcggaacccatatcaaaccagtgcggcgtgccggcaggcactgaaatcagatcgtttttctcgcacagtacctgatacacctcattgccgatatgcaggcagaacagccccgcaccctccacaaaaaagcgcacttcatcttcgccgtgcgtatgctcattcaggaattttgcgcgtaacgcgtctttctgcgggttatccgcgcgcaggctgatcacatcccagctctgatagcctttttcggcaaccagcctgtcgatagcagactgataggcatggatcaccgtgtcggctgacgggttttcccctaaatcgcggtccgcctgccagcgctcaaagcgcacgcctttggcgttaagctgctgctggatctctgtggcatcggtgctgtgccaggtgtgctggctggcgtcggtatctgaaaaaatcgtcagggcgctcatgaggggatctgctccggattgatgacatcaaaacgatgaacctggtgatgatggctggcggcatcgtcatcaccgcgaataagctgcacggtacgcagcccggcttcggccgccgcatccagctcctgatgaatatccgacaggaacaaaatctgcgacggggccaggcccagctgttcagcgatgctggtataggaactcacctcgcgtttcgcgccaatgtgcgtatcaaaatagccgctgaacagatgagtaatatcaccttcgtcgctgtagccaaataacagtttctgcgccgcgacggagccggaggaataaacatagagatcaataccctgcgccttccatttttccagcgacggcagcacgtccgggtagagatggccggtaaagtcgccgtgcacatagccttcgcgccagataatgccctgtaaggctttcagcgccgtggatttgcgatcttcatccataaagcggaataacgtgtcgataagctgcgcggtggtggcgtccggctggccgatttcgtcgcgcagattatcgagaatcgaggagaccggttcgccatactgctgcgccgtaatgaaggcggcgagccgctcacgggcataggggaacaggacatcatgcacaaagcgaatatcgctggtggtgccttcaatatcggtaactatcgcgcggatcattctctctccagcaggcggcgctgcatttcacattcgaataagaactcaagaccttccagatgacggcgggcttccgccacactgcgtccccagcaggttaaaccatggccgcgcaggaggaaaccatattgcagcggatgatcctgtgcgaaggcttcaattcggcgggcgagggcgtcaatatcctggtcgttatcgaaaatagccacgggaacgtagtccagatgagtgtgctgcccgctgagggatttttgcatttcgtagccatgcagcatcagttgcgtgcttttctccacccgcgacagcacggtggcattgaccgtgtgcacatgcagtaccgcattagcctcgggaaacaggcggtagatcagcgtatgcaggccggtctccgccgacggcgtacgcccggagggcacgcggtgggtggcaatctccacgcgcagaaaatcgtcgggcgtcaggctgcctttgtccttgccggattcgctgagccagcaccagtccgtgtcttcgcgcaccgacatattgccgccagtggcgggagcccagcctttcgcgcctatccagtgacaggcgtcgacaagggcggagagttgcagattgtctgtcattcagtgtcttcctttatagccgtgaggcaggaatatcattatggtttagacgtctaagcgtcttgattgccaaatactaacatcgtgttatagtggcagcaacacaagtatcacaggcaggcaaccacgcatgagcaataacccgctgatcccacagagcaaacttcccgccctcggcaccactatctttacgcagatgagcgcgctcgcccagcagcatcaggcgatcaatctgtcgcagggcttcccggattacgatggcccgcactatttgcaggaacggctggcgtatcatgtggcgcagggggcgaatcagtacgcgcccatgaccggcgtgcaggcattgcgggaggcgattgctgataaaaccgcagcgctgtacggttacctgccggatgcaaacagcgacgtgaccgttaccgccggagccaccgaagcgctgtacgccgccattaccgcgctggtgcgccagggtgacgaggtgatttgttttgatcccagctatgacagctacgcgcctgccgttgaactgtccggcggggtgttaaaacgtattgccttacagccgccgcattttcgcgtcgactggcagaatttcgccgcgctgctgagcgagaaaacccggctggtgatcctcaacaccccccataacccgtcggcgacggtgtgggaaaaagaggattttgccgccctctggcaggccattgcagagcaggaaatttatgtgatcagcgatgaagtgtacgagcacatctgctttgcacaggagggacacgccagcgtactggctcatccgcagttacgcgagcgggcggtagcggtctcgtcgtttggcaaaacctatcatatgaccggctggaaagtgggctactgtgtggccccggcggccatcagcgccgagctgcgcaaagtgcatcagtatctgaccttttccgtcaataccccggcgcagctggcgctggcggacatgctgcgcgaagcgcctgagcactaccgcgaactgcccgccttttatcagcaaaagcgcgatctgctggtggaggcgttaagccacagccgtctggagattttgccctgcgaaggcacctatttcctgctggcggactacagcgccatttccgatctggatgacgtcagcttctgccagtggctgacaaaagaagcgggcgtggccgccatcccgctatcggtattttgcgcggatcccttcccgcataagctgatccgcctgtgttttgccaagcagagcgccacgctgctcgccgccgccgaacggctgtgtaagctgtagctactccacggtccaggcgctggaaaatcgacggtcggcaaacaactccagcagaccgttgatttgcttcaggcgcagcacttcgtcgctgtccattcccagctctttaccgatgcgctcatcttcccagcccagctgcgccagttcgcgcacgatctctgacatctcctggatctggtgccgcccgcgggcgcgattatggcggatggtcgccgccatgcgctcggacttgcgggtacgggaagcgcgtaaacaggtgaccggcaggtagcctttaagctgctttttcagcgccggtttgctcttacccagttcatgccggtgaaagccgtccacaatttcatactcgtgggcgccggtacggatggcgacgaccggctgagtaaagccatccatctccagcgatttcagcagcagacgcttttccggcggcgccacattgtttggattgtagctgttcggtttgatggcttcgtgcctgacccacagcacgcagtccaccggctgctcgcgaaacgggctgagctcgtgcagcgcctgacgaaaagcattaatagcgtcaatgcgatccgcttcctccagcgagcttaagtaatcctttaagtcatatatcagtcgttgtcgcataaaattccccactccttacgtttatttttcatacgctcgttgtagcgcttatagttgctggtttttgtcgggctgaatgacagggcgcggcaccagtaatcgttattgagcagcaccttgcagatgcgccgccaggaaggaatatccttcgcgccgatgtcgccttcctgaacgtccggaatatcttccatgccttgtctctcataccagcggagataaacggcgattttgttgcggtaatgttcggcggtagagacgggcatactgtcgagaagaaagagagcgtaggagcgccagctgtggccttcgggtttgtacagcttgcggtggccgtaaaactgattatcctgcccggcatacagaccgccgcttcgcgcgccgctgacccgttcacacatgcgtgcccaggtgtgcggctcgagtacgtgatacagccacaggccctgccgttgttccgggccgaaaggttcgcagatgcgcatatagcgtaaggggacgcccgccttgtgcatcagatcgtacagcacgttataggtggcttttgattttgcaaaccaggtccagacgtcggcgattttccagtcatagatagggtagatgtaccagctattaccgcgtggggtgcaggtcgtccagggtttatcatcggcgaaacgctgcttgcgcgaagaggcgatggccagaaagcggttataggattcatcggcgcggatgccgatcatcatggcggcggggcgttgctgtgaaaaccagtccgcaaactggtaaacgaaactttcgaaggtcataccctgctggtaaaagggaaaacaggcagggtcggtaatggcgcagtcggggggctgcctgacccaggctttgccaggctcccagcactgccactccggttcaaattgcgagagggcattctgcgtggtcagcggcagggcaatccaccagaaggtttcgatgacatcctgatactcctcccgcattttattaatatgctttatggtacaggcgaactgcgcttcccagtcaataaataacacgtggatttttttattcatctgtcgggcaagcagggcggtgaggtgcagcataacggtggaatctttgccgccagaaaaagaaacgcaaacgcggggcagattttctaaggtccagcgtattcggccaatactggcttcaaatacgttttccattaactcaatcttatgaattgacatgagtgttaatccagtaagttaaaccatgattaaaaacactggtatgaagatgcggggaaagcccgcgaagagaatatattctgttggctggaggaagattcgtcaatgctgttaatgtaagtaaaaacagcaatactttatcccgggaatttaatacggccggagataatgtcaggccgtatatatcagcgggaggttactgatcctggtcaatactttctaccagttgcgcgaaaacagcgctattcatggaagcgcgattatacatcataaaaacatcaatggtgggcagcgagacgccagcgttaatctgtttaagattaagcgatgctttataatagttgaaggatttaagggggacgatgccgactaaatcagtatggctaatcatattcaaaacagaaatgaatgaatcgctgcggaacagtattttccgttgcggtaactctttttcaatgctggtaaaaatttcgcgggtcccctgtgcaggggtcgaaaaggcggtaaaaccctcttccagcaggtcactaacgctaatggtatcgttaatacgcgggtgcgatttgctgcataccagcaccagcggatcggttctgtagcgggtgcagacaatagaacgattggtgaccggcagcagggagagcaccaggtcggccttgcgatagttaagcaggtcttcggcggtttccggggcgataaaaatgtcgtggtgcacgatattatactgggcgttatcacgcagccggttaattaaactcaccatgccgttcgaaaccagtatctgggggctataaacaacaatggtcttcatcagctcactgttattcataatattgatggttcgttccagatcgttaaggttttcttccaggtgagcatgtaagtttatgcccacggtggtcggggtgacgcctttaccggaacgaacaaatagcgggtcattcagttgggcgcgcaagcgttgcagcgactgactgacggcagaaggcgtaataaataacgtctcagccgccttgctgatactttgatgctgataaatactctcaaaaatcaccagcagattaagatcgaattttttaagatcataaagattagccattaggtcatcctgatttattgactatgatttatttatctgatgattgtttcacgatggtgaagaaaaaaataaatacaatcctttgcgaataccaaacatgactttgtttgataagatgaatatatcatgaaaagcgatatttgaaaggtgcgacccgaaataagttgagggccgcaaaacgcggccctcaaactggcaattgttctggtctgacgcaggcgtttattgttcgcccattatcaccttcagcttttgctcatccggcagaccgaccacctgttgcagcacgttgttttcattcatgtaataaatagcaggagtcgcgctggccccaaggctatccatcaggcgctgatgcatattaagcgaacgcatggctttgtctgcgggtgtcgcgggcacgttaagcttcatcttgccgccggactgctcaaaatcgtgccaggtttttgccggatcggctgaggtcattatcgcggcggcggtcgccgggctttctggtttgatcacgcctaccagcagggtgcgcagctgaactttcccgctatccacccacggacgcgcctgctgccagaactgatggcagtacgggcagaagggatcggcaaagacatagaccaccctcggcgcgtcttttttaccatcgaggatccattctgctttttccatctgctgccagagctctcgtccggcaggggcatagatctctttctcaatcagcttttcgctaagattggcgcccgcgccgtcgtacatgtatcctgagatggcatgtttaccgtccggcgtgacataaatggtcacgcccatatcctgatattttcccagataacccttcatgccgccgggcgcatcgaacggcttaatgatggtgataccctgtttctcaatagctttaaccgcatcaggcagctcgtctgcttgtgcgaaaacaggtaaaagggtcatcagaactacacgctttaacatatcaaggccttgaatataaactgtaaaagtgagttttaggctgcggcggggcaggttgttagatattgcctattgagttgataacgtaaacgcattagccgtggcagtaaaacttgcgtaacttagcactcaacgaaaccacggaggaagtatagatgtccttaattaataccaaaatcaaacctttcaaaaaccaggcgttcaaaaacggcgaattcatcgaagttaccgagaaagataccgaaggccgctggagcgtattcttcttctatccggctgatttcaccttcgtttgcccgaccgagctgggtgacgttgcggatcattacgaagaactgcagaaactgggcgtagacgtgtactccgtttctaccgatacccacttcacccacaaagcatggcacagcagctccgaaaccatcgcaaaaatcaaatatgcgatgatcggcgacccgactggcgcactgacccgtaacttcgaaaacatgcgtgaagacgaaggcctggctgaccgtggcaccttcatcgttgacccgcagggcatcatccaggcgatcgaagtgaccgctgaaggcatcggccgtgacgcttctgacctgctgcgtaaaatcaaagccgctcagtacgttgcttcccacccaggcgaagtgtgcccggctaagtggaaagaaggcgaagcgactctggctccgtccctggacctggttggcaaaatctaatttttcttcggcttttgcatcatagcggcgttggctcactctcgcgccccggtcacttacctgtgtaagctcccggggacttaagtgttcgccgccttgctctgaagcaaaatcctttgaaaaatacgcgttatccgggtgcagctatgcacccgttttcccccaacaccatgattcaagttgcattcaggcagcccggataaggcagcttgcatgatgatgttttttagcaggagattaaaaatgctcgacacaaatatgaaaacccagcttaaggcctaccttgagcgtctgacaaagcctgttgagttgactgccacgctggatgacagcgccaaatcggcggaaatcagggaactgctggtcgaaatcgccgaactgtctgacaaagtgacctttgttgaagacaacagcctggcagtgcgtaagccgtcgttccgtattgctaacccaggctccgatcagggcccgcgtttcgccgggtcgccgctgggtcatgaatttacctcgctggtgctggcgttgctgtggacgggcggtcatccgtcaaaagaagcgcagtctctgctggagcagatccgcgacatcgacggcgatttcgaatttgaaacctactactcgctgacctgccacaactgcccggacgtggtgcaggcgctgaacctgatggcggtacttaacccgcgcatcaaacacactgcgattgacggcggcgcgttccagaacgaaatcaccgatcgcaacgtgatgggcgttccggcagtctatatgaacgggaaagagttcggccagggtcgtatgacgctgacggagatcgtcgccaaagtggacaccggcgcggaaaaacgcgcagccgatgagctgaaccagcgtgaggcctatgacgtgctgatcgtcggttccggcccggcgggcgcagcagcggccgtgtactctgcacgtaaaggtattcgtaccggtctgatgggcgagcgtttcggcggccaggtgctcgacactgtagatattgaaaactatatctccgtgccgaaaactgaaggtcagaagctggcaggcgcgctgaaagcgcacgtggatgattacgatgttgatgttatcgacacgcaaagcgccaccaaactgaccccggcggcagaagaaggcggcctgcaccagattgaaaccgcctccggcgcggtgctgaaagcgcgcagcgtgatcattgccaccggcgcaaaatggcgcaacatgaacgtgccgggcgaagatcaatatcgcaccaaaggcgtaacctattgtccgcactgcgacggcccgctgtttaaaggcaagcgcgtggcggtaattggcggcggtaactccggtgtggaagcggccattgacctggcgggtattgttgagcatgtaaccctgctggagtttgcgccagagatgaaggcggatcaggtattgcagaataaagttcgcagcctgccaaacgttgacatcatcctgaatgcgcagaccacggaagtgaaaggcgacggcacccgcgtgaccggccttgagtatcgtgcccgtgtaagcggcgatacgcaccagttggaactgtcagggatcttcgtgcagattggtctgctgccgaatacgaactggctggaaggcgccattgagcgcaaccgcatgggcgaaatcatcatcgacgccaaatgcgaaaccagcgtgaaaggtgtgttcgcggcgggtgactgcactaccgtgccgtacaaacagattattattgccaccggtgaaggggcaaaagcgtcactgagcgcctttgatcacctgatccgtaccaaaatctgataagaaagtaagatacacctgcatcaaaggcccggcggcatcagcttccgggcctttgtttttatcagaacggcttaacgtatcaccagcacaggcacatgcgcatggctgacgatgcttgaagcgttggatccgagtaagtgagtgctcattgacggattacgcgagccgatcaccactacgtccgcatgcagctcttcggccatttcattcaccacatcgcgtacgctgccaacccgcacatgggttttgagccgttcaggtggcagtgaaaaatggctgagcatggtttgcagacgcgcttgtgcttcattctggatatgctcttcaaagcggcgaatatctgcggcgaagcggtataaactcagatgcgccgagccgggaaccacgtgcagcagatggataattccatcggactgcgcaagaaattcggcgtgacggatcgccttttcactgagttccatgtcaaaaacatcaaccggcataatgatggacttatacataattacgtctccctgttagttccagggcttattcaaccataactaacccgcaatttttgtaaggtttgtcatgcatcctgtaaaagtcaggcgtaacggaaaggattgtacaaaagagcgtgccggaaagaggatgcgcaggcatcctctgcaagacaaagcgcagggcttaatcagaagagttagcgattgaattcaccggccgcttcgggctgataaaggatttcaatcacttcaaggtgggtggaggcgccgccgggtaattcccactggatgctgtcacccacgcgcaggcccagcagtgccgcgccaaccggggccagtacggataactgtttcgtgctgtcgctcatctgcgccggataaaccagcgtacgcacgcggatttcgccgcgggtcagatcgcgaaacttcacttcactgttcatggtcactacatcggctggcatttcttccggcgcgcacatctgcgcgcgatccagttccgcggtcagcgcggcggcaacgggcagcccggcgtagggcgcctgctccagcagccgatcaatgcgcccggcgtctcgttcattaatgataatggcaggtctggacatttcttactccatgtcgttcccggtgacattcaccgaattaatccaaagaaaaaccctcaccgtcagacggcgagggtttagcagatccgatgatactcattcttgcccgatcattgaagtgatatagctcacacccacgtttttccgcgccgctttttttgaatgatttcgcctttccgccgcacaggatccgctaagataacaggctgatttttagcggagcgcccatgccagagaatcccttacccgccgatcagcaatttttcgccgacctcctcagtggcctggtacttaacccacagcggctggggcgcatctggtttgccgtacccgcggctggcggcagcctggcagaatggccgcggctggatattgtgctgcgcggcgaatacggtgcgctgggcgaaggcgaaatgctgtttatcccggcgcggaccgcgatccgccagacgggagataaaccggcgatggtgttaagtctggtgttcgccccggcgtggctggggctgacctttcacgacagccggggacggcagccgctgcgcaacattgagctgccccatccgcagcgcggggaaggggaggcgatgctgacggcgctcacgcacctcgcccgcacgccgcaggatcaggacattattcagccgctggtgttaagcctgctgcatctgtgccggaaggtggtcaacagcctgccgggtcgctccctgccgcgggcggatttcctttatcaaagcctctgtaactggatcgaggataactatgcctcgccgctgacccgcgagagcgtcgccgcgctgtttaacatcaccccaaaccatttatcgcgtctgttttcccggcagggcaccatgagttttgtggactatgtgcgccaggtgcgtatggcaaaggcgcggatgattttgcagaaatatcacctgccgatacatgaggtggcgctgcgttgtggatttcgcgacagcgattacttctgccgcgtgttccggcgtcagttcgggctgacgccgggggagtaccgggcgcgttttcagtaggcttacagctccagctctgcctgcaacagcgccagaatggccggtgcgtctctggcggcaaagagcgcgtcgcggaaggcggtattcatcagcttacgcgccagctgcgaaaataccttcacatggctgatgccttcgctttcgcccagcgtcagcataatcaccatctccacgtcgcccccgtcagcgccccagcttatgggatgcggcagacgggcaatgctgacgctggagtggcgcacccacggggatttggtatgggggatcgccacgccaaagccgatggcggtcgagacaatttcctcccgttgccagacatcttcctccagcgcctgcggcgcatcggtacggccatgcagcgccagattgccgcacaaatactggatcacctgttcacgtgaagcgagcggctcgccaacgcagatggtttccagcgccagcagcgggcgcggcgcttcatgcaccacgatattatttaacgccagctcgatctcctctgcgctgcggcactcgcaggctttctccgccagctcacggcaggccgcataatccagctggcgcaccagcgctttcaccggcgcgatgcgtggtccgctcatgctgagttcatccagatccagccccagcagcagcggcagataacggctttcgccgcccagctcaccgcaaatacccacccgcttatgatggcggtgcgcggtgctgacaatctggcgcagcatacgcaagaacgacggtgtgatggggttatacagcggcgaaacgcgcggattattgcgatccaccgcatacaggtattgcgtcatgtcgttcgagccgatgctgaagaaatccacctcctcgcagaagtgatcgatgataaagcacaccgacgggacttcgaccataatgcccagcggcagggtgggggcgacgcgcaatccctccgctttcagttcggcacgcaccgacttcagcatatttttcacccacaggatctgatcgaggctgtgcaccatcgggatcatcaactgggcattgccgaacgcgctggcgcgcagaatggcgcgcagctgcgtgcgaaacagatcggcaaactccggataaatgcgcaccgcgcgataacccaggaacgggttttcctcatgcgggatcggcagatagggaatatgtttgtcgccgccaatgtccatggtgcggaaaatcaccggctgatcgccggcgctgaccagcacctgctgacaggcttcgaactgctcctgctcgtccggggcgctgtcgcgatccataaacagcatttccgttctgaacaggccgacgccctgcgcgccgctggcaaaggcggcgggggcctccagcgcgctgccgatattggcggcgatatcaacgcggtgtccgtcgagggttatcgccggtaaaccggcatcgttgatttgctgctggtgacgtttcatcgccagcttttgcgccagcgcataatagccgctcaccgcctcgtccggcgtcatcaccagcacgccgcattcgccgtcgagtatgcactcagcgccatcatgcaggccgagtgaggcgggcggcaggccgcttaataccggaatagcgtgggcgcgggcgaggatcagcgtgtgcgaggtgcgcccggttttttccagcaccatgccttttaaataacctaaatcgaggccgagaaactggctcggcgtgacgtcttccgccaccagaatcgtcggctgattcagcgtcaggctgttgccctgccgcacctcaggccaggtgatgtgcagcagttgctcgctgatgtcgcggatatcgctgacccgctcacgcagatagtcgctggcggaggccgccagtttcgcgcatacctgctccatattcgtgatgatcgcctgcgccagcccctggcgctgctcgctcatcagccgacggatattaccgctgaattcggcatcctggatcagcgacagatgggcgctgataatggttttgctttcgccatccagcgcctgcaactgcccgttcagctgttcggccagcgccgccagactgtgctccagccgcgcgttatcttccgcgcgggcgggcagttgccggtaacgatcaagattatcgtgttgccagacggtaagacggcctgcgcctatgccgcctgccagtacgctggcatgaataagcgtgggattaagccgggccagcgagcgcggcaacggcgtggcagacggagctgcctgcgggggcggcaggctatcgctgtcaataaactggtgttcgagatagtgctccagcgcccggcgggcggcctcttcatcgctgccgttgatttccagacggcagctgtcgttaaacagtgtgccggtactcaccagcgccagcgagcttttggcgtcggcctgggtgttgaggcgcaggttaataaagcgaatatcgctgtgccaggcggcgcactgctctttcagcgcccaggcgggacgcgcatgcaggccgtttggcagcgggcagtaaaaggggatggttaacataaatgactccctgaaagagaacctgacctgaaatccgtcagatcgttgaccgttgcggcagtaaacgcgttgatcagcgccaccagcaggcggtgcgtgtccgccagatccgtcagatcggcaatggaggccgcgcagtgaccgtgacgcgtgggcggcccgagcacaatagtcggcacgccggtaccggacaggtgaaccgcgccgccatccgtgccgccgttactgaacatatcgttttgcagcgtaatgccacagtcatgcgctaccttctgcacagccgcggcgagcttcggcggcgcaaccatcgatttatcgtacagcaccagcatcggccctttgccgatctgccggttattggccgggtcgtaatcaaaattattgccccagcaggcggtgtcgagcaccagcgccacatcaggctgcaccgcccgggaggcagtctgcccgccgcgcaaacccacttcttcgctggagctggcgaccagccagacctcgcagggcagcggcgtggcgtgcagttcacgcagcagcgacagcagcagccagcagccgaggcgatcgtcaaaagctttgcccatcacccgctggcggggcagcgtctgaaacggactggcaaaggtaacgcgatcgccgggggcaatgcctgcggcgctgacctcctgctggcttgcggcgccgatatcgacgcgcagatttccgccctgggcgtcgccgtccagcaggccgtgaattttctgtccgtcgcgggtggtgatgcgcaccggctgaagggtgcgcgcgctcaggcgcacattgccgacgggcaatacctcaatcgccccgtcgcggctgatgctgcgtacgataaagccaacttcatccatatgagcgcatatcattacttttggtccggcgctgccgttaagccggatcagcaccgaccccagaccgtcaaactgcaccgctttaccgtacttctgcgcttcgtgaaggaaaatatcccgcacttcctgctcggcggcggcaatggcatccgcctcactgagcgctttcagtaatgcgacatccatcagcattctcccgtcagttgcagttccgtcggctggcgatacagcacctcgtgaccgctgtcggtgaccagcaccatatcttcgatgcgcacgccgccttcgccgggcaggtaaatccccggctcgacggtcagcaccatgcccggctgtaaaggcgtggcgtcagaaggcgcgaaacgcggattttcatgcacatctattccgaccgcatggccggtgttatggccgaagcgatcgccatagcctgcgtcagcgatgagccggcgtgcggcggcatccacctcccggcacagcacgccggggcggatggcgttaatcgccgcccgctgtgcgcgtaagacgatctgataaatatcgtaaagcgacgtctcttcgggcggcgtgtcgcgtccggcgacaaggaaagttctcgtcatatccgaacagtatccctggtactggcagccgaaatcgagggtgacgaactcacccgcgactataactttttctgaggctttgccatgcggcagcgcgccgcgcgcgccgctggccacaatggtgtcgaacgagggcttttccgccccctgttgtttcatataccactccagttcggcggccacttcacgttcacgcatcccgggggcgataaagcggcgaatgtggtcggcgctgacatcggcaatgcggcaggcttcacggatcagcgcgatttccgccgtggtttttatctgccgtaacggatcgagcgacacgctgaccaggctggcgttcagcgcctcgcgccactgattaccggtctgccagctgacgtgctcgccttcaaagccgagggtggcgatgttttcagcggccagcaggcaattgaccactaccggcatggtatgcgcggcatccagcagatgcagctggtagcccttaacccggtcggcgatgtcggcaaaatatcgaaaatccaccagaatatgcgcctgttcacgggtaatcagcacataacctgaactggtggcgatgcccagatgcggcagcttattttgccgggaggcgatcagcaccgcatccagcgcattgtccgacagccagtcacgcaggcggctaagcagtgtcatggtatttatccttgtcattacaggctgtcgattatcagtttgccccggcgatagagcatattgcgcgagacaatcaccagcagggcggtgatcaccgcgccaagcaggatgccgaacatatagacgccaagattagtcaccagcggccacgcccagatcgccgattccgggaaccactgcactgcgccaagccacacggcggtggtggagccgacgatggtgccaatcatataggacgggatagcggtgagcgggctttcaagcgcaaaggggatcgccccttcgctgatgcccataaatgccaggaacatcgcggttttgccctgcgggtacagctgggcgctgaacaggcgtttgccggtcagacggcgatcaagcagggtggcaaggccaaggccaatcgacggaatgacaatggcgatagatcgggcggtgaccggcaggacgtgatccgtggtaaagctgaaggcaacaaaaccggcggctttattgatcggcccgcccaggtcgatggccgtcgtggcggagatgccgacggcatacatcagcgcgcctttttctccggcggcggtcagcagggtgcggatgccgccgttgatccagccgccaaagggcgtgatcacgtagtacatcgccagcatgacaaaaatcgccgacaggatcggtatcaggaaagtggttttaaacgccagcaggtaatcgggcatgcggaacgtctgattcatccacttcaccagataaccggcggcaacagagatgatcagcgcgccgataaaggtcgacggcaccggcgcggtggtaacccattgcagcgcggtcgggtcaaagttcagcaactgcgtgggctgggtggacatcagcccgccaataaatcccgccggaaacgccagtttgccgccgatggagttggcgacaaaggcggcgaacatcggaatggcaaagccaaacagcacgccgccgaacgactgcgacagccaggcgaacttcagcagcgataaattaaagccggtgaattgcccggaattcagggcgtccatgatgccggtatcggcgggaatatccagccagctgtaagcgataagctgtgaaaacgcgaggataacgcctcccatgatgagcgtcggcaccatgcgtgaaatgccggacataatatgttgcggtaactcaccccaaaagcgacgacgggtggccacagtgttgttgaccgtcgccgctgcccctgaaggactggcgaccacggttgcgctgcgttttttaatggccatgtgctgatcctcttaccagggattagtgttctgcggcgatcatgtcttcaatttctttcagcgttccggcggcatttttgatggcgtcctgaagcgtaatttcgtacacgtcgcgggattcaaagcgctcgttatcttccggcgtaatggcgatggcgtgaatgatgatcgtcgcctcggcgatgtcctgcgcggtcaggcggttctggatcccgtccgcgccctgagtttcgatttttacctcgtagcctgcggcttttgcggcgtcttccagcgcctgggcggccataaaagtgtgggcaaggcccatcgggcaggcgcagagcgcgataagttttttggtcatgatgaactcctgatatgagtgggactgaggggattatggtgagggtttagcggacgggttaccggataaataatgcattgactggatttttaatgcggtgaaggggaaatgtgacgcaggtcgcgaagggggctaaaggagaaaacacgaacaaaaaagcgcagcgtctttgtgacactgcgcccctggctgatgcgaggcttaaccagcgatgccaggcaccagaatttccgtggcgacgatcactacaatcagaccgactacaacgggaacagaggtgcgttttaccacttcgaacggcgagatttttgccatcccggccactgctaccaccacgccggaaaccggtgaaatggtgcggccaaggttagacgcctgtagcatcgggatcgacagataggccgggttaatgcccgcttcgtgggccagtttggggatcatctccacaaaggcataaaaaggcgcgttaccggaaccggtggtcatggcggccagcatggtgaggatcaccagcaccagcatcagaataatgctcgcggaaccgaaagaggtggcgatggaaatcaggctctggatgaaaccaatggtgctcaggccctgggcgaagacgccggccgccaccagcaggatcactacgcccgcaaaggcgtcggccataccgcggtacgccacttcgaggccagagaacactttttgcgtgttaaagccgcgcaggaactccaggatggcggccagcagcatacagatcaccagaatggtgatgatgtgcagttccgggccccacttaccgtcaaaaatcagtacgccgacaatgggcgtgaacggcagaatggcatagaacgacggcgctgaggtgacgatgtcgttcacatccagcatttccggggtgatgttctcttttttatccagatagcgctgccagaaaaagtgcgcgatcgccatgcagataatggccgcaatggagatgggcagcgtggttttaaaggcgaaatcaatcagcggcatctctgcggctttcgcggccagcaccacatcgccggaggtcggcgacagaatgatggcagccggcgaggcgcagattgccgccgctgcgccgcggctgatgcctacgttaaccatgaccgggaacagggtggccatcagcaatacgccaaggccggtcgcggaggaaaccgccagtgacatcagacaggccacgaaataagcggcaatcatcagcacatagggagagttaatataacgcagcggtttggacgccagcttgaccaccatgtcgttggcgccgatatgcgtcatgtaagccgcgaagccgcacagcatcatgatcatcataccgaggtcgccgccacggctcatcagcagaatttttatgtattcgacgatgtcggtgacattatagccggtgctggtggcgctggcgggcagtaccttatgacccatcagggcgctgatgattaacagcgtcagaccgcccacaaagagcacgcccgtcgcggaatagcctttgatgatgtagcgcgcgacgcccacgatcaccacgaccccgataagcagttcaataaacgttaacatggtttccccggagagacagaacacggcaaagcattctgtgaaaaaataagtaaatgaaaaaacaaagacgcaatgtgccgaattaatgggcaaaaatagctgattgaaatcaataaacagacgagtaaagcagcttctcacgctgtacgtctatacacatgctaaatatgctggcgcgttgtaaccacgattttgcgcaccccaaccctgcgctgctgcgctttgccggcgcttttttccagtaaaaagaaacactttcattgtcgaaaacgccaaaggcgttgcccccatgcaggcaaaaaagttcgcgacattaatcactttttcgtaaatatcgactggacaaaacccataacaattgttgtactgatacccgacacagcatttgtgtcgtattttcatgtaaaggtaatttagatgtctaagattaaaggtaacgttaagtggtttaatgagtccaaaggattcggtttcattactccggaagatggcagcaaagatgtgttcgtacacttctctgcaatccagagcaatggtttcaaaaccctcgctgaaggtcagcgcgtagagtttgaaatcactaacggtgccaaaggcccttctgctgctaacgtaatgcctatctaagttagcgataagacagaattcaaaaacccgctgagaagcgggttttttttgcgctgagcgcagcggttactgcgcattgacggtggaaaaaatccagaacgccagcgcggtcatggcaaaagagccgaaaagattcagcgccacgttcagcatcgcccagccaaaacgcccgtcctgtaataaaaagacgacctccgctgagaaggtggaaaaggtggtcagtccgccgcaaaagccggtagtgataagtagcttccatagcggatcgatatgcgtcatccggttaaaccaggccagccccataccgataataaatgcgccaataaggttcgccgtcagcgtccccacagggatagcgtgatgagcaggatttaagcgcagactcaaaaaccagcgcagtacacttccggttccgccgccaataaataccgccaaaagaagttgtcccaccgctatgtcctgctatttgatttgtcagaggaatgagtgtaatgctgtcagaataatatgactatcgcaaaaagctgaggagtgacgatgcgggtggcagcgggacaatttgcggtgacgccgtactgggaaaccaatgcgcagatctgtgccgacctcatggcacaggcggtcgcgcagcaggccgctttactggtgctgccggaagccttactggcgcgccgggatgacgacccgacgctgtcggtgaaatcggcgcagccgctggatggcggctttatcacgcgcctgttgcaggcaagccacggcaatactatgaccacggtgctgaccctgcatgtgccttccacggcgggcagggcggtcaatacgctggtggcgatccgcggcggcgagattatcgcccattacgccaagctgcatctctacgacgccttcagtatgctggaatccgcacaggtggacgcgggagataatattgccccgctgattgagattgatggcatgaatgtcgggctgatgacctgttacgatctgcgttttccggagctggcgctgtcgctggcattagggggcgcggatctgctggtgttacccgccgcctgggtgcgcggcccgctgaaagagcagcactgggctacgctgctggcggcccgtgcgctcgacaccacctgttatctgatcgccgccggggagtgcggtaatcgcaacatcggacagagccggattatcgatccacagggtgtgacgctggcggccgccgctgaagatccgcagctgatttttgcagagctaacgcgagagcgtataatgcagacgcgcgaaaagctgccggtgcttaaaaaccgtcgctttgcgccaccgcaattattgtgatgtttttttaaacaacacttgattcaccttgttacagattgctattgtgtgcgcgcgtcatatgaccgttaataacgtcaggttttagggcgcatttcgcagcctgttttatgaaagaaggtatttatgggtgagattagtattaccaaactgctggtggtagccgctctggttgtgctgctgtttggtaccaaaaagttacgtacgctcggcggtgaccttggcgcagccatcaaaggctttaagaaagccatgaacgacgatgacagcagcgcgaagaaaaccgtagacggtgacatcgccgcagagaaactcactcacaaagagtgatagcaatgccccaggcttgcaaaaaaaccggcttatcaggccggtttttttatgcgcatctgtaagtaaatatgtcgtgcttattttacttccagacctttcgcctgcatgtcggcgtgataggacgaacgcacaaacgggccgcaggcggcatgggtaaagcccatcgccagcgcttcggctttcatctcatcaaattcgtccgggctgacgtaacgctgtaccggcaggtgatggcggcttggctgcaagtactgacccagcgtcaacatggtgacaccgtggcgacgcagatcgcgcatcacttcgatgatttcggcgttggtttcacccaggccgaccatcagaccggatttggtcgggatctccgggtgcgcttctttaaaacgctccagcagcttcagcgaccagttatagtccgcgccagggcgtacctgacggtagacgcgcggcacgttttccaggttgtggttaaacacatccggcggcgtggcgttcaggatgtccagcgcgcgatccatacgaccacggaaatcgggaaccagcgtctcgattttgatggtcgggcttttctcgcggatggcggtgatacaatcagcaaagtgctgagcgccgccgtcacgcagatcgtcgcgatccacggaggtgatcaccacatagcgcagcgccatgtcagcgatggtttgcgccagtttatttggttcattcgcatcaggcgcgaccggacgaccatgagcaacgtcacagaacgggcaacggcgggtacaaatcgcgccgaggatcataaaggtggcggtgccgtggttgaaacactccgcaaggttcgggcatgacgcctcttcgcaaacagagtgcaggccgtttttgcgcatagccgctttgataccctggatacgggtggagtctgccgggagtttgattttcatccactccggttttcttaacagggcttcacgctctgttaccacgtttttgaccgggataagagccatcttatcggcgtcgcggtatttaacaccgcgttccatcacaatgggtttactcatagcgtgcgtgttccagttgcgaataacgaaggaaagcttttcaattcaagggaatgttgtatttatcaactatttttgaattagctgcgccgcagtataccattgaaaagggtgataaagcagcctgacggcccggcaaattgtaaaatagttgttgatttgtgcctttactgccagggcacgccgccgttatgtcaggcaaactctcccgtcagaatgcacgggatattacattgatgacgttttccagtaccggatcgcgcatactcaacttgttgtaatacaaagaaatttcaatctgctcattgctgactgccgggaattcaatctcctgtaacggccagcaggcgctaaacagggtaaataaacggaagggcatcagccccaacaggtcactgttgccgatcagtgctgcaatggtgaacatattgtaactgctaaagctcacctgacgctcagggaagagttcctgtatgcgctgacgtaatacgctcaggtgctgtccttccagcatcaacatcgtgtgctcatactggcgcagcgcctcttcagtaatgggctgttgcaggcaaggatgatcttttcggcacattagcaccagacggtcagaatagagcacatgctgattaagcgcgcgggtgctcggcagatgcgtatcgataattaaatcagtctgaaactgactgagctggctttccccgtcgttaatgggaatattgcgcagcagcaaatgcggcgactgtgctttgatagcctgataaatggtcggaataaccagcgcgccaagcgagggcggcgtgcccagcgtaatggtgcgctgtttatcatagctaccggtgagatccagcgcccccagaatagactccagtcccaggctgatatattcgtgcaaatgcgtcgcataggccgttggcgtcacgccctggcccttacggataaacagcggatcgggaaagatagtacggagtttctgaatggactggctgatggctgacggagtgagattaagcacttttgccgcattcacaatgcctttatgcacgtaaacggcttcgaaaatcgtcaataaattaagatcgatattgcgcaatgtacggaagatctgcggttttgcgtcctcgggacgttctgttattcgattttccgacgggtcattataatccacgcgtaaactccgaatttattcatgcgatgaataatgcataacaaataagtgtgatgattattagcgcgcaggacaggcaatcaccagcagtgattgccctgcgctttgattttcctgctgaccccagatgaaatcgtcagcatgaataatatattagacgctaatatgttgatgcgggggattattaagtaaatttaggaaattagcgactaatcgcgggccggttttatcggtgctggcgtcagcaacccactggctcatttgcgccatttccattcctgcataaccgcagggattaatgcgctggaaaggagcaagatccatggcgatatttaacgccaggccgtgaaaagaacagcctttgcgaatgcgcagtcccagcgaacagattttcttgccgctcacatagacgccaggcgcatccgcgcggggataagcttcaatatctgactccgccagcgtgttcaccacggtttgttccagcagggtgaccagttcgcgtacgcccagcttacggcgtttcaggtttaacagcacgtacatcacctgctgacccggtccgtgataggttacctggccgccacggtcgctctggatcacgggaatatcccctggcatcagcacatgttcggcttttccggcctggccctgggtaaacacaggatgatgttccaccagccagatttcatcaggcgtggcgtcgtcgcgggtatcggtgaattcatgcattgccagggagacgggctcgtaaggctgtaaaccaaggtgacggataagaatcgtatcctgaagcaaaacagcatctccggagagagggaagggtggcaggagtatatcataatgacgtgttacctgagatgcccaggtaacacgcctgttaattacagtaccatacgcacgatgtcgatattgccgagctcttcgtacagggtttcaacctgctcaatatgcgtcgcggtgatagtgatagagaccgagtggtaattgcctttgctgctcggttttacctgcggagagtagtcaccaggcgcatggcgctgtaccacttccaccacctgatcaaccagctccggtttcgcctgacccattactttgtaagtaaagggagtcgggaattcaagcagttcgttaagtttggttttcatgtcagctccggcgttacaaaaaagaacaactcccgccacagggcgggagttttattgatgcatagtatatggggatgaaattcagactttcaagtgctgaatttttaaccaaaccagtggtggaacatcagcttgatataatcaatgattttgccaaagaaattgccttccggaatttcctgcaacaccaccagcggacgctgttcaatggttttgccatcaagctggaagttaatggtgcccactacctgatttttttgcagcggcgcgtgcagctccgtgctggtcagcacatagctggccttcagatctttcatgcggccgcgcggaatggtcagataaacatctttatccacgccgagggaggcgcgatcgctgtcgccaaaccaggcgggttcagaagcaaactctttacctgctttgatcgggttaacagtttcaaagaaacggaagccccaggtcagcagttttttgctttcggtttcacggcctttaaaggtgcgcccgcccatcacggcggaaatcagacgcatctggccttcggttgccgaggccaccaggttatagcctgctttatcggtatggccggttttaataccgtcaacgttcaggctgttgtcccacagcaaaccgttgcggttggtctggcggatgccgttaaaggtgaactctttctctttataaatagagtattcgtttggcacatcgcggatcagcgcctggccaatcagcgccatatcgcgggcggagctgtactgaccttcagcgtccaggccgtgaacggtctggaaatgggagtttttcaggcccagcgcgttaacgtagctgttcatcaggccgacaaaagcgtcctggctgcccgcggcaaaatcggccatcgccacgcaggcgtcgttaccggattgcaggttgataccacggatcagctgggataccggcacctgcatgcctggtttcaggaacatcagcgaagagcctttgaacaccgggttgccggttgcccaggcatcgttattgatggttaccaggtccgtttccttgaacttgcctgctttcatggcctgaccgatgacgtagctggtcatcattttggtcaggctggccggatcgcggcgagcatcggcattctgctccgccagcactttaccggagttgtaatcaatcaggatgtaagactcggcatcgatctgcggcacgccggggatcatggttttgatgttcaggtcatcggcatgggcagcagacagggttgcggctgtcagcgcggtggtgagcgcgaggcgcttcacgaaacgaacggaaaaagtggtcttcatggtcagaacaacgacatccgtgatggagtgaaaaaaagtgccttactatagcaaaagctataagggcaggcatctgactttccgcatgatttgtgaatgaaacttacacaaactgacaaagtaagatgccctgttggtatttactgcgcgctggcaataaaggattgcagctgagcttcgctctgcagacgtgactgtaacgcgctggcgtcagccttgctgctaaacggccctaactgaatacgccagaccgcgccgttttgtaccacccgacccggcacggaaaactgctgtgccagacgctgctgatactgctgcgcgcgagtctgatcgctgaccgcgcccacctgcacgacatagccgctggcagcgcctgcggcggctggcgctgcaacgctaccctgcacggagcctggcgcggtgactggcgcggcaggcgtaaccggtgcggcggcaggcgccggggtagccacgacaggctgtggctgagcggcaggcggttcgttaccttccagcacgccgcttgcaagggtggtcggcgcgccgaggaatccgccgctgctgaccggtgagcccagcgtgttttcgcttttcagtgtatcgttgctgatcggctgcacgtcagcctgtgcctgctcaggctgcgggaggctggaggcgctgcccatgccgccggtcagatccggacgggcgggcagggcgtaagtctgtttcgccaccgtcgtacaggcggtgccaggccctgacagcgtgccatcctgcgccacgataatcggatcgatgcgcactttggtattgttggagttgttcagacgatccgcggcggcacgcgacagggaaatcacgcgatcgttaccataaggcccgcgatcgttaatacgcaccacgatcatacggccgttcgccaggttggtgatccgcgcatagctcggtaccggcagcgtcgggtgcgcggcggtgagctgcatgggatcgaaggcttcgccggaggcggtcagattgctgccgggttcggcatcataaatggccgccagacccgcctggctgaagcgcgacggatcctggacgattttataacgcttgccatcgcgttcgtaatcctgattcacggcagggttaagtgactcgtagcgcggctcagccccgccaatttcaacaaccgggccgttacataccgcaggctgcggcgcaaccggggcgggctgttgttgagtgtcacttgtacatgctgccagtaatcctgctgctatgcagactgcaagccattgcttacgcattgcgcacctcttatacgctttttgacaacattttccggtgggtatgaatagacatcacaataccaaacccggccatgagtacgatgagagcggagcctccataactgaccagcggcagaggaacccctaccaccggcagaataccgctcaccataccaatatttacgaagacataaacaaacaaaatcagcattaagccaccggccatcacgcgaccaaaggtggtctgcgcgcgggcggcaatatacagcccacgaataatcagcagcaaatagagcgccagcagcaccaggaagcccaccagacccagctcttccgccactaccgcaaagataaagtcagtatgccgttcgggcaggaattccagctgcgactgtgtaccatgtagccaccctttaccgcgcagcccgccggagccaatggcaattttcgactgaataatatgatagcccgcgcccagcggatcggtttccggatcgagcaacatcatcacgcgctgtcgctgataatcatgcatcaggaagaaccacaggatcgggataaaggccgccagcaggatcgccgcaatgccgatcagacgccagctcaggccggataaaaacagtacgaacagaccggaaagcgcgaccagaatcgacgtacccagatccggctgcgccgccaccagcagcgttggcataaagatcagcaccagcgcaatagcggtatttttcagcgagggtgggcagacgtcgcggttaataaagcgcgccaccatcagcggcacggcgatcttggcgatctcggagggctggaaacgcacaatgccgagatcaagccagcgctgcgcgccttttgagatcgcgccgaaggcgtccaccgccaccagtaaaataacgcagatgatatacagatagggcgcccagccttcgtagacgcgcggcgggatttgcgccatcaccaccatcaccaccagtcccatggcgatctgcccaatcttgcgctcggtcatgccaatatcctggccgctggcgctccagatcaccagcgcgctataggtcagcagagccaggataatcagcagtagcgtcgggtcgatatggattttatcccagaacgattttttgttcggattatccgtcatgatcattggtcctctgctgccgcggttgccggattttccgcaggcaaatcggtattgttatcgcccagcataatgtggtcgaggatctggcgcatgatggtaccgaccgcagggccagcgccgccgttctccagaataatcgccaccgcgacctggggtttatcgtacggcgcaaaggccgtcatcagtttatggtcacgcagacgttcagcgatcttgtgcgcgttataggtttcgttggccttcaggccaaagacctgcgcggtaccggatttggccgccactttgtaaggcgcatcggcaaaatacttatgcccggtgccgttcgcgcggttagccacgccatacataccgtctttggcgatttcccagtaaccggaatgaatatcgcctaccggcggctgttccggctgtttccacgggatttgctgaccattttccagcgtgctcattaacagatgcggcactttaaccacgccgtcgttaatcaaaatcatcatggccttgttcatctggaccggcgttgccgtccagtaaccctggccgatacccaccggaatggtgtcaccctgataccagggttttttgaagcgcttaagcttccattcgcgggttggcatgttgccggagcgctcttccgccagatctatgccggtgtatttgccgtagccgaacttgctcatccattcggaaaggcggtcgatacccatatcgtaggcgacctgatagaagaaggtatccgccgactcttccagggacttggtgatgttcagatgcccgtgtccccattttttccagtcgcgataacgcttctcggagcccggcagctgccaccagcctgggtcaaacaggctggtattgcgggtgatcacccccgtgcttaaggctgataccgcgacgtaaggcttcaccgttgacgccgggggatagacgccctgggtcgcgcggttaaccagcggcgtgttcggatcgttaagcagggcgctgtaatctttgctggagatgccgtcgacaaacaggttcgggttatagcttggcatggataccatcgccagaatgccgccggtgcgcggatcggtcaccaccaccgccgcgcggctgcccgccagcagggtttcgatatagctctgtagcttcagatccagcgtcagggtaatgtcatgaccggcctgcggcggcacttcttttaactgacggatcacccggccacggttgttaacttcaacctcttcatagccggtctgcccgtgcaggacgtcttcgtaataacgttcgattccctgtttaccaatatcatgagtggcggcgtagttagccagcttgccctctttatcgaggcgcttcacgtcgttatcgttgattttggaaacgtagccaagcacgtgggtcagggcggagccatacggataaaagcggcgtttatagcctttgacttccacgccagggaaacggtactggttaacggcaaagcgcgcgacctgcacttctgtcaggttagatttcacgggaatcgaggtgaagcggtgcgagcgggcgcgctcttttttaaagttggcgatgtcgtcatcagtcaaatcgaccacgccacgcagcgcatccagcgtctgctgcacgttatcgactttttccggcatcatctccacctgataaatggtgcggttcagcgccagggggatgccgttacgatcgtaaataatgccgcgactgggggcgataggcaccagtttgatgcggttttcgttcgagcgcgtctggtagtcggtatgccggagaatttgcagattataaagattggcgatcaggacaccagaaagcagcaaaatccccgtaaaggcgaccacagcccggcgcacaaacagcgcggactcagccgtatagtcgcgaaaagaattctgtaatttcatccgctgcgtaatctacctggtctcattactctcggtgataaggatggttggtagtaatgctccatgcacgatagaggctttccgccaccagtacccgaaccagcgggtggggtagcgtcagtgcagagagagaccaactttgttcagctgccgctttacaggcaggggataacccttccggcccgccgatcagcaggctgacgtcgcgtccgtcctgcttccagcgttccagttcatgagccagctgcggcgtatcccagggtttgcccggaatatcgagggtgacaatgcggtttttgccagccgcagccagcattaactcaccctctttatcgagaatgcgtttgatatcggcgttcttaccgcgttttccggcgggaatttctaccagctcgaacggcatgtccttcggaaaacgacgcagatattcagtaaagccggtttgtacccagtccggcattttggtgccgacggcgaccagttgcagcttcacgcattaaccccagagtttttccagctcgtacagcgcacggctctctgcctgcatgacgtgaacaatcacttcgcctaaatcgaccaccacccagtcggcgacgttttcgccttccacgccaagcggcatcatgcccgccgcgcgtgactcctgcaccacatggtcggcaatcgacatcacatggcgggtggaggtgccggtgcaaataatcatgcaatcagtgatgctggacttaccctgaacgtcaattttaacgatgtcctgacctttcaggtcatcaattttgtcgataacaaaatcctggagtgctttaccctgcaagtgttccccctgggagcgtacatatagtcattaatgaaggtatgacagtataactgaactgtcattctggcgggacacatgccgccagtaagatttttgaaagtgggctatcatcccacccgcggcaggagattgcatcgccatttttgtaaaacaatttcttaaagactttgcatggcggggcaagtccggcagcggaggataacagccttgccgggcgtgtcaatcatgtaatgacgcgcaggacgattatccggcgtccggcagccagaccgcgcggctgttcagtacgctcagggtggcaaaatccttgtggaaatcgatggcgctccacgccccctgttcgacgcgaaaatgccacaacgaggcagcaggcatgttaagcagcgtggcgatcagcagactgatcaccccctgatggctgacaatcagcacgttatcgtggtgctgccagtcacgcagcccggcaataaattgttgcacgcgctgtgaaaaatcctgaaacccttcgccgttggtcggcacggcgttctgccagtcgagacaccaggcggcgtaattatcagcgtcttcctgttttaaatcgcgatgatggcgcagttcccagtcgccaaaaaacatctcattgagcaggggcgtggtgtgcagcggaatattacggtcgttcagtaccagccgggcggtatgctgcgcgcgttccagggcgctgcacagcacctgatcaaaaggcacctcccgcagcagcgaatgcagcgccgtggcctgggcaatgccgcgcggcgtcagtgacgtcggcgcatggccgctgtacagcccggcgacgtttgcttcggtttctccatgacgtacaagccataatcgcatacgctatcctccggatattttctgcataaagtctaccattgcgcgctgagcgggcgcggttttttcgctccgatagccgctttaacaggagttcaccgatggctttgtttcacagcgcccacggcggtaatatccgcgaggcggcggacatgctggggatcgcgcctgacgccctgctggatttcagcgccaatattaatcctgccgggatgcccgatacgctgcgccaggcgctggtggataatctgcgccttgccgaacgttacccggatgcggagtatcagcatctgcatcaggcccttgccgcgcatcatcaactgcctgcctcctggctgctggcgggcaacggcgaaacggaagcgatttttaccctggtcgatggccttgcgccgcgccgggcaatgctggtgacgccgggttttgcggagtaccgccgcgcgcttaagcgggccgggtgtgccatagaagatttcgcgctgcgtgaagacgcaggatggcagctcaccggggacattctggatgcgctgaccgccgatctcgactgcctgtttctctgtacgcccaataatccgaccggcttactgcccgatgaaagcttgctgctggccattgccgcgcgctgccgggcgcttgggatcgcgctgatcctcgatgaagcctttatcgattttatcgaaggccactgcggatttattccttatcttgcggcgaacccgcacgtctgggtgctgcgatccttgacgaaattctatgccattccggggctgcgactcggctatctgattaacagcgatgcgcaggcggtcgggcgcttacgccagcggcagatgccgtggtccattaatgcctttgccgcgctggcaggggagatcctgttgcaggatacggattaccagcgcgccacctggcagtggatcaacagggaacggccacgcctgtatcaggcgctgagcgtgctgacagggctgactctgtggccgggggtggcgaattatctgtttttgcgctgcgaggtgcctgggctggatttacagcgggcgctgctggagaagcatattttgatccgcagttgcagtaactatccggggctggacgaacgctattatcgggtggcggtgcgtagccttaaggagaacgacagcttgatcgacgcgatgcaggcggtgcttagcgatacaggccctgctgtttgatgtaatcaagcacactctccggcagcaagtcgtcgcacgcttcgccgcgcgacagtcgctcgcggatcagcgtggcggagatattcagccatggcgtttccgcaaggaaaatcttcccggcgggcagggcgtgcagatcgtcgatgcggtgggtgaggtgctgctccagccactgcaggctggcctcgtcactcatcttttgtggataaccgggacggcggcagaccagcaaatgacagtgatcaagaatggtttcatagcggtgccaggtggggaaggagagcagagaatcctggccgataataaaagccagcggtcgcgtcgggccttgctcttcccgccatgcctgaatagtttgcgatgaccatgagggcgtatcgcgttgcagttcccgctcatccagcctgaacagcggtttatcggcaattgcccgctggatcatggttttacgttgtagcgaactggcttccggctgcggacgatgcggcggcacgttattgggcatgatgatcacctgcgacaggccgatcagattcgccagcgcttccacgggtttaaggtgcccgtaatgaaccggatcgaaagtgccgccaaacagtgcctgtaactgattcatctcatccatcaataaaaatatctgccagtgccttatgacagagtagcagagaaagcccttccagctccgcccataccgattgcccaaagtcctgctttaccgttaattcagtgcgggagagcaggtgtaccgcatgacgtaactgttcgttactgagccggttcagcgcctcgctggtcaccgcgcggcggttctgccagacgcgatgcttatcaaacagcgtgcgcagcggcgtgctggcggactgacgttttaaggtcaccagcagcagcagttcccgctgcagggtgcgcagcaggatcaccggctcgcagccttcaagacgcagctgttgcaggatatgcagcgcgcgtttgcttttcccggcgagcagcgtatccacccagtgaaaaggggtaaagtgcgccgcgtcgttaacggcctgctccacgcgggggagcgtcagcttgccgtcgggccacagcagcgccagccgatccagcgcctgcgccagcgccagcaggttgccttcatagcaatagcacagcaactggctggccgcttcatcaagctgaaggttgttctgttttgcgcggttcgccacccagcggggcagctgtgcctgttccggcgtctgacaggtgaccatcacggagcgctctgtcagcgcgctaaaccaggcggcattttcctgcgctttggtcagtttgttgccccgcaccatcagcagcagatcgtcgtgcagcaggctgaccagcgtggcgagctgttcattgatggcggcattcgggccgttgtcagggagctgcaataacagcgtctgacggctggcaaacaggctcatggcctggcacagtgaaaagagggcggaccagtcggtgctggcatcaatggtcacgctgtgatgctcatcaaaaccctgggcgatcgccgcggcgcgcaccagatcctgactttcctgcaataacagcggatcattacccagtagcagatacgccgcgcgcagcccttcattgagctgcgcgcggagttgttcagggtacagcttcagcatcagttacctaatgatgttggggcgcttggcgcaacatcaggcgtggtcaccggcacatcggcatcctcactattggcatgtacgcttggcagctggcggatcagctgttccgccgctttgtcatacatttcctggatgatcatcgtctgttccgcatcttttgccagcgcgttttgcgggttatcgaagaaggaacgataaaccttggtttttaaaggataaattcctttgccagggatcatcagcgatgcccatacgtccatcaccatctggtattccgctgtacgaccgttctggaaaatagaggccgtgtcctgtacaagactggcggtacccagacggagcgaaggaatatcctgacgtgtgctgcctttctcaaccacttcaactccgttcagccgcagctgggtacgaatcgcacggcttaacggaccataaggatccgaagagtcgaaaatgatggttttcatttcggcaggaacctgggtggtattccgtaaatgccagccgcacccggcggtgaccagcaccgccagtgatagtaaaactgttgccagatatcgcacgcttcctcccgcgcttagccaacgaccagattgagcagtttgcccgggacataaatcactttacgcacggtaacgccctcaagatatttcgcgaccagatgttcctgacccgcacgttcgcgaacctgttgttcggtagcatcgacaggcacggtaattttaccgcgtactttgccgttcacctgcacaaccactaaggtggaatcttccaccatcgcgttttcgtcagcctgcggccatggcgcgttgtcgatatcgccttcgccatgcagttcctgccacagcgtgaagcaggcgtgtggggtgaacgggttgagcatacgcactaccgccagcagcgcttcctgcatcagcgcgcgatcctgctcgccgtcctgcggcgctttcgccagcttattcatcagttccataatagccgcaatcgcggtgttaaaggtctgacgacgaccgatatcatcggtcactttggcgatggttttatgcacatcacggcgcagcgctttctgatcttcgctcaggctcgccacgttcagcgcggcaacctcgccctgagaggtatgttcatacaccagtttccagacgcgtttcaggaagcggttcgcgccttccacgccggattcctgccattccagcgtcatgtctgccggtgaagcgaacatcataaacagacgcacggtgtccgcgccgtaacgttcaaccatttcctgcgggtcgataccgttgtttttcgacttggacattttgctcatgccggtatacaccagctcatggccgtcggcgtctttcgctttcacgatgcggcctttctcgtcgcgctcaacgatggcgtctttcggggacacccaattgcgctcgccgttagcacccacatagtagaaggcgtctgccagcaccatgccctggcacagcagctgcttcgccggttcgctggaggtaaccatgcccgcgtcgcgcatcagtttatggaagaagcggaaatagagcaggtgcatgatggcgtgttcaataccgccaatgtaaatgtccaccggcagccagtagttggcggctttcggatccagcatgccgtcggtgtgctgtggacaggtgtaacgcgcgtaataccaggaggactccataaaggtgtcgaaggtatcggtttcacgcagcgcaggctgaccgttgacggtagttttcgcccactccggatcggccttgatcgggctggtaatgccgtccatgacgacatcttccggcaggatcaccggcagctgatcggcaggggtcgggatcaccgtaccgtcttccagggtcaccatcgggatcggcgcgccccagtaacgctgacgggaaacgccccagtcgcgcaggcggtagttcactttacgctcgccgacgcccagcgccgccagcttgtcagcaatggcgttaaagccctcttcaaagctcaggccgttgaattcgccggagttaaacagggtgcctttttccgtcagcgcctgttcagacagatccggctccgcgccatctgccgtcagaataaccggcttgatggtcaggccgtatttgctggcaaactcatagtcacgctgatcgtggcccggaacggccatcactgcgcccgtaccgtactccatcagcacgaagtttgctgcccataccgggatcgcttcgcccgtcagcggatgaatggctttaaagccggtatcaacgccttttttctccatcgtcgccatgtcagcttccgccactttggtgttgcggcattcgtcgatgaaggtggccagttctggattgctttccgccgccgcctgcgccagcggatgacccgcagctaccgccaggtaggtcgcgcccataaaggtatccgggcgggtggtgtagacggtcagcttgctgtcatggccctgcacgtcaaaggtgatttccacgccttcggaacggccaatccagttacgctgcatggttttaacggtgtccggccagtggtccagcgtatccagatcgtttaacagctcttcagcgtaggcggtgattttaataaaccactgcgggatctctttacgctcaactttggtatcgcagcgccagcagcagccgtcgataacctgctcgttcgccagcacggtctggtcgttcgggcaccagttcaccgcggaggttttcttgtacaccaggccttttttatacagttcggtgaagaacagctgttcccagcgatagtattccggcgtacaggtcgccagctcgcggctccagtcgtaaccgaagcccagcattttgagctggtttttcatgtaattgatgttgtcgtacgtccacggggccggagcggttttgtttttcaccgccgcgccttcagccggcaggccgaacgcatcccagccaatcggctgcagaacgtttttgcccagcatacgctgataacgggcaataacgtcgccgatggtgtagttacggacgtggcccatgtgtagtcgtccagaaggatagggaagcatcgacaggcagtaatacttctctttgctctcgtcttcggttacttcaaatgtgcgcttctcgtcccagtgttgctggacttttgattctatctcttccgggcggtattgctcttgcatggcagccagtgatcctgttttcaatacagctacaagcgtagcattagatgtgatgtctcagatccgcatagcatagcccaaacgcccgcctcaaaacagcctttcgcacaaaaggagggatgccgatccttgcaggaatttacacactctgtggggcggctggcaaagtacgccggaaataacgtctattattagaaggtgttactaagcccggaggcgaaaggatgaacaaggttgctcaatactaccgtgaactggtcggcacgctgaccgaacgcctgcaaaacggcgagcgcgacatcgacgcgcttgtggaacaggccagactgcgcgccacccagaccggggagttaacgcgaaccgaaattgatgaactgctgcgcgccattcgccgcgatctggaggagtttgcccgcagctatggggaaagccagggcgaactgaccgacagcgtttttatgcgggtgatcaaagagagcgtctggcagcagctggcggatattaccgataaaacccagctggagtggcgggaagtcttttccgatctcaatcaccacggggtctatcacagcggggaagtggtggggctgggtaacctggtctgtgaaaagtgccatttccatcttgcggtttacacgccggatgcgctgccgttatgtccgaagtgcggtcatgaccagttccagcgtcgtcctttcgagccgtaaattttaaggccggagcgccttcaggcgtttccggccatcacgctttattctccgtagaacgccagtcgttcggccagtaaatccacaaaagccccgcgatcgacatccatcatcaccgtcgtattcggcgtattgccggtcaggaaatagtaatccaccaccgtcataccctgggtgtactgcccgcgggtttccacgccgacccagcgctccaccgtggtgaaaatttccggtttcagcagccaggcgatggtacagggatcgtgcagcggcgcgcccacaaagccccatttttcctgtttgtgatattccataaagaagtcgagcagttcggccacaatcacagccaccggattgccgatggcgcgaaaacgctccacatccgcggcgtggatctgtgctttatgggtgacatccagccccgccatcaccaccggaatgccggagcggaagacgatttccgccgcttccggatcgacataaatattgaattcggcggcgggcgtccagttacccggtgccattgcgccgcccatgatcacaatacgcgcgatgttgtcatgcagttccggatggctgtttagcagcagcgccacgttggtttgcggcccggtagccaccagcgtgaccggctccgcgctctcgcgcagggtttttgccatcagctcaacggcggtgcagggctgcgccgcaaaacccggctccggtaatgccgggccatcaagcccgctttcgccgtgcacgttatcggcgatgataagctcgcgcatcagcggttttaccgcaccgcccgccaccggaatgtcgctgcgcttaagcagcgtcagcatccgcagcacgttattcagggttttgtccggcgtctggtttccggcggaagaggtgacggctttgacgtccagttccggggaggcaagggcgagtacgagggcgatagcgtcatcatgacctggatcgcaatcaattattacgggcagtgccattggtattccttatccgtgttgttttgtgacaagggtaacgcgtcactgaaaggcagacgataaaggcgggtagaaaacgtgaagcggcgcgcagatatgccctgcgcgccgggaagattaatgcaggattttggcgaggaaatcttttgcgcgatcggaggccggattcgcaaagaactcctctttcggcgaatcttcaacgattttgccttcatccataaagatcacgcggctggcgactttacgcgcaaagcccatttcgtgcgtcaccaccatcatggtcatgccttcctgcgccagctcgaccattacgtccagcacttcgttgatcatctccggatccagcgcggacgtgggttcgtcaaacagcattgccaccggatccatgcagagcgcgcgggcaatagccacacgctgctgctggccgccggagagctgagccgggaatttattggcatgcgccgcaagacccacgcgctccagcagtttgctggctttttcacgggcggcggctttatcgcgcttaagcactttgatctgcgccagcgtcaggttttcgataatcgacagatgcgggaacagctcgaaatgctggaacaccatgccaacgtgggagcgcagctccgccaggttggttttcttgtcggtcacggtggtgccgttcacaacgatctcgcctttctgcaccggctcaaggccgttgacggttttgatcagcgtcgactttccggatccggacgggccgcacaccaccaccacttcaccttttttaaccgtggtagagcagtcggtcagcacctgaaagtgaccataccattttgaaacgtttttcagggaaatcattaaactgtccttttcttcagatagctgaccaacagtgaagcactgagactgataacaaaatagacgaagccggcaaagaggatcatctcaacctgggtaccgtcgcgctcgccgatggtggaggcggtgcggaagaagtccgccaggcttaacacgtacaccagagaggtatcctggaagaggacgatgccctgggttaacagcagcggcaccatcgcccggaacgcctgcggcagaataatcagcttcatcgactgccagtgggtcatgcccagcgccagcgcagcgcttgactggccgcgtgaaatactctgaatacccgcgcgaataatttccgaataataggcggcctcaaacatcgagaaggcgaccatcgcggagatgaggcgaatatccgatttgggcgacagccccagcacatcctgcaacagacccggcacaatcagatagaaccacagcagcaccatcaccagcgggatagagcggaaaacgttcacataggcagtagcgaaccacgccagcggcttgaacgtcgacatgcgcagcaccgccagaatggtgccccagacgataccgacaattaccgccgtgacggtaattttcagcgtcacccagagtccgtcaagcagatagggcatcgccggaataatggaactccagtcaaactcgtacattatttgcctcccatattgccaggcaggcggactttacgttctaccaggttcattaccagcataatcacggcgttaatcaggacgtaggcaagggtgatggcggtaaaggattcccacgcgtgggcggagtaatccagcagcttacccgcctgcgccgccatatccaccagaccaatggtcgaggcgatagcggagtttttcaccaggttcatcatctcagacgtcatcggcggcacgatcacccgataggcgttcggcagcagcacatagcgataggtttgcggcagcgtcaggcccatcgccagcccggcgtttttctggccgcgcggcagcgattcgatcgccgcacgcacctgctcgcacacacgggcggcggtaaacagtccgaggcagatcattgacgacaggaagaactggatattgggatcgagctcggctttaaaccacatgccgagatcttccggcagcagttcaggcacgaccagataccaggtaaagaattgcacgattaacggcacgttacggaagagttcgacgtaaagcgtcccgatgcctgccaggaaccggttaggcacggttctgaggatgccaaacagggagccaaccaggaaagcgaggatccaggcggtgatcgacagcgcgaccgtgacctgaaaaccgctccacagccagccaagataggtggtgttgccgaacggggcttgttgcaggaaaattccccagttccagtctattgacataatctacctctgaaaaaaaagggtagcagcgctacccccgaagattaataagaagctgtaatattcgtgctgaatggggaacgacccttcaacgtatagtctgtccgcgcttcatatcaatcgagagggcaggaggacccgcccctaatggttgtaattagttaagagctttgtcgttaggttctttgaacagcgctttcatctcatccgagagttcaaagttcatgttcagattttttggcggaattgggtttttgaaccacttatcaaaccacttagccgcttcgccagaggtctgcgcctgggcgatggtgtcatccatcagcttcttgaactcggtatcgcctttacgcagcatgcagccataggcttcctgcgactgcggcttgccgacgatttcccagttatccggttttttcgccttcgcacgctcgcccgccaacagggcatcgtccatcataaaggccacggcacgaccgctttccagggtgcggaaggagtcgccatgatctttcgcgctgatgatgcgcatatccattttctgctcttcgttaagcttgtgcagcaacacttcagaggtggtgcctgaggtgacgacgaccgctttacctttcagatcggcgaagtctttcacgttgccgccttttttcgccagcagacgggtgcccacgacgaaaatggtgtcagagaaagcggcctgcttctggcgctccaggttgttggtagtggagccgcactcaaaatcaaaggtgccgttctgcaacagaggaatacggttttgcgaggtgatagggatcagttttacctgcaggtccggcttgttgagctttttctttaccgcttcaacaatggcgttggagtaagcctgcgaataacccaccactttttgctggttatcgtagtaggagaacggtacggaagattcacggtgtccgaccacgatgacgccgtttttggcgattttttccagcgtgctttgcccggccgcaggggctgcatcttcagcctgcgctacgccggcggacattcccatcaccagcattgctgtggccagtttacgtaattgcatatccaactccttcatcgtcagcgccagagacgcattgatacccagtgtgagtgattgtgttgttatatcctgctgcttaagcgtgcagtgttatgcgtgtttgttaacatttagtctggcttaatgtaaagattttgctgcgatattgtttatttttgcgaggcgctccgcaccgtttagaggcataaatcgctgcttgcaccaaattagtgccgccgccgatccgtgctggtgcatcaaggttgcagagccgcaaaaaatcgctgttccctgctaatgggtagcaagaggtgtgccagttttgaaggagtgcaggcccggtgcactgtgtgcgaccggtcctggaggagagggattagtgacgacgctggcgcagactcatcaccagcgcgccgaaaccggcgagcgcggtgaggatccacagcggccagttgccggtgcgggcataaggcgtaaggccacgtgccggcgtgacctctgccgtcagcacctgacgggtaaactgcgggatcatagcctgaatgtcgccctgcggaccaatcacggcggtaatgccattgttggtgctgcgcagcagcggacgtgccagctccagcgaacgcatacgcgccatctggaagtgctgccacgggccgatagatttaccgaaccaggcatcgttggaaatggtcagcaggaagtccgtatccggacggaagttgtcccgcacctgttcgccgagaatgatttcatagcagatggcgggcgtcagattaaacccgtgcgcatgcagctgcggctgcacgtaaggcccgcggctgaatgacgacatcggcaggtcaaagaacggcgccagcggacgcaggatcgactccagcggcacgaactcgccaaacggcaccagatggtttttgttgtagcgattggtggagtcataacgatacggactgtctttacccagcgtaatgatagtgttgtaggtatcgtagcgattctgctgattcagacgcgcatccacaatgccggtgataagcgttgtgtctctgtcacgcagctgcgcgtccagcgagcttaaaaagcgctgctggttgatttccagatccggaatggcggactccggccagatgatcagttgcgatttgcccatctcccgctcgctgttgctaaggtagatctccagcgtattcaccagctggttttcatcccatttcagcgactgcggaatatcgccctgcaccagcgacacctgcgtggctttttccggcagcaacgtataccactgaacatagcgcagcgggaagggcagcgcgaacagcaccacgcccgccgccagcggacgccagttgcgggtcgcgatagccagcgccagcaggccgctgactatcatcagaagggcgttgatcgcttccacgcccatcaccggcgccagccctttcagcgggccgtcgatctggctgtagccaaactgcaaccacgggaagccggtcagcacccagccgcgcaggaattccgtcagctgccagacgacaggcgcggcaatcgccacgcgcagccagttcgtcttcggccacaggcgggagaggatcccggcaaacagaccggtatagagcgacagataggcggccagcagtacgacgaggaaaatattgatcgggccgggcatgccgccgaactgcgcgatgctgacgtaaacccagttgatgccggaaccaaacagccccagcccccagaaataaccaatccaggcggcctgcagggggcggcggttgagggtcagcccctgcagccccatcagagacagcagcgcggcaggccagatatcataaggagaaaaagccagcgttccgctggctccgagtatcagcgccagcagcaggcgatagcgctggcgttccattaatggggcaaaaaccatttattcatccagtagtggttttattcgtccagttttggctggggagaatcatccggtattctgacgtgaacctgaataatacggcggctgtcggccatcgcaactttaaactggtaaccatcaatgtcgatggattcgccgcgcgcaggcaggtgcccgaacgcctgcattaccaggccgccgatggtatccacttcttcatcgctgaagttcgtaccgaaggtttcgttgaagtcttcaatggaggccagcgcgcgcaccgtccaggtatgacggctgagctggcggaattcgatatcctcttcttcatcgtattcgtcttcaatttcgccgacgatcaactcaagaatatcttcaatggtcaccagacctgaaacgccaccaaattcatcaatgacgatcgccatatggtaacgttgtgaacggaactctttcagcatgcggtcaacccgcttgctttccggtacaaccaccacctgacgtaacactttctccatgctaaaggcttcggcatcgctgcgcataaacggcagcagatctttggccatcagaatcccttcaatgtgatctctgtcttcgctgatcaccggaaaacgcgagtgggcagactcgatgataacgtcgagacattcatccagcgtttgattgcgtttgagggtgatcatttgcgagcgggggatcatgatgtcgcggacgcgctggtcggcaatatccattaccccttcgagcatgtcacgcgtatcttcgtcgataagatcgttctgcccggaatcacggattagcgccagtaattcatcgcggtttttaggttcaccgtggaaaagctggctcagtaagagggaaaaaaatccctttttgctgttaagtgtatcgttactgtgggaattgtcgtcgctcatggcgtcgtgtgggatctcatgttaatcaaaatgtcgcacgtcacgcgtaaactcagcgccagacggcatgaaaagcagccgcgccggtaaaccggcgcacagactactccttctcggcaatgtacggatcctcatagcccagagcaagcattatctctgtttcgatgccttccatttcttctgcttcgtcatcttcaatatgatcatatcccagcaggtgcaaactgccgtgaataaccatgtgcgcccagtgcgcgtccagcggtttcccctgttcgcgggcttcctgttccaccacctgacggcagataatcaaatcccccagcagcggcatttcaatccccggcggcgcttcaaacgggaacgacagcacgttggtggatttatctttaccgcggtaggtcagattcagttcatgactttcggcgtcgtccaccacgcggatggtaacttctgattcttcctgaaactgcgggatcaccgcattcagccagtcctggaactgggcttcagtcggcaggcctgcggtatcctcgcaggccagttgtaaatcgagtatcacagaactcatttttgctcctgctgctgggcttcgcgtttgcgctcggcggccagttcagctttacgtttttggtcggcctcttcccaggcctcgtaagcgttaacgatacgggcaaccaccgggtggcgcaccacgtcttcgctgtggaagaagttaaagctgatctcatccacctcggccagcacctcaatagcgtggcgcagaccggatttcaggttacgcggcaggtcaatctgcgtcacgtcaccggtgatcaccgctttcgagttaaagccgatacgcgtcaggaacattttcatctgttcgatggtggtgttctgactctcatccaggatgatgaacgcatcgtttaacgtacggccacgcatatacgccagcggtgccacttcgattacgttgcgctccatcagcttttcaactttctcaaagccgagcatctcgaacaacgcgtcatacagtgggcgcagataaggatccactttctggcttaaatcaccaggcaggaagccgagtttttcaccggcttccaccgccgggcgggtcagcagaatgcggcgcacgtcctgacgctctaaggcgtcgacggcggcagccacggcgagataggtcttaccggtaccggcaggccctacgccaaaggtgatgtcgtgatcgagaatgttggccacgtactgcgcctgattcggcgtacggggtttgatcaccccgcgcttggttttgatgtggatcgccttgccgtattccggcacgctttccgcactctgttccagcacgcgggcttctttgatcgccagatggatctgttcaggctcgatctcctgcgtctgaccgcgcatcggggcggtatcgacgtacaggctacgcagaatatcggcagccgcgttcacgctgatcgggcgaccggtcagtttgaagtggttatctcggcggttgatttcgatacccagacggcgctcaagctgtttcacgttgtcatcaaacgggccgcacaggcttaacagacgttcattatcggcgggttcaaggctgatttcgcgggtttctgtattcaaattaatcctcttatacctttaagcctgccagcaaaaggctgacgggcgtgatgtcatcattaccgaaagtatttacggcatggggaaaaggcgcaagcatggtattggatatgggggctggagggggcaaaacaaggcctgccagcgacggcaggccgcaatgattatggctggaaaagaccgacgccaagctcattttctttacgggtgcgggcgatcaccgactccggcgtttcgctgatgcgcaggcccatctcatcttccgtgcgtaccactacgccgcgcagggagttggtcagaacatccgtgatttccacgtcgacgaatttgccgatcatctccggcgtgccctcgaagttcaccacgcggttattttcagtacggccggaaagctccatcacgctcttacgggaggtgccttccaccagaatacgctgggtggtgcccagcatacggcggctccaggccattgcctgctgggtgatgcgctcctgcaaaatgtacagccgctgctttttgtcctcttccggcacatcgtccaccatatcggcggcaggcgtacccggacgggcggaaaagataaagctgtagctcatatcgaagtttacatcggcaatcagcttcatcgtctgctcgaaatcctgggtggtttcaccagggaagccgacgataaagtcagagcttatctgaatgtccggacgcgccgcgcgcagcttacggataatcgccttgtactccagcgccgtatgggtacggcccatcaggttaagcacgcgatcggaaccgctttgtaccggcaggtgcaggaagctcaccagctccggcgtatcgcggtagacttcaataatgtcatcggtaaattcgatgggatggctggtggtaaaacgcacgcggtcaataccgtcgatggcggccaccaggcgcagcagctcggcaaaggagccggtggtaccgtcatagttttcaccgcgccaggcgttgacgttctgccccagcaggttcacttcacgcacgccctgggcggccagctgggcgatttcaaacagaatatcatcgcacggacggctgacttcttcgccacgggtataaggcaccacgcagtaggtgcagtatttattgcagccttccatgatggagacaaaggcggtcgggccatcggcgcggggttccggcagacggtcgaatttttcaatttccgggaagctgatgtccaccaccgggctgcgattgccgcgcacggaattgatcatctccggcaggcggtgcagggtctgtggcccgaaaacgatgtcgacatagtgggcgcgctgacgaataagatcgccttcctgggacgccacacagccgccgacgccaatgatcaggtcaggatttttctcttttaataatttccagcgacctaactgatggaagactttttcctgcgccttttcgcgaatcgaacaggtgttaagcagcagcacatcggcttcttccgccacctcggtgagttgatacccgtgggtggcatccagcagatcggccatctttgatgaatcgtattcgttcatctgacagccccaggttttaatatggagtttttttgtcatcgacttgctctgttaatcgccaggaatgcaggccgcgtattgtaatgctttgacccggcgctgaccatagttcatgtcccgccccacgaaaatgaaaaatccggtaaacttaagggaattaaaaataaggaaaaaagaccatgatgaatcaaccaacggaagtggccgtggtcggcggcgggatggtcggcagcgcgctggcgctggggctggcgcagcacggttttcaggtaacggtgatcgagcagacgacgccgcccgtctttgatagcgcggccgcgccggatgtgcgcatatcggccatcagcgccgcctctgtctctctgctgcgcagtcttggcgtctgggattcgatcgagaatatgcgttgtcatccataccggcagctggaaacctgggagtgggaaagcgcgcacgtcctgtttgacgccgctgaactcaagctgccgctgctgggttacatggtggaaaacaacgtattgcaacgcgcactgtgggaagcgctggagcgccagccgaatatcaccctgcgcgcgcccgcctgtctgcgcgccatgcaccgcgaggccgatcatcatgcgctggaatttgtcgatggcgataccctgcgcgccaggctggtgattggcgctgacggggcgaattcacaggtacgccagtgggctggcatcggtatccacgcctggcagtacgaacaatcctgcatgttgatcaccgtgcagtgcgaaaatccgccgggcgacgccacctggcagcagttcacccctgacgggccacatgcttttctgccgctgtttgataactgggcctcgctggtctggtacgaccgcccggcacgcatccgccagctgaagtcgctcaatatgatgcagctgcagcgggagattgaaaaaaccttcccggcacggctggggaaagtcataccggtgcaggcgggcgctttcccgctgacccgccgtcatgcgcggcactatgtgcagccggggctggcgctggtgggcgatgcggcgcataccattcatccgctggcggggcagggcgtcaacctgggctaccgcgatgtggatgcgctgctggacgtgctggcagaggcgcgcagcgtcggcgagccctgggccagccacagcgttctgcaacgctaccagcgccgtcgcatggcggataacttcattatgcagagcggcatggatctgttctatgccggattcagcaataatctggggccgctacgggtggtgcgaaacctgggcctgatggcggcgcagcgcgcaggcgtgctgaaaacgaaggcgctgaaatatgcgttaggcttgtaagtttcagcccggcgacaggacgttgccggggacgtttatgaaaggacaaaaacaaaaaagcccgccgaagcgagcttttttgttttttatggctggggtacgaggattcgaacctcggaatgctggtatcagaaaccagagccttaccgcttggcgataccccaacagggtgttgctataaattggctggggtacgaggattcgaacctcggaatggtggaatcagaatccactgccttaccgcttggcgataccccaacaattttttactgctaaagcctctttaaaagacgcttccagaatatggtggctactacgggaatcgaacctgtgaccccagcattatgagtgctgtgctctaaccagctgagctaagtagccaaattttactgctttaccagccatcgactggctggggtacctggattcgaaccagggaatgccggtatcaaaaaccggtgccttaccgcttggcgataccccaacgactgacgtgttaatacacaggagtcgaagaaaagtggctggggtacctggattcgaaccagggaatgccggtatcaaaaaccggtgccttaccgcttggcgataccccatccgtgcaacgcttactgggaatggtgcgggaggcgagacttgaactcgcacaccttgcggcgccagaacctaaatctggtgcgtctaccaatttcgccactcccgcaaaaaaagatggtggctacgacgggattcgaacctgtgaccccatcattatgagtgatgtgctctaaccaactgagctacgtagccatctttttttcgcgttaccttatcggcgttgcggggcgcattatgcgtattgggtcgatgatggtcaacacctttttcatcgaaaattgccggattgtgactgtttggttgggttgtgaacagcctggcgcattattcagcaaccaaagcaaacaggccccgcagggcctgtaataataacacggacttatttgtaagcggactggtgaacgcccaccgcgcggcctgatggatcgttcatggttttgaaggcttcatcccattcaatggctttggccgacgaacaggccactgacggaccgccaggcacgcattctgcggcacttggcaccgggaacagctcttcaaaaatctcgcggtacaggtagccttcttttgacgacggcgtgttgtacgggaaacggtagcttgcggtggccagttgctgatcggtcacctgctgcgccgccacttctttcagcgagtcgatccagctgtagcctacaccatcagagaactgctctttctgacgccatgccacgctggccggtaaataggactcgaagcattcgcgcagcacatgtttttccatcttgccgttgccgcacattttatcctgcgggttgatacgcatcgccacatcgaggaattttttatccaggaagggtacacgcgcttccacgccccaggcggacatcgctttgttggcgcgggcgcagtcgaacatatgcagcgcctgcaatttacgcacagtttcttcgtgcagctctttggcatccggcgctttatggaaatagaggtagccgccgaacacttcgtcagacccttcgccggagagcaccattttaatgcccatcgctttgattttacgcgacatcaaatacatcggcgtcgaggcgcgaatggtagtcacatcataggtttcaatgtgatagatcacgtcgcggatcgcgtccagcccttcctgcacggtgaaatgaatttcatggtgcacggtgcccagatggttcgccacttcctgcgcggccttcagatccggcgaaccgacgaggcccacggcgaaggagtgcagctgcggccaccaggcttctgaacgctcctgatcttccacgcggcgcgcggcgtattttttggtgatagccgagatcaccgatgaatccaggccgccggagagcagcacgccgtaaggcacgtcagacatcaggtggcttttcaccgcctcttccagcgcattgcgcagctgttctttattggtgacgttgtctttcaccgcgtcatagtcgaaccagtcacgctggtagtagctgcggatctcaccatctttgctccacaggtagctgcctgccgggaactctttgatggtgcggcacaccggcaccagcgctttcatttctgaggcgataaacatgttgccgtgttcgtcgtagcccatatacagcgggataataccgatatggtcgcggccaatcaggtaagcgtctttttcgctgtcatagagggcgaaggcaaacatcccctgcaaatcgtcgaggaattccgggcctttttcctgatacagcgcgaggatcacttcgcagtcagagccggtctggaaggcataacgttcgctgtattcagcgcgcagcgcctgatggttgtagatttcaccgttaacggccagcgcatgggttttttgttcgttatacagcggctgggcaccggcgttgacgtcaacaatcgacagacgctcatgggcaaggatggctttatcgctggcatagacgccggaccagtccgggccgcggtggcgcatcagacgtgacagctccagtgcttttttgcgcagttcaaccgcgtcagttttaatatccagtacgccaaaaatcgaacacataaccttctccgttaaccctgtaatggtgcgttgtcttatcgcctgttaatgaaaatgccgcaaaggagcagggggcgcaagccttttagcgggtcggcaataaatagtgcaatgagcgttgtcgattcatgaaaattgcacaggagaagaccgcaataattaacggatcggtaattattgacgggttttattgaatggggtgatttacccgggaacgaaataatgcccggcagttcgcaggcccggcaagcatgcgccgccgggcaactgtgcatcagatcacgtcgatttcagcgacagacgggtaaatccagctcggacggaacggcatatcatcaatgtcatcaatctgcgagacgccggagagcaccagaatggtgtccagcccggcctggaaaccggccagaatatcggtgcgcagattatcgccgacgatcaccgtatgttcagagtgcgcctgcatggtgttcagcgccgcgcggatgatccacgggctgggcttgccgaccacgaacggcttgcggccagagattttctcaatgcccgcgcacagcgcgccgcaggccggatagaagccgcgaccgtgcgtatccgggttggtggcgataaagcgcgcgccgttggctacaaagaaggacgccttatgcatcatctcccagttgtaagagcgggtctccccgacaatcacaaaatcaggattgatatcggtgatagtaaatccggctttatacagctcatggatcagcgcgccttcgcccaccacgtaggctttttttccttcctgacgcttaagaaaatcagcggtcgccatggcggaggtgtaaaacacgctgtccggcacgtcaatgcccgccgaggcaaagcggttcgccagatcctggccggtttgtgacgggtaattggttaacaacaccagcggcatgcctttttccatcacccgcgtcaggaactcagcggcgcccggtacagcaacgttgtcatgcatcagcacgccgtcaatatcacaaattacattcttaatggtcatggactacccggataaaaaatgaaggcccgactatatgatcgcctcagctttccagcaaccgttgcagcagaatgccgttaagcatggcacgtttaaccagcgcaaaggcgccgatcgccgagcggtgatcgagggtcgagcgcaccaccggcaggtttttacggaacgcttttaacgcctgggtattaatgcagccttcaatggccggcagcagcactttttccgcctcaacgatctcaccggcaatcaccactttctgcggattaaacaggttaatggcgatggcgatggtttttccgagatgacggccaacatattcaaccacttcgcaggcgaggggatcgcctttgttggcggctttacagatggctttgatggagcagtcatccagcgtcacgcggctctgatagccctgttccagcagatgacgcacgcgctgttcgatagcggcgttggcggcgacggtttccaggcagccaaagttaccgcagtggcagcgctcccccagcggttccacctggatgtgcccgatctcgccgacattaccattacggccaataaaaattcgcccgttggagatgatccccgccccggtgccacggtgcacgcgcaccagaatggagtcttcacagtcctggcttgcgccaaaatagtgctccgccagcgccagactacgaatatcgtgaccgacaaaacaggtgacgttaaaacgtttttgcagcgcctccaccagcgcccagttttccacctgaatgtgcggcatatagcggatcacgccgctttccggatccaccagccccggcaggatcaccgagatggcgatcagttcgcggattttgcgctgacagctctctataaaggaagcgatggtattcagcaacgcatgttccagcgtttcctgggtgcgttccggcagcggataatgctcttctgccagcgttttgctgctcaaatcgtacagcgtaagggtggtgtcatgacggcccagacggacgccgatggcgtgaaaattgcgggtttcggtaacgatggaaatcgcccggcggcccccggtggaggcctgctggtcgacttctttgataagcccacgctcaatgagctggcgggtgattttggtgacgctggcgggcgcaagctggctgtgatcggcgatctgaatacgcgagataggcccgtgctggtcgatcaggcggtaaacggccgcactgttaagttgtttaacgaggtcaacgttaccaatttgagcttgtccgcctgatgtcattcttttacttacccggtgacgacctcgttaccattaacgatggtcttgattactttataatcgcgggtgaaggcggtcaggttggcgaccatccccggcgcgatactgcctaactgcttgtcaacgccaatggcgcgagccgggtagagcgtggccatgcgcagggcttcatccagcgcgatattcacatgctccaccagattcttaaccccctcgatcatcgtcagggcagaaccgctcagcgtgccgttttcgtcaacgcagagtccattccggtagtatattgttttaccagcaaaaatgaactgttcaatgtttgcgcctgccggggcagtggcatccgtcaccaggcaaagtttctcgcctttcagacgcttagcgagacgcacattactgtaatcaacatgtaaaccatcaacaataataccgcaataaatatctgcatcgtcgaggatagcacccgtcagacccggttcgcgtccggtgatgtacggcatggcgttgaataaatgcgtcgcaaagcgaatccctgcgcggaagcccgctttggcttctttcagggtcgcgttggaatgtccggcggataccacaataccggcggccgccagtttgctgatggtgtcgctgcccgccatttccggcgcgagagtgattttggtgatgacatcggcgttctggcagaggaaatccaccagcgcgggatccggcttacgcacgaattccgggttgtgcgtgcctttcttcaccatattcagccagggcccttccagatgcagacccagcgcctgatgcggatgcttcgccagatactcgcgcatcacgcgcacaccctgtttcatcagatcgtcgctggtggtgatcagcgtcggcaggtagctggtgcagcccgatttttcattcgcgcgctgcatgatttccagggtttcgatgctgacggcttccgcagtatcgttaaactgcacgccgccgcagccgttgagctgcacgtcaataaagccgggggccagtatggcgcctgccagtgaacgctgctcaatatcaggcggcagatccgccagcgggcagagacggtcgatcaggccattggcgacaataagcgcatggtcatccagaatttcatggccggtaaaaatccgacattgggttaaagcatacataacgacccccggtaaaaatggcgttccgtccttcacagatcgtagaggaaggacggaaacgtaattacagacctttaatattttcagcttctaattcgttgaaatatttcagcgttttaactttcagctccatggtggacggctcatcgcataccaccaccgctttcgggtgcagttgcagacagctgatggtccacatgtggttgacgttgccttccaccgccgcctgcagcgcctgtgctttcacgctgccgagcaccaggatcatcacttcttccgcatccagcagcgtacccacgcccacggtcagcgcatattttggcacctgatccacatcgccatcaaagaagcgggaattcgccacgcgggtatcgtgggtcagcgttttaatacgggtacgggaagccagtgaggacgccggttcgttgaacgcgatgtgcccatcgttgcccacgccgcccataaacaggtgaattttgccgtacgcgcggattttttcttcatactgacggcattctgcgtcaatatctggcgcattgccattcagcaggttgatattttctgcgggaatatcaacgtgatcaaaaaagttgcggtgcataaagctgtgatagctttccgggtgctctttcggcaggccgacatattcatccatattaaaggtgaccacgtgcttaaagctaacctggcccgttttatgcatttctaccagagctttatacgcggtgaggggagtgcccccggttggcagacccagcacgaacggacgatccgccgttggtttgaaggcattgatgcgattaacgatatgacgggcagcccattttccgacttgttcggcggttgccagggggatcagtctcatgtttcacctctacaatttagataaataaatggacgggttgggcattctgcctgctcttgtaagggtaacgcagtatagccgtcgagtggcaacaatccgtcttgattttttgaatcataaaataagttttgtttgttagccagcggaagggagggtaaataacgatatttggtgattttaatcacaaaaaaagggtgtttaatttgcggggcgaattaattttttacacactcattcagtaagtgaaaaatagcctttgcttcaggctggtcggactataaaaaaaactgcttgtgatgaagcctgacagggtttcatagggggaataaaagtgagtattttaggctatctgcaaaaggttggccgcgcgcttatggtgccggtcgccacgctgcctgccgcagcaattttaatgggtgtcggctactggattgaccccgtgggttggggtggtgataacgcactggcggcgttcttcattaaatccgggtcggccattatcgacaacatgtccgtactctttgccattggcgtggcgtatggcatgtcaaaagacaaagacggcgcggcggcgttaaccggctttgttggtttcctggtattaaccacgctctgctcgcccgctgcggtttccatgatccagaaaatccctctggaccaggtaccggcggcattcggcaaaatcagcaaccagtttgtgggcatcctggtgggtattatctccgctgagctgtacaaccgtttcagcagcgtagaactgccgaaggcgctctccttcttcagcggtcgccgtctggtgccgatcctcacttcctttgtgatgatcatcgtcgctttcattctgatgtacatctggccggtgatttttgatggcctggtgaacttcggtgaacagatccagaaactcggctccgtgggcgcgggcgtttacgccttctttaaccgcttgctgatcccggtgggtctgcaccacgccctgaactccgtgttctggttcgacgtggcgggcatcaacgacatccctaacttcctcggcggcgcacagtctatcgaagcaggtaaagcggttgtcggtatcaccggtcgttatcaggcgggcttcttcccgatcatgatgttcggtctgccgggggcagcgctggcgatttatcactgcgcgcgtccggagaacaaagcgaaagtgctgggtatcatgatggccggcgcctttgccgctttttttaccggcatcactgaaccgctggaattctccttcatgttcgtggcgccggtgctgtacgttattcacgccgtgctgaccggtatctctgtattcatcgccgccagcatgcagtggattgccggtttcggcttcagcgccggtctggtggatatggtgctctcgtcccgcaacccgctggccacgcactggtacatgctgatcctgcagggtctggtgttcttcgtgatctactatgtggtgttccgcttcacgatcaccaaattcaacctgatgaccccgggtcgtgaactggcggttgccggtgatgaatccgatggtcaggacgtgaatatcagcaccaatggtaaagatcaggacattaacggcctggcgcgtcagtacatcgcggcggtcggcggctctgccaacctgaccggtatcgatgcctgtatcacccgtctgcgtcttaacgtgaaagactcctcgcaggtcaacgaagcgctggcaaaacgcctcggcgcaaccggcgtgatccgtctgaacaaaaccagcgtgcagattatcgtcgggtttgtggcggaaaaaattgccaatgctatgaaaaccaccggcgatgttccggcagcgccggcaaccggtgccgctgccagcaccgcccctgctgctgccgcgccggttgccgcagcccaggccgtgccgaatgccgcgactatcgcgcagctggtatcgccggtaacgggtgaagtcgtggcgctggatcaggtgccggacgaagcctttgccagcaaagcggtgggcgacggtgtggcggtgaaaccaaccgataaactggtggtctctccggcggccggaaccattgtgaaaatcttcaacaccaaccatgcgttctgcctcgaaacggacaaaggcgctgagatcgtggtgcacatgggtattgataccgtggcgctgggcggtcagggctttacccgtctggtggaagagggcgcaacggtcacggctggtcagccggtgctggaaatggatctggactatctgaacgctaacgcgcgctccatgattagcccggtcgtgtgcagcaacatcgacgatttccgtggtctggtgatcaacgccgaaggtcatgtggtggcgggtcaaacgccgctgtttgaaatcaaaggctaatcacaccacgcagtgataaaggcggcgggatcatcccgccgcttttttttgcctgtcattcccgtaatcgcgctttttgtgcaacttaaaggttgtctcggcgtccggcttataagatcatatcccgttatacgttattgacgctttgaggaatccgcgatgagtgaggcagaagcccgcccgagtaactttatccgccagattattgatgaagatctggccagtggtaagcacagcaccgtgcacacccgttttccgccggagccgaacggttatctgcatatcggccacgcgaaatccatctgcctgaactttggcatcgcccaggattatcagggccagtgcaacctgcgtttcgatgacaccaacccggtaaaagaagacatcgaatacgtagactcgatcaaaaatgacgtgcagtggctcggttttcactggtccggcgacgtgcgctactcctctgattatttcgatcaactgcatcagtatgcggttgagctgatcaacaaaggccttgcctacgttgacgaactgacccccgatcagatccgcgaataccgcggcaccctgaccgcgccgggcaaaaacagcccgttccgcgatcgcagcgtggaagagaacctggcgctgttcgaaaaaatgcgtaccggcggcttcgcagaaggcaccgcctgcctgcgcgccaaaatcgacatggcctcgccgttcatcgtaatgcgcgatcccgtgctgtaccgtattaagtttgcggaacaccatcagaccggcaacaagtggtgcatctacccgatgtacgatttcacccactgcatcagcgatgcgctggaagggatcacccactcgctctgtacgctggagttccaggacaaccgccgtctgtacgactgggtgctggataacatcaccatcccggttcacccgcgtcagtacgagttctcgcgtctgaatctggaatacgccgtcatgtccaagcgtaagctgaacctgctggtcacggacaagcacgttgaaggctgggacgatccgcgtatgccgaccatctccggtctgcgtcgtcgcggctacaccgctgcggccattcgcgagttctgcaaacgtatcggcgtcaccaaacaggacaacaccattgaaatggcgtcgctggagtcctgcattcgtgaagatctgaacgaaaacgcgccgcgcgcgatggcggttatcgacccggttaaactggttatcgaaaactacccgcagaatgaaagcgaaatggtcactatgccgaaccatccgaacaaaccggaaatgggcagccgtgaggtgccgttcagcggtgaaatctggatcgatcgcgctgacttccgcgaagaagccaacaaacagtacaagcgcctggtgctgggtaaagaagtgcgtctgcgtaacgcctatgtgatcaaagccgagcgcgtggaaaaagacgcggaaggcaacatcaccaccatcttctgctcttacgatgcggagacgctgagtaaagatccggcggacggccgcaaggtgaaaggcgtgatccactgggtgagcgccgcccatgcgctgccggttgagatccgcctctacgatcgtctgttcagcgtgccgaacccgggcgcggccgaagatttcctcgccactctcaacccggaatcgctggtgatcaaacagggctttgcggagccaggtctgaaggccgcgcagccagaaaaagcgtaccagttcgagcgcgaaggctatttctgcctcgatggtcgccacagcaccgccgacaaaatggtgtttaaccgcaccgtaggtctgcgcgatacctgggcgaaagtcggcgagtaatcgcgtcaatctcaggctatcagaatgccggtcagtgaacgctgaccggcattttttatggccatgatcttctcactctcttccattcgcgctgcaaattaaactcagcgtttcctttccgagcgggcttattttccgtctgaacatcccccgtacagcgtaccgctcagccgcctgttgccagatgtaactttttatgtgcactgcgtcatagtctcatcttttccccggtaaattgtgttgataattcgcgacgcgaaaaataatctttatggcaccggaacggcgagtttatgactcataagcgacggttatatttaactttttttatttatcgcttctgcgcttgcaggcgaattttattatgtcaaagaggaaccattatgcgtacattcagtggcaaacgtagtacgctggcgctggctgttgccggcgtcaccgcaatgtcgggctgggggctatccgggcaggcgagcgccgccggatttattgacgactccacccttaccggcggcgtctattactggcagcgtgagcgcgaccggaaagacgttaacgaagacaaatacaaaaccaacctttcgcactccacctggaacgccaacctcgatttccagtcgggctatgccgccgatatgtttggtatcgacgttgcggcctttaccgccatcgaaatggcggaaaacggcgacagcggccacccgaacgaaatcgcgttctcctccagcaacaaagcctacgacgaagactggtccggcgataagagcggggtcagcctgtacaaagccgccgctaagtttaaatacggcccggtctgggcgcgggcgggctatattcagcccaccggacaaacgctgctggccccacactggagctttatgccgggcacctataaaggcgcggaagcgggcgctaacttcgactatggcgacgcgggcgcgctgagcttctcgtacatgtggaccaacgagtacaaagcgccctggcatctggagatggacgatttctaccagaacgatcagaaaaccaaagtggattatctgcactcgctgggcgcgaagtatgactttaaaaacgatctgctgctggaagccgccttcgggcaggctgaaggctatatcgatcagtatttcgcgaaagccagctacaagtttgatattgccggcagcccgctctccacctcataccagttctacggcacccgcgataaggtcagcgacggcagcgtcaacgatatctacgacagcaccgcctggctacaggcgctgaccttcggctataaaataggggatgtcgatctgcgtctcgaaggtacctgggtgaaagcggaagggcagcagggcttcttcctgcaacgtatgacgccaacctatgcttcatcgaatggtcgactggacgtgtggtgggataaccgttccgactttaacgccgacggtgaaaaagcggtgttcttcggtgcgatgtacgatctgaaaaacttcaatctgccgggctggcaggtgggcgcgtcttatgtttatgcctgggacgcgaaaccggcagagatggcgacgccggatgcatactacgatccgaattatcgcctgaaagagtcggcctacagcctggatgcggtttataccctgcaggacggtcgcgccaaaggcacgatgtttaagctgcacttcacccagtacgacaaccactccgacatccccagctacagcggtggctatggcaacattttccaggatgagcgtgacgtgaaatttatcgttatcgcgccattcaccattttctgaccccggcagttgccggatttcctcacccgctccgctgagcgggttttttttaaattttttttcccgccatttaatttttgctcccggtggtcgctttaccactacatctcgactgagacccataaaattcaaggagcaggaaaatgttatctattaataccaacgccgcctctatggccgctgtcaacgccatcaacaaaagcaatgcctctctgagccagtccatggaacgcctggccaccggtaaccgtatcaactcctctgcggatgatgcggcaggcaaacagattgctaaccgcctgactgcacagtctgacggcatggcggttgcccagcgcaacatcgccgatgcaactgcgatgctgcaaaccgctgacggcacctttgacgagatgaatgacattctgggtcgcatgaaagacctcgcaacacaagcagcgaacggaacctacagcgatgatgaccgtgcagccatgcagtccgagttcgacgaactgggtcaggaaatgtctgacatgatgcagaacaccacctacggcggcaccaacctgttcaacaaatccgccagcggtctgttcacccaggcatccggcgtgactttccaggtgggttctgaagccactgaccagatgaccgtcaacatctcttcccaggttgacgcgctgaccacgtccctgagcgccctgagcgcctcctttgcggatgacttcggtactgacggcgcaggcggcggcaccggcgtaagcggcactgaactgatgtcttctgcttctgcgaccgccgcgatcgacagcattcagaacgtgatgagcgcggttggcaaaatccagtccaccctgggtgcgtccatcaaccgtctgaacgacaccgcgaacaacctgcaaagcatgcaggacaacaccaacgtggcgatcggtaacatcatggataccgactacgcggcggaagcgtccaacatgtccaaagagcaggtgctgatgcagaccagcatcaccatgctgaaacagtccaacagcatgtccggcatggtttccagcctgctgcagtaatcggcctgacgtccagtcaaagcaccgccttcgggcggtgtttttttttgccgcccgctgccgcacagagggaaaaaaccttccgcgcgaagcggaaaacgcctttccgcctgtaattatcttattgattttaatgggtaaaattattggcatggcaattgctaattatgagccatgaaatctgaacggagcaaaaaatgattaacccgcagcagattgcgaaaaaattcgccctgatggatatctccaccaaggcatcgtcgctggcgcgccagcaaaacgacatcgatacccagaccagcgcgctggagagtctggacagcgccctgaccgccttccagagcgcggtggatgcgctgaacagcgagacgggcggcccggtggttaacaccgttaccgccaacaacgactcggcgaccattaccgccgactccaccgccgcggaaggctcttacaccttcttcgttgaccagctggccaccgcgcagcagtccacgctggcctttgccgacggcgatattccgaatagcggcactttcaccatcaccatgggtgacagtgaaatggacatcgatctcagcacggtcgattccagtggcgatggcagcgtatcggtggcagagctggcggatgccattaacgattcgccggacaatccgggcgtcaccgccaccatcgtcaacaccgatggcagcaccaccctgatgcttaccgccgatgaaaccggggcggaaaacgcctttaccgtctccgccagcggcgtcgatccggcgtcggcgttcgccaccgacatcagcaaccagaaagatctggcggtggcgcaggactcggtggtgtatctcggcagctcgccggaaaccggcgtgatgatcaccagcagcagcaacacctacaccgatcttattcccggcgtcagcatcaccttcgccgaagaatccgccgagggtgaacccctgactttcaacgtcaaaaacgattccggcgcctcgcaggaaaaggtgcagacctttgtcgatgcctataacacgctggtggataccctggacgcgctgaccaccaacggcggcggcaccggatcggccgggccgctggcgggggacgcggggatctcctcgctggagcgccagatcgaggacattacccacgccagctataacggcgtgtccatcgtcgactacggcatcacgctggatcctgacgggcacctgcaaatcgacagcgaaaaattcgacgaggcaatggaagaaaacccggacggtctgaccgcgctctttgtcggcccggacagcatgaccgcccagctcgacagcctgatggagacctggcttgacgacaccgacggcatcatctcgcagcggcagagcaacctcgacgacaaacaggaaaaagtcaccaacagcgtggatgacctgaagacccgttacaacacctcttacgaacgctatctggaggagttcacctccacgctggttgaaattgaaagcatgaaaatgagcatggcggcattcatgtaagtcgccgtccgaaaaggtcaaaacaacgatgtacgcttcagataatggttacacccaatacaaagagatggatctggccgcccgcaccgcgtcagcttcgccgctggatctggtgctggtgctctacgccgggctgatggacgagctggaacgggcaaagagccatatcgaaaacaaacgctacgagcgcaaagcgcaaagcatcaacaaatgcatcgacattctcaatgccctgaccagctcgctggagtttgaaaacggcggcgacctggtgctcaacctcgcgcggctttatgaccactgcgtctaccgcctgtatgaagccagcggccagatgtcgacggcgaaagtcgacgaagtggtgctgatcctttctaacctgcgcgaaggctgggaaggcctggcgcaaaaactgggctgatctatgacaagcaacgcactacgcctgcaaatagagagtctgctggacgcgatgaacgagagcctcgacaaacagcgctggcggcgcctgcccgcgctgcgccagcggctgatgatgctgtttgcgcagtaccgcgacgccgcgccttcccctgacgaactggcgcaggtgaaatcccgcctgcgcgacggcttcgcgcagataatcgcccgccgcgaggcgcgtgccgctcagcttgcggcgcggatggaaaagcaccgtcagcagcaggaggggcggctggcctattcgatggtcaatctggtggcggagcaaaaatcatgaaaaccctgtcattactttccgaagccatggggcaactgctttccgcgctccctgtgaagccgcaaggggagggcagcgcggcgggcttttcgctgcctgacgatcatcatcgcaagcacgctgaaaagccgcatccggcggagaaaatcattgccgatccgcgggaacagctggatctgctgctggcgcacttcctgacgccctctgccacagatcccaggcccgacgccgctgcgccgctgatgcagatggccgcccgcgcgggagagcagagcaaaaccgacgcgcagccgatgatcgatccgctcgccagtctgctgaccgactcgccaaaactccaggcggtgatggcgacgctgcttgctgcgcaaccgctcaccggcgacaccctgcagcagcaggccacgctggcgcgcagcgcggcggaaaatttgcaggctatcgcgccgcgccagacggctgcgccgcaggccgacgcgaagccccgcgtcatgcgcagcgctccccgcgtggagactgccgcgccgccgcgccacgacaagctcacgccgtccgtactggcgagcaccacctttacccgtgaaatgcgtccgccgcaggaattcgatgcgcggacgcagccgctgaacctgtcaaccgacagcgcggagtggggcgataagctcaccagcctgctgaaagatcgcatccactttcagatcggtcagcagcagcaaagctccaccattcgtctggatccgccgtcgctcggcaagattgagatcgccatacatatggaggcgggcaagctggtggtgcacatcggcgccagccaggcggatgtctgccgctcgctgcaacagctcagcgacaacctgcgccagcagctcaccgggcagaactttgtcggcgttgaggtgcacgtctcgcaggatgggcagtcgcaacagcagcaggaaagacagtcacagcagcagtcggcgcagatccgctctgccgtcgaactggaagaagaagatacccccacccgacagaatgattctgtcctgatcaaagtgtagaggcccatgaaaaaaacgcttatggtcggcatgtttgccgccactctcgcgatcctcgtcggcggcggcgctgccgtcggcgcgatttattatatgaaagaccaggccccccaggcgtcaggtgacgcggcggctgccagcgcaacgaaactgaaagcgaaaaaagagggtgatgacgtctttgtcaccctgccggaatcgctgatcacgctgcacgataatagcggcaacgatcgttatatgttgctggaagtggcgatggtggccgacgatgaaaaagcctcgaaaaaaatcctcgccgacgagccgttatatcagagcatcattgtgtccaccttatcggatatggaatacgacgaggtgcgtaaattaaaagtcagtgaaataaaacaaaccctgctcaccgccctgaaaacgcagttaaaagcccgggatatttccgcgccctacagcgatgtcttactgaaaaaagtcgtttatcagtgatcgccggaaaataacggaaataacaccatgacacttgcctgggaaatgcaggacttccagaccctgccttcattaacgcccgcggaggagagccactatttacaggcttacctgccgctggtgcgcaaagtggttcgccagctcgcgccgcaatgcagcgcggtgatggaccggcaggatatggaacagatcgcgctgatgggcctgctggaagcgatccggcgctacggcgcgccggatacgggatttggcggctacgcggtgcagcgcatacgcggcgcggtgctggatgaactgcgcagtctggactggcgtccgcgctcgctgcgacaaaaattccatcaggtcaatgacgccatccgcgcggtgcgtaaaaccctcgggcgcgaacctgaggcgcatgagctggcggctgaaggcatcacggcggaggattaccgggaatacctgagtctggaaggggcgggcagcctcgcaagcctggatgaattgctggatgccgatcagagcgccgtaccgctggaaagccgtcggctggaagagcaggtgatcacccagcatatgctcggtaaagcgctcggcagccttagcgaaaaagagcagcagatcctgtttctttattaccagcaggatatgaattttaaagagatcgccttagtgctcgggctgacggaagcgcgcatttgccagttgaataaaaagatcgcgcaaaaacttaaagattatttcgccacacattaattcttctttacgtaataagagcctgccgcgcaggttcgcagaggtgttatgcaaaagttatttggtttactcattgtcttaggttgcgtatttggcggttatttcgaagcgggcgggcagttaattgctatctggcagcccgcggaaatcgtcattattttaggggccggttttggcgccatgatcatcggtaatccgctgcacgtcttaaaagagatcgtccatcagattaagggcgtgatcagcaaaaaaaatatgggcgcggaatttcagcgccagctgctgatgtgcctgtatgaactgctggaagcggtacagaccggcggcctgcgcaccctcgatcagcatatcgaacagccggacgagagcactatttttcaaaaattcccgctggtgcttaagcaaaaacggctggtgatgtttatcgccgataacttccgcctgatggcgatgggtaaaatcgacgcccacgagctggaaaacattctcgaccaggaactggtgaccattgaaggcgagctgatggcgccgtcccgctccctgcaacgtaccgcagaggccatgccaggcttcggcatctgcgcggcggtactcggcattatcatcaccatgcagtccattgacggctccattgcgctgatcggcctgaaagtggcggcggcgctggtggggactttcctcggcgtgttcttctgctactgctttatggatccgctggcaaacgccatggagcagcaggcgcgcgccgaacactcgctgctggaatgcgtgcgtaccgtgctggtggcgcaggcgggcggcaaaccgaccctgctggcggtggatgccggccgtaaattgctgcacctggcgtcaaaaccgacgttcgccaatctggatgcgtgggtgaacgccatgctggagcaggaggagtaatgcgccctgccaaccgccgcaaccgtggcacgcaaaccaccatcatccgccgtcagatcaaaaagagtcacgccggacaccacggcggcgcatggaaagtggcctttgccgactttacgctggcgatgatggcgctgtttatgacgctgtggatcgtcaacagcgtcagccagaccgatcgcgaaaatatcgtcgccgcgctgcacggccactccatttttagcggcaatggtatttcgccgttaagcagcctggcgaagaaaatcaacagcaaacccattccgcatccgggcgagaacaaaaatgccgccattgataaagagagcgaagaaaaagcgcgggaaaccagcaaaaagatggcggagatgaagcaaaaatccgccagcgaactgggcgagctggcgaacagcatcaatgagatcgccctgaaggcgcacatggagagcaacctggagatggagatcgtcccccaggggctgcgcattctgatcaaggacaaccagaaccgcaatatgtttgagcgcggcagcgcgaagatcatgccgttcttccgcgtactgctcagcgagctgacgccggtgtttgactcgctggataacaaaatcattatcaccggccataccgacgccatgccctataaaggcgatgcccggcagtataacaactggaatctttccggcgatcgggcgctgtcggcacgacgggtgatggagcaggcgggtatgccctcaggtaaagtgatgcaggtcagcgccatggcggatcagatgctgcttaacgcggcagatcctgccggggccgataaccgccgcatcgaaatcatggtgctgacccactccgccgccgacaccctgtaccagttctttggctcgcagggggagaaggtggtgaaaccgctggcggcgaagcttgaccagcaactccccaaagatccctgagttatcaccttaaacgcttatgttcgcattcagagtaaaaaccctcgtgctgctgacgacgcttgtcgccagcggtaacgccttttccgcccctcacgcgccgccggtgaagaaaactctcagctatgccgcgcgccagcgccagcataaccgcgaactgttacgcacaaggcagcaactgaaaatcgcccataccacgccggtggtgcggggtaatgcgcaggcaaaagcggccctgcgcgcgcaaaaccgccgcaggctggagcagcatccggaatggtttaccccgatgcgcgcccatttgcaggacggcaccggactggtgagcaacagctacctgctgcacgtgaccgataccatcatcaaccgtctgcaacagcagctgggcaagccttatgtctggggcggcgagacgccggaggagggattcgactgtagcgggctggtctattacgcctataacagcatgctggcgaccagactgccgcgcaccgccgatcagatgtaccacttcccgcaggcgcgaaatatcgccgaccgggatttacaacgcggcgatttactctttttccgcattcacagcgatcataaagcggatcatatgggcgtctatctgggggacgggcgctttattgaatcgccgcgtaccggggagcggatccgcatcagcgatctcaataccgaatactggcagcggcattttctgggcgggcgtcgggtgattatgaataacaccgtgcgctgatcaattaaacgtcgacaaggggaagcagacagacgaagaacagtaagatgaggataatcaccaccacgtcgaccagacttaccacgccgcccgcggcggcctgcgccgcttcttccgcacgggctttttcccgcaggcgtttcacttcctgctcgcggacaaattcttccatcgatttatagtatcgatcggtcggaatgcggtgcgggtccttatttttctctgacattatcctcatccctggatgatattactgagatccttttccctggattgtctcagatttaccttcagggccatagcgatggcccgattaatgataacgaattgataattaattcaggtggccgaggatagtcagttccagctcatccggcacttcgttataggaaagcacatgcagtcccggcgcgaacagtcgggcgtagcgggccagcaacggtcgcagttgcggcgcgaccagcagcaccggctcttttccggcggctttcatctgctcctgcacctgcggcatattttcctggaactgggtgagcatattcggctcaacaggcacgctgtccagcatcaccttgccgccctgttgcgcctgattgaccacgttttgcagcagattttccagttcaccggcgagggtatagaccgccagcgccccattacgcaccaggttatgggtaatactgcgccgcagcgccagacgcacatcggccaccagtaaaatcggatctttcgacaccgcgccgctcgccaccagcacggtggcaatggtgacaatatcccgcagcgacacgcgctccatcagcaggctgcgatagaccttcagcaactggctgtaattcagcacgccgctgagatcttccgccagcttcggggcctgcgccgccagccggttatgcaactgggtgacatcgtcatagttaaacagatcgggaatatggctcagcagcactttattaaggtgggtggcgatcacgctggcgctgtcgattacctgataccccagattcagcgccttcgctttttgcgccggggtgatccaggtgaccggcataccgtaggccggatcgttacccagcacgccgtcgatttcgccataagtttcgccggagggcagggccatcaggcggtcggcgacaatatcgccgccgtcggctttaatatcgttaatgtaaatggcgtactgggtgggcttgaggcgaaagttttcacgcacgcggatctccggcagcagtatgccgttgctctcggagatcacctgccgcacgccgcgaatgcgctgcgtcagcgggctgcctttgcttttatccaccagcgacaccagcttatagccaaggctgatactcaccggctcaatggtggggatggtctcccagctcacctgctgctccggcgcttccgtcagggttttactgagcgtggtaaggctttgtacttcggcttctgaggctttgggctgcttgctctgacgccaggcggcgaaggccagcagcgctgaaaacgccaggaagggcaggtgcggcatccccggcacgatggcgagaataaacatcacgccgctggcagtgtaaatcaccgatggggtggccagcagctgctttttgatctcgcctgcgatctcgccgctgtcgctgacgcgggtgacgatgatcgccgccgccgtcgataacagcagcgacgggatctgtgccaccaggccgtcaccgatggtcatcagcacgtactgagagaaggccgcgtcagcgcttaaattgtatttaaagatgccgatgcacacgccaccgatcaggttgatggcgaggatcatcatcccggcaatggcgtcgccgcgcacaaacttcgaggccccgtccatcgcaccatagaaatccgcttcgctggtcacctctttacggcaggcctgcgcctgcgcctgattgataagaccagcgttcagatcggcatcaatcgccatctgtttaccgggcatggcgtcgagggtaaagcgcgcggacacttcagaaatacgctctgcgcctttggtgacgacgataaagttgatgatcatcagaataatgaacaccacaaaaccgaccacaaagttaccgccgatcaccacctgaccaaacgactcgatcaccttaccggctgcgcctatcccttcatgaccgaacagcagcaccacgcgggtggaggcgacgttcagcgtcaggcgcatcagggtggtgatcagcaataccgttgggaacaggctgaactccagcgggcgttttgtcgagacgctcaccagcagcaccagcaccgccagcacgatgttaaaggtgaaaagaatatccagcagcatcggcggcagcggcaaaatcaccatcgccagaatagacaacagcaccagcggcacgccgagatgcccggcccgcacggtcgtcagaagttgcttaatgtttttctgcatcctgtttcagaacctctttagggatggaaatatgtcggttaagttgcggcttgtcctgcattccggcgcgccaggatttaagttgcaggacataggtcagcacgtgggcgatggcgcggaaaagctgatgagggatctgctgattaagctgcgtggtgaagtacaccgagcgcgccagggtggggaattcgacgatctcaatcttgtgctcctgcgccacctcgcgaataaagcgcgcgatgtcgtcggtgcctttcgccaccacaaagggagcggcggcgcgggtggtgtcatatttcagcgccacggcgtaatgggtcgggttggtgatcaccacgtctgccgcgggcaccgtacggcggatctgccccatggcgatctggcgctgcatgcggcgcactttggctttgatctccggattcccttcctggtttttgtactcctctttcacttcctgtttggtcatcttcagcccgcgggtaaacaaatgtttcgccagcggaatatccagcaccgcaaagagcacgaacagcatcaccatgttctgcatcacgctggcgtataacgacagcccgtggtgcacggcgctggcaaaatgctgtgattgcagcgccataaaggcggcaaaattgtggcgcacgctgaaccacagcagcgccagcactaccaggcttttcagcaccatcttgccggtttcaatcaggtgatctttggaaaacagccgcccgacgcctttgatcgggttgatcttattgaggtccggtaagatctttttcggcacgaacagccagccgccgggcaccagcgacgccgccagcgccgccagcggcatcggcgtcagggtcagaatgaacttcatcaggatcagcaggttatgctgcaaaaactgccccagtacatccggattgttgatctcctgcgcgtactgatggacggtaataaagccttcgcgcacaaaatcgcagtaccagggaaagctgttcaacagcacgatgaacgccgccagcagactggccgccagccccatatctttggagcgcggcaactgcccgtcctgtcgcgccttacggcgtttctgcgccgagggcttttctgttttttcatcctgcgaggcgtcagccatggggcactctcagggcgtcaaactggcttaaaacaaaattcgccagatgcagatagtgatccggcagggtgtagagcagtgcggcaaagcacaccagtcccgccagcatgttgatgggaaaaccgagggagtacaggttcagcgccggggacacgcggttgagcaggccaaacccgccctgtactaccagcatgataaaggtggtcggcagcgccagcagggtggcggaggcaaacacccagcccaggcccagcgccacgctgcgcagggtctgcggcgtcagggcgttgccaatcggccagtagagaaagcctttataaagaatgctgaccagcagcagatgcccgtccatagcgaaaaacaggatcgcggcatagatatagataaactccgccagcacggtggtggacgcgccgctgttgggatcgttcatcaccgccatgctcatccccatattaaaggagaggatctgcccgccaagctgcagcgccagaaagacaaactgcatcatcaggccgaacagcaggccccagaggatctgctccaccgtcaggatcagcatcgacatcgtcagcaacccctccggcaccggatgcggcaccagcggggtgatcatcaccgccagcgccagggagatcacaatgcggatgcgcacgctgaaggctttgctgtcgaacaccgggccatagtggaaaaaggccataatgcgcacaaagggataccacagccccagtaccaggttcatcagttgcgtgatagtgagcgtggtcatctcagttcaccagcagcgcggcctgggcaaacaggtgggtacagagatcgcttaactgcacgatcatccatttaccgcagacgccgagtacgatcagcgtgacaatcaggcgcggcagaaagctcagcgtctgctcgttgatctgcgtgaccgcctggaaaatacttacgcacagcccgaccagcaggctcggcaccaccagcaccgaaaccagaacgatcaccaccttaataccgctggcgacgagatccgccgccacatcaacagttatcatgatcagcccagccccagtccgcgaatactgctggtgagcgtgcctacggtcagcgcccagccgtcaatcagcacaaacagcatcagcttaaagggcagggagacgatcagcggcgacagcatcatcatgcccatcgccatcagcacgctggcgacgatgagatcgatgaccaggaaggggatgtaaatcataaagccgatctggaaagcggttttcagctcgctcagcacgaaggcaggcaccacaatcgacagatcctgatccgccgcttcacccttcgcgccgccgatggtcatgatctgcgccatcgcctttttattggtctgcgccagcataaagcgcttgaggggcgaggcggcggtggagagcgcctgcggcagggtgatctggtcgttttcaaagggcaccaccgcatgatcgtaaatattcagccataccgggcgcatcaccagcagcgtcagggacagcgcgatgccgatgagaatacggttcggcggcgtctgttgcaggcccagcgcctggcgaagcagcgacagcacgataataaagcgcgtaaagcaggtcatcatcaacagcagggtcggcagcagcccgaccagcgtcatcaggatcagcacctgcatcttgacggtcatatcctgggtcgcgccgtgcgtcgccacctgcaacagcgtgatgtcgcccccctgcgcgaagacggccggagagagcagcagcacgctgccggaaagccagatcagtgagcgtttcatggcgtcagttcgttgatgtcccgggtattaaactccagcacccgcagaccatatttctcgttgaccaccaccacttccgcttttcccagcagaatattgttcactttgatgtccagcggctcgcccgccagcttgttcagctcaataacggtgtcatcatcaatgttcagtagatccgccagcatcacctcgacagaggacacttccagcgtcagggtgacggggatgcgtttcagcaggcccatggaatcggtgagcggcgcggcgggcgcggcaggggcggcaggggcggcttcaccggcgtcgtcagccagctcgaagccctgttcaagtaaatcgatctcgttagtcataggattttccggcgagggtttcgcgaatgtcagatagcagaagcttgtcgtgatcttcgacaatcagcgccttaaacagctctgactggccgatgaacacagggaatttgtcaggtaaagctaccgggaaaatatcgccggctttgatggtcgtcagatccgcgacgctgagggttaaatccgccacccgcacattcaggcacagcggcagggtatcgatcacctggcgcaccagcgctttttgcgccgcctgccgttcggcatgggtgtcggtgtgctgcggtttttcggttttgcgcagcatattgaggatgtaatcggtgtgcgcgttatccagcagcagataaaagttgcgcttgccgtcgtcgtccagctggaaggtgatttgccacgcccactggctgcaaatattgctgttatcggctttgatggccagcggcagcccgagggcgtcctcgctgaacagcatctggcagatatccagcgccagccggttgcgcaggcggatctccgttttggtcggcagccgctcgccgctggcggcgttttccagctgcgtctccaggccataaaaattattcagcagggtgagcagcagcgggcgatcgatatcaaaggccagattacccaccggcgaggccagcaggtccgcctgtttatttctgacatccattttgcagccgatttttttcaggctgacgctggagcggtgttttttcaggaaatagctaccgatacgcgactcaataatgtcaaagcggcgggtgaacatattcggcaggcgatgccagggacgaccgagacggtttccctccagcgtgaatattccacgggtttggctgtacttcaacattggtgttatatctcttggtgaataccggcgcacagaaaaactgtttatgagaacaagctcacattctgataattaaaacagtctgacctttaattttctctttatgattgtcgcctgtacttatcaggccgtacataaaagagaagtcgcatttaaccggaatgaggtaaaaatcacaatagcgcctgcggtcaatattattattaatctgttattaatcagggtggcttattattgctgcgcctttgttatgcctgttgctctgctgttttattaattaattggttgatttttaagcattaattattttttgatttattaatttccgctgtttccttccgcttaatgatattgttctctcgtgatttatattccacccgctatcacctttatacataactgtgagagaaaaaatgccgactcttattgctgaagcctccgccagcaggaaagctttttcattagcaaaacgcgttgccagttttaatatcccggtattaatccagggcgaaactggcgcaggtaaagagtgcgtggcgaaatatattcacgctcatgcctttggcgaagataaagacgcgccctttattggcattaactgcgccgccatcccggaaaccatgctcgaatcgacgttattcggctatgaaaaaggcgcttttaccggcgcggttaatgccgtgccgggcaaactggaaatggccaataacggcacgttgctgttagatgaaattggcgatatgccgctggcgttgcaggccaaactcttgcgcgtattacaggagcatcaggtggaacgcctgggcagcaatcgcgccatcaaactcaatttccggctgatcgcctgcaccaataaaagcctcgaagcggaagtggccgccgggcgttttcgcgaagatctgttttaccgcatttcggtggtgccgatcagcgtgcccgccttacgtgaacgggtgggcgacattctgccgctggcgcaggcctttatcgaaaaatattcccgcatggtgggcaaatccatccgcctgtccgaaggggcgaaaaccgccctcttgcagtaccgctggccgggtaacgtgcgccagctggaaaacaccattcagcgcgggatgattttaagccaggacggggtgatccacgccagcacgctgggcattccgctggcgcaggaccacgggcaggcgccggcgcgcaacctcagcgacgtcctttgcctgaatcaggacaacctgcaacagcatggccgtcacgcgcaatatcagtacatcgccgatctgatgcgccagtatcagggcaaccgcagcaaaatcgctgacttcctcggcattacccccagggcattgcgttaccggctggcctcaatgcgtaagcagggcatcgacctctgcttttaactgccgctatccatccctatttatcaacaagagtatgcaatgaatacgatcacccgcctcaccccgaacgccccgccgctccatatgatgcaggagatgaaccggatgcaggatcttgcgaatggcgttcccgttgccgcaggcgagatgcggccgggcagcgaagtttccttccatcagattttcagccaggccctatcccgcgtggacggcctgcaacaggacgccgaaatgcagcagaacgcggtggaaatgggcgacagcgacgatctggtcggcgcgatgatcgccagccagcaggcggcgctctctttttccgcgctggtgcaggtacgcaataaagtggcgagcggcgttaacgatctgatgaacatgtccgtataagcccatgaaactctcactctctgaacgcttttccgccccgttgtccgcccttacgacgctgatgggcggcaataaaaaatggccgctgcttggcggcgcggcggtactgctgaccgcggtgatcgtcggcagcctgtggcacagccaggcgggttataccgcgctgtacggcgcgcaggaacatctgccgctgtcgcagatcatcacggtgctcgacggcgaaaaagtggattaccgcattgatcccggttccggacaaattctggtgccggaaacccagctctctaagatccgcatgacgctggccgggaagggcgtgcaggcgctgagtcccaccggctatgagctgatggacaaagacgaagtgctgggcagcagccagtttgtacagaacatccgctacaagcgcagcctcgaaggggaaatggcgcagagcatcatgaccctcgacgcggtggaaaccgcccgcgtccatctggcgcttaacgaaagcagctcgttcgtggtcagcgccgaaccgcaaaatagcgcctcggtggtgctgcgtctgcattatggcagcacgctgacccctgagcaggtgaacgctattctgcatctggtgagcggcagcgtgccgggactgaaaacctcgcaggtgagcgtagtggatcaggcgggaaatctgctgtcggaagaggtcggcgaagactcgcgcaccggcgccatgacgcgcaaaaacaacgaactgctgaaaaatattcaggataaaacccacgccagcctcgccaatgtgctgacctcgctggtgggtaaagacaacttccgcatcagcgtgatgccggagctggacctgagcgccattgatgaaacccaggagcggctgggggatgcgccgaaagtcagccacgaacggctggaatccgacaagactatcgatccgcaggcggcgggtattcccggttcgctgagcaaccgcccgccgctggctgaaccccggaccgacagcgcaaaaaatgacagcgcccgttccgagcgcagcgaaagcgatcgcgattacggctgggatcgcaccatccagcacattcagcatccgggctttgccattaaacatctcaatgtggcggtggtgctcaaccagagcgccgccagcatcaaaagctggacgccggaacagatagcccaggtcaccaccatgctgaataacgccgccggtatcgatccggcgcgcggggacaaactctcgctgtcgatgctgagctttatcccccaggccgcgccggtcatcacgccggaaaaatggtggcagaacgacagcattctcggctgggcgaagctcggcggtctgatactgctcggcctgttactgctgctgatggtagtgcgcccgctggtgcgtcagaccatcgccagccagaaacgccgtgcggaactggcggcgcgcccggtcaacgaaccggacgacgccacgctgcccgcgatcgccgccaccggcgaagacgagcgcaaaagtatcgagctgccgacgtttagcggggatgacgccttaccggcgcagagttccggcctggaaattaagctggagttcctccagaaactggcgatcagcgataccgatcgcgttgccgaagtgatcagacaatggattaccagtaatgagcgaattgacaataaataagcccggcagcgcgggcagctatctggagcaggcggcgattttgctgctgtgcctcggtgaagaagccgccgccaccgtgatgcaaaaactcagccgcgaagaagtggtgcgtttaagtgaaaacatggcgcgtctgtccggcgtaaaaaccagccacgcccggcgggtgatcaacaactttttcgacgaattccgcgagcagagcggcatcaacggcgcgtcccgcagcctgttgcagggcattcttaataaagcgctggggggcgaaatcgccagcagcgtcattaacggtatttacggcgatgagatccgctcgcggatggcgcgcctgcaatgggtggagccgcgccagctggcggcgctgatcgccgaagaacatctgcaattgcaggcggtattcctcgcctttctgacgccggaaatcgccgccaccgtgctggcctttatgcctgacgcggtgcagaacgagatcctttaccgcatcgcccgcttaagcgacgtgaaccgtgacgtggtggacgagctggatcggctgatcgagcgcgggttgtcggtgctggcggagcacggctcgaaggtgaaaggcatcaagcaggccgccgacatcgtcaaccgtattcagggcaaccagcagcagatcctcgaacagcttcgcgatctggatgaggaggtgctggagcagttgcaggatgagatgtacgacttctttatcctcagtcgccagagcgaagaggtgcgccgtcgcctgctggatgagatcccgatggaagactgggcggtggcgctcaagggcaccgaagcggcgctgcggcgttcgattttcgccgtcatgcccaaacgccaggcgcagcagctggaaaccatcacctcccgcctcgggccggttccggtcagccgtatcgatcaggtacgccgtgagatcatggcggtggcgcgggaaatggaagaagcgggcgacattcagcttcagctgtttgccgaacagaccgcagaataggagacacgccaatggatacgcttcgcggccgctaccgggtataccgtttcccgccgcgccacaccatttctgccactgcgcccgccgccgcagggctttctgcggctgactttcagcgtcagttgatggacggctttcaggaagggctgcaaaaaggctttgcccagggcctcagcgaaggccaggcgcagggacatgcagaagggctgcaacagggtcaggaagaaggctatcgtcagggtttcgcggagggcagtctcgccggtcagcaggaagggcggagccagtttaatcaggccgccgcgccgctggaggcaattgccgcccgcctgaacgactatctggcgcactgcgaacgcaaacaacgggacgacctgctgcaactggtggaaaaagtcacccgccaggtgatccgctgtgaactggcgctgcaaccgacgcaactgctggcgctggtggaggaggcgatcaccgcgctgcccgccgtgccggagtcgctacaggtttatttaagcagcgaggagttcgcccgcattcagagcgtcgccccggcgaaagtgaaagagtgggggctggccccctccgccgatctccagccgggagagtgccgcgtggtgacgcccacctccgaactggacgtcggctgtgaacaccgcctcgaacagtgcatgagcgtgttaaccgacacgctggtgccggatgcgccggatgcgtgacgatccgctgtttgacagcgccctgcgctccattgaatccatttctttcgcccgcgtcgccggacggctggtgcgcatgaacggcctgctgctggagagcgttggctgcccgctggccaccgggcaactctgtcgggtggaaagcgctaatcgcgagctgatcgaggctcaggccgtcggctttaaccgcgatatcacctatctgatgccctttaaaacgccctccgggctgatggccggggcgcgcgttttccccgaagagaaagcgcaggagatcctgatcggcgaaagctggctcggcagggtggtgaatgggctgggcgagccgattgatggcaaaggcaaaaccggcggcagccatctgttagcgccgctcgcgcccgccatcaaccctctgacgcgccagccggtggcggaaccgctggatgtgggcgtgaaagccatcaacggtatgctgaccatcggcaaaggccagcgcgtcggcctgatggcaggcagcggcgtcggcaaaagcgtgctgctcggcatgatcacccgtcagacgcgggcgcagatcgtggtggtcgggcttatcggcgagcgtggacgcgaagttaacgagtttatcgaacactcgctgggcgacgagggcctggcaaaatccatcgtggtggcggcgcctgcggatgcctcgccgctgatgcgcctcaaggccaccgaactgtgccacgccatcgccgcgttttttcgcgaccagggttatgacgtgctgctgctggtggattcgctcacccgttacgccatggcgcagcgggaaattgccctctcgctcggcgagccccccgccaccaaaggctatccgccgtcggcttttggcattattccccgtctggtggagagcgcgggcaacagtgacagtcatggctcgatgacggcgatctacaccgtgctggcggaaggggatgaccagcaggatcccatcgtcgactgcgcccgcgcggtgctcgacgggcatattgtgctgacgcgcaaactggcggaagcggggcactatcccgccattgatatcagccagtccatcagccgctgtatgacgcagattattcccgctgcccatcagcgcgccgcccggctgcttaaacagcattacgccgcttatatggaaatcaaaccgctgatccccctcggcggctatgtcgccggggccgacgctaccgtggataaagcggtaaaactctttccggtcatcgagcggtttttgcgtcaggagatgcacgaggcggcgcctctcgacgccgtacaggcgcagctcagcgcgctctttcccgccgctaaacaggcagaggtgaaaaaatgaagccaatgatcgccacccttgcgcagcttcagcggctgcgcgaccgcagagtgaaagacatcaccgtacagctcgccgaacagcagcagctgtgcgcccgttacgacagcaatatcaaagcgctcggctacctgttcgataaaacgcagattaacggcagcgacgcgccatcggtggaagttctcaaaaacgtcaccggctacaaaggcagtctgcaacgggtgatcgcctggcaggagcaggaaaaaaccctcgcgaaaatcaaagccaaccgcatacagaaaaacctcgttcgcgccgcctgcgacgaaaaaatcgtcgcactgaccctcaacgaccagcgccgggcgctgaggcaggaacagcaaacccacgcccagaaatcgctcgatgagatcgccagccagtgctggctgcgccagcgtaagcggccggagtaaagtcatgcgcaccgtcattacttttggcaccttcgatgtctttcacatcggccacctgcatattcttaaccgggcaagaaagctcggggatcggctggtggtgggcgtgtcgtccgatcaactgaaccggcaaaaaaagtcgcgcgccccgctctatgatgagcaggcgcggctgcaaatcatcagcgcgttaaaatgcgtcgatgcggtctttcttgaacaggcgctggaattaaaacgcgcttacatccgccagcaccaggccagcgttctggtgatgggggatgactggcaggggcgctttgacgatctcagggatatgtgtcaggtaatttacctgccacgtaccccttcggtttccaccacgtccataatcgaactggccggacgcgttctcagccatccttaaaacagtttctgccgcaggctgtgcagcaggctgaaggcctgcggatcggctggcgtatccacggcggccatcaggcacgccgcggcgcgttgcccggcgttaccatcccggaaggcgtcacaataatgatggcgaatgtcagcaagcgccgcctcccgcgaggcccagtcagagtcagcggacagctgctggcgaagctggatcatatcgccggccaccggcagcagcgcgcggatcttttgctcggcgctgtgtggattgctgtaagtcacatcctgagccagcagatcgtccatccccgcccagtcgagcaaaataacccgtttcccggcgtggatggcatcgaaaataaatccgctgttatccgtcagcacatagtcggcgcacgccagcaacggcagggttaaatcatggcgggtgacgcattttttgaaatggcgtttgattaacgccaggtcatccgcctcttcgacgcggtgcagcgtgccgtggtgcagtttcaccaccaggttatattcacggctcagacgtgacaacgatcccgcccagtgcggtatagagcttaacgtgccgaaactgggggcatacagcagcgtcggtttttttgtatccagccgcaggcctgccagcgccgacagatccacgtcaccccgatgccatttatcgaagcgcggattgcccaccaccactgcattgccattgatgttcagcgcctgctggctgtagtggctgaagcagagaatatggtcataaaaggcgttccaccaggcatgattccaggattcttttgccagaccatacatcgcccgaacctgcacctttgccagcgatttcagcatcggcgtgtaataggggctgaccaggcaggcatactgctggcggcgattgatcgcctcgctaaggcggctgccgctgaggcgcggctcatccagcgccgccagcaactgctgcagttcatgacgcaatccctgcggcacctgatcgcttaccagcagatcgcagggataaccggccgcaagcagtggagcgatcatcggctgataaagctgataatgaaaggcggtttccagaaaaaaaccgatggttttccccagccggtttgccaccggcggctgttgcgctttacgtttttccgccaggtggttaccgcccattttgctgaaatagaaatggatatggtcagtatctttttgctcgatatcgctgaagccaggccgctgatagctgatgcacgggtagaaggaaagccactttccgcgcgcctgtaacggctgccagcgcgcttccagttggatggccggatcttcctgcagctgtttgagcagcgccgggtaataaggccggttgaccagatacgcgcagactttttcgctgtcgctggcgcgtaccatccccggcaggcttttcatcggctggccctttgtcacctgcgcgccgagcagcaccacttcccatgcaagatgcggcagcgccgccagcagcgcgttcagtccgctgatatgtttttcctgcctgagcagcagggcgtcatcctccagcaccagcacgctggcaaagccttcatcctgcgccatctgcaacgcctgctgatgcgagcgcgtgcggcccagcgctggctgcggatgctcgcaggcgctcacgcgccgcactttatctgccggaacctgaagcgccgccagtgtttgctgcatctgctgccagcggtcggtgcgggcatcgcggttgatgacaaggattttgtcgatacgcgaccactgcaccggctgcccgccggtggcattgtgcaggctctgataccaggcccgcagcagcggatccgtcaccacctcttccagcgtctggctgacgggctggctgctgccgaggataaaatctttatcgaaggtgttctggctgtgagagatgcacaaaatagtgcgctcgcacggcagctgtaaggggttgacggtgaaattatcggtaaaggcctgctcctcgccgaggttacagttatcgtcgtaacggtgttttttcaggtagttacggtgataagcgaaggtgccgttaagaatatgctgctcgccgaaggcgtgagttttaaagatgcgattaatatggctgtaccagatggggatccgatcggagccggaaatcagcgcgccatgacgctgcatcatactgacggtatacgacagcttatccgacggataaaaatcgtcgtcgtccatgcagacaatgtattccccgcgcgccagctcgttaagcatattgcgtttcttgcccagcgccagccgctcagggtgatggatatagcgaatattaaagcgcgccggatcgctgttcgtcagggcattaatagtgtcgatctggctggtgtcggagtcatccagaataatcagctcgcgccgatccgccggataatcctgatagcggaacatatacagcagataaggcagaaaggcggcgcggttccaggtgggcgtcaccacgctgacaaagggtagcgggcgagcgccgcgcggcgcggcgttgtccagcagcgtggcgatcagactgggttttggcgagagatgtgacatagcggtatcacctgaccagcagggagatcgccgtcagcagcggatccggttgatccgccagcagcgccgcgcgttcagcggtggctttttcatcaagacgccaggcttcgaaaacgctgaacaggctgatggcctgcgcatggctgatggtcgagccatccatcagccacaggctgaacagcgaacgcagcagaaaatagtcgctcaccaggtgcagatagcaggtcagcatgtcgtgatgatcctggcctggaaacgtctcatgatagaggcgatacaccagatagttggtccagatccacggcctgtccgcaaaggccttttggccttcacgcgcccacacgtccagcagctgttgctgcatcagggcttcgctgttggcatcagccagcgccagcaggctgagctgcaacggcaggctcattttgcgcgtgcagtccaccaggcgatcccagtcaaaaggcagacgcccaaggctgccgatcagctggcgctgcggtccggcaatcaccggcaactgcgcgaacatctccgccagcgtgccgcgggcggcgtaacccgccagcgtctgcggcagcgatttcagtgtttccagcgcatcatcactgtcggcaggcaatttttgtgcgtaagagagcatcacgccgagggcgtacaggcgcaggtcaatgctcagatcgggcagggtgacaatatccagcgccgcctgattcagcacctgtaaatgttgcggcagcgccgccacgcccggcaccggctcggtcattttgacctgcaaaacgaacgcctccggcgagccgagcaccgcctcgcagcagtcgggatcgtctaacagcaggctacaacgcgcttcatgctgccagttgatcaccagcggctggcggatggcagcgggatgctgcgcccggtagtggcggataaacgccggttcgtaacactcaatctggttcataggattctcatacgcgccgggactagccgcggtagataaaatcgggccccgtgccgaggaaggtttgcacaaattcgtactgcatggtcagcagttcgccgtttttttcgttacagctctgacaggacgccgcctggcgctccagctgttgccagctctgttgtgccgcgtgtttttgtgccgcaggcagccagctgaacacctgcgcgatgccgtcgcggtcagcgctgacgccaaggtttagcagcgtctcgcggcgggcgcgggcgctgtcgctcagacgctgatagcgctggtggatggcgtcgttgacggcgagcagggcgtcgctgtcgcggcggatcatgcacaggcgctgttcgtcgagctgcgcgcgcagctgacggtaatcttcttcatcctgacggatgccgcgcagcaggctttttacctgctcaagtcgggtggtcatgggcatgtctcttacgactggaaaaaggccagcatcgaggcggccagcgcgtcggtgtcgacggtaaaatcgtctgaagccagcagcgcctgcatttctgcgacgcgtgtcgtgtcgacgttttcgctgtcgtcgccgtcaaggctggactgcgcggtgtgcaacccctgctgggtgatgtcctctgcgcccggcagggtggcgatcgtttgcgccgccgcgtccgcagattttttttgcgacgaggtggtcgtcgggcgcgaggccagcggcagctgtctgattttaatacctgactcgttagtgatggccatggtgtttactcgttgattaagcagggtttgtcctggcggcgggcggtgatatgccctgtatgctggtgtaaagcggcgcggagcgaggaaaacttaaacggggggaggggatttttttctggggggagattgcgctctggtgactattgcgtttggtaccgggtaggttgcgctcttactgacttcttagtacggctttaacagtgggtgcacagagcgcgcagggggcggccagtcgccgccgccccctgcacccccgggctcccggcaggaaaatcgccgcttcgcggtgccctcggcttatcccttccggcttcgggtcgggcgcgatgcagcgtccctgcaagtcgcgccctcagcccgcatccatgcgggctgccccggccgtaagtgaacgcctcagcgattttcagccggactccccacacttccagattttttataaacccaatatcgcggttcctgtaagttcaaataaacttcaagccactcagtcgtaacaaaccgtcatcgtaattaacgcgaggggttgagtccccgctgaaaccggcgagccggaggccggatgacaagggctggacgccatggatggcggccagaggcgaaatgaggcaggatgccgaatcgagccgaccgcgggcagacggccgggaggtgagcgcagtgcgcagcaccggtttctgtgcggggccgcggggattgctaagggggccgcggtggcccccttagcacgttcaccgtcagcggcgtcacgcctgacacgaaacgcaaagtgaacggaacattccaccacacttaaccaccccgctcactgcgccaccgctgccaccaccacccctggcgcctccaccgtcgcactcaccacccgctggctgctcgcattctgtaccttaatcacctccccctgatgcccgcttttcagcgccaccccgctggtctgcgcggtgatctccccgttgcgcgacaccagcgtcaccgcctgatcccgcttcacccacagcggccgaaccacatcgttcgccttcaccggcgtattcacccgcagcgcatggcgggcggtcaggccgagcacctcttccatcttcatcaccagctcaccacgttgattgctgatattaaattttttcagcgtcagcgcgtcagcggtcagggtttcgccacgcgcgatctcccgcgcgggcatcactaccggcaggtaaatatccgctttcaccgtcacggtaaagcgccagcctgccgccccaggacagagcacgctgtagccgaggcgcggcagcgttttcgcgctggcggtaaagatcggcggttgcgggcagggggccgcgctggcgacggcggcgggcataaagacgttgaagcgggaatggtaatcgggccactgcttttgcgcggccaggttctttaccgtctgctcagcaagctggatcgcgccctggttaatttgctgtcgcgcgctgtcggttatcaccgcgcaggcggggaatgtcagcagcagcagggccgccgtcagggcttccgccagcggaaaaggaaggcggaaaaaggctttccgcggcgacggggtattcttcataaaaactttacctttcaataaattaaaaaattggcacgccaattgcttaaagggccagccagtcagaatttagtgaaggagagttgcagaagaatgggcatcagttttcagcaagcatttggtgtacatccgcaggcagtggcgttacgtcttgagaggaccgagctaatcaccgccaacctggcaaacgtggatacgccaaatttcaaggctaaagatattgattttgccgccgagatgcaacgggcaaattttcaccagcctgcggcaaaggcggtggcgatgtaccgcgtgcccctgcaaccgagtcaggacggtaataccgtcgatctggacgcggagcaggcgcggttttcgcaaaacagtatggattatcagagcagcctgacgtttttaaatctgcaaatcagcggcctgcgcgccgctattgaagggaagtaaccatgtcttttgctgacatttatcagatttcgggttcggcgatgagcgcccagacggtgcgtctgaataccgtcgccagcaatatcgccaacgccgattcgcctgccgccagcgaggccgccacctacaaagcccgcagcccggtgtttgcggcggagtaccacagcagcctggcggcggcggggcatcatgagatgaccggcgccagcgtgcggctggaggatgtggtggaaaccggcaccgccgtgcgtcgctacgagccgcatcatccgatggcggatgagaacggctacgtctggtatccggacgtgaacgtcgtcgaacagatggccgacatgatgtccgcgtcgcgggatttcgaaaccaacgtcgatgtgctcaataacgtgaaaagtatgcagcaaagcctgctgcggctgggagaaaacgcatgagcgccacggcagtaaacagcacccagccgggcgcaacgacgcaggaaagtgctgcaacggtgagcagtaaccctggtgaccagaccaccacctccaccagcagctcgatggcggacacctttctgaccctgctggtggcggagatccagaaccaggatccgaccaatccgaccgacccgacggaatacatcacccagctgtcgtcgatggcgcaggtggcgatggcggaggagatgtcggtgcagatgaatactaacgcggtgctgatgagcaacatccaggtgatggccctcggcaatctggtgggcgatccgatcatggtgcagacctccacgctgagcgttgacgacagcgccattcacggtcgcgtaaccattgatgatgcctgtaccaccgtcgatctccacttcaccgacgaagccggtaacgactacgtggtgccgctgggcacgcagtcgccgggccaggtgagcttcgatatcgatccggcggattacggcattccccccggtgattacgaagtgtcggtggtgaccaacaccggggaagaagaagtaccggttgaggtggcgggcgtggtcaacgacgtgcgcattccgctggacggcagcacgccggtgctcaacgtcagcggcatcggcgaggtgcctttcaccatgatcagccagttcggcgtgccggatgatgtcgcgcctgccgatgacgttttggtttaacccttacaaggaacacaggattattttatgagttatgaaattgcagcaaccgggctgaacgcagttaacgaacagctggacggcatcagtaacaatatcgccaacgccgggacggtgggctacaaatccatgaccaccgagttctcggcgatgtatgccggcagccaggcgatgggcgtcagcgtcagcggcacggcgcagagcatctcccgcggcggttcaatggtctccaccggcaatgcgctggatctggcgattaacaacgacggctttttcgtcacctgcgacagcgcgggcaacgtctgttacacccgctccggttcatttaccaccgataaagacggctatatcgtcaacacctccggcgactatttgcagggctatccggtggatgacagcggtacgctgcaaaccggtacggtaaccgatctgcaaatccagaccggcaatattccggcgaaagctaccgacagcgtgagcttcggcgccaacttcgacgccagcgacgaggccatcgacaccgccgcggtgccctttgatgccaccaatgccgcgtcttacaacgacacctacaccaccacggtttacgactcgctgggcaacgagcacaccgtcagccagtacttcaccaaaacggcggataacacctggcaggtgcattacagctttgatggcgaaacgcaaagcaccaccaccgaactggtcttcgacagcgccggtaagctcaccagcccgaccacgcctgtggcactgagctttgacgtgccgggagcggatccgctgaccctgaccatggattacggcacctgcacccagttcggttcggaattcgctgtcagtaccaacagcgccaacggttacgcctcggcggagcagaacggcgtgcaggtggacagcgacggcaaagtttatgccacctacagcaacggcgagcgcatgttgcaggggcaggtggtgctggcgaccttcccgaacgaaaacggccttgaagcggtgagcggtacctcatgggtacagaccggcgaatccggcaccccgctgctgggcgtgcccggatccggggcctgcggcacgctgagcaccggcatgctggaaggctcgaacgtcgatattaccggcgagctggtggcgctgatgtcggcgcagcgtaattatcaggccaacaccaaagtgatctccaccagcacccagctggatcaggcgctgttccaggcgatgtaagacatggaccgtttactttttaccgccatgagcggagcgacccatgcgttgcaggggcaggcgatcagcgccaataacctggcgaacgccagtaccacaggttttcgcgccgatctggcgctgtcgcaaagcctgccggtgaacggcaacggtttcgccactcgcgtgatgagccaacagacgcccggcggggtgaacagcgccactgccgatgctcaggaaaccgggcggccgctggacgtggccattcagggcgatggttacatcgccgtgctggatgacgacggccaggaggtctacacccgcaacggcaatatccagcagaacgaccagggcgagctgaccatcgacggacatccggtgctcggcgacggcggccccattgtgctgccgccgaacgccatcgcctcctttggcagcgacggcaccctgtccatcactccggacgacggcgatgttaccgccaccatggatatcgaccgcctgaagctggtgaccattgcgcaaaacaacctcagcaaaaatgagcgcggcatgatgatcacccgcgacggccagcccgcgcagcccgatgaaaacgtcagggtcagcggcggctttctggagggcagcaacgtctccgccgtcgcggaaatgctggcctccatttccttaaaccgccagttcgaagcgcagatcaaaatgatgaaggcggcggaagaactgagcgaatccggtaaccgtttacttcgtggctcctgaggggccgcgtgatcaggataaaaaatgaacgcagctttatggatcagtaaaaccggtctggcggcggaagactccgaaatgagcgctatcgccaacaacatcgccaacgtcaacaccaacggcttcaagcgtgaccgggtgatgtttcaggatctgttttatcagaatcagcgtgcgccgggggcaatgctcgatcagaacaacattgcgcccaccggcattcagtacggcaccggcgtgcgcgtggtcggcacgcagaaaaccttcaccgaaggcaatatccagaccaccgagaacccgctggacgtcgccattatggggcagggcttttttcaggtgcagaaagccaacggcgacagcgcctacagtcgcgacggcaatttgcaggttaacgccgacggcgttctgaccaacgcccaggggttgcccatccagccggaaatcgacgtgcccgccaacgccactgacatcaccatcgctgaagacggcacggtgatggcgatgatgccgggcgaagccgagccgactgaactggggcagatcacgctggtgaactttaccaacccggcggggctgatggcggaaggggacaacctttatctggaaaccgccgccagcggccagccgacggaaggcacgccgggcgaggacgcgctgggcaccctgaaggccggggcgctggaaggctctaacgtcgacatcgttaacgaaatggtggcgatgatcaccgtccagcgggcctatgagatgaacgccaaaatggtctccgccgccgacgagatgttgcagtacatcaatcagaacatgtagggctaagggccgcctgcgcgcggcccgtctgaagtaacaggaacgaaagtgaaaaaatatttgtggttaatcatggcattgccgctgttaagcggctgcgagtcgcaggcgatgctggtcagcaaagacgacgccgcctttgcgccgcctgacgcggcggtagcgccgacgccggaagggcgcgcgggcggggtctttcaggcgggctataactggtcgcttaccgcggatcgccgtgcctatcgcgtgggcgatattctgacggtgatcctcgatgaatccacccagtccagcaaacaggcgaaaaccaatttcgacaagagcagcagtctggatatcgccgcccccacgatttttggcaaaaccaaagacaaactggaaagctctgctgacgctgaccgcagctttgatggcggggccagctcacagcagcaaaacagtcttcacggctcgattaccgtgtcggttcatcaggttttgccaaatggcgtgatggagatccgcggcgagaagtggctgacccttaatcagggggatgaatatatccgcctgagcgggctggtgcgtgccgacgatgtgcagaacgacaataccgtttcctcgcagcggatcggcaatgcgcgtatttcctacgccgggcgcggggcgctcagcgacgccaatgccgcaggctggctgacgcggctgttcaaccatcctctgttcccgctgtaacccggagttgtttatgaagtgttttacatgtccacaggggcgctggctgctgctcattaccctgatgctgacgctgtttaccgtccatgctcagtcgctggagtcgctggtggatattcagggcgtgcgcggcaaccagctcatcggctacagcctggtggtcggtcttgacggcaccggcgataaaaatcaggtgaagttcaccaaccagaccatcaccaatatgctgcgtcagttcggcgtgcagctgccatcgaaaatcgatccgaaggtgaaaaacgtcgccgccgtggcggtgagcgccacgctgccgccgatgtacgcccgcggacagaatattgatgtgacggtgtcgtccattggcgatgcaaaaagcctgcgcggcggcacgctgctgctgacgcagttgcacggcgcggatggcgaagtttacgcgctggcgcagggtaacgtggtggtcggcggcatgaacgccagcggggccagcggctccagcgtcacggtcaacacgcccaccagcgggcgcatccctaacggcgcgtcggtggagcgggaaattcccagcgacttcggcatgagcaatgcggtgatgcttaacctcaagcgtccgagctttaaggatgccaataacattgcggcggccatcaaccgcgcctttggcggtggcctggcgacggcgaaaagttccactaacgtcgaagtgatcgcccccaccgacgccggtgcgcgcgtggcctttatgtcgcagctggaggatgtgcaggtgcaggcggagcgggtacgggcgaaagtggtgtttaacgcccgtaccggcacggtggtgatgggtgacggcgtggcgctgcatgcggcggcggtgtctcatggcaatctgacggtgtcgatctccgaaaccacccgcgtcagccagccgaacgccatgtcccgtggccgcaccgtggcgtcgccggacagcaacgtcaacgtcgatcatgcgcgtccgcaaatggtggcgctgccggagtccaccagcctgaaaaccctggtcagcgtgctgaacggtctgggcgcctcgccggacgatgtgatgtcgattttgcaggcgctgcatgaggcgggcgcgctggatgccgatctggaggtgatttaaatggaaaaccttaacgccattacccacgccctgcgcgcccctgacagccccgacgcggcggcggtgcgtgaccatgacataaaagaagcatcagcccagtttgaagcgattttcatgcgcagcctgatgaaagagatgcgcaaggttaatgcgctgttcgactcgaaagacaacccgtttaacagcgatgcggtgcgcaccatgcagggtttttacgacgacgccctgtgcgacgaactggctaaacaccaggggatcggcatcgcggagatgctggtaaagcagctgtctgcacagcgtcacgattaaggtttaagaacgggcgcggtccggtcgctttaggtagcaaacgcgaatttttagccgggcctggcccgacgaggagtaccagatggacatgataaatatcggttacagcggggcatccgccgctcaggtgcagctgaacgtcacggcgcagaacaccgccaacgccatgacgccgggctatacccggcaggtggcgatgaccagcaccattggcgcaagcggcggcgcggtaaacagcgcgggcaatggcgtgcaggtggacagcatctgccgcgtgtcgaatcagtatctggtcaatcaggtctggtatgccgccagcgacaacggcttttacagcacccagcagcagtacctgacgcagctggaaaccgtgttaagcgatccgaacagcagcctgagcgccggattcgataacttttttgccgcgcttaatgaggcgtccgccaacccggacgactccgccctgcgtcagcaggtgatcagcgaagcgaacgcgctggcgctgcgctttaacaatacctgcgactacattcagtcccagagcgatgaactgctcagtcaggagcaggcgaccatcgcgcagatcaacagcctgacctccggcatcgcgggctataaccagcagatcgccgaagcagaagctaatggcgataacgcctccgcgctctatgacgcccgtgaccagatggtgcagcagttgagcggcctggtggacgtgcaggtgcagatagacgatcgcggtaattacaacatctctctgccgaacggccagccgctggtcagcggccaggactgctcgaccattgcgatgagcagcaacgcagacggcacaccgtgcatggaactgaccttcgccgggacgacctacagcatgacggaagacaccggcggctcgctgggggcgctttttacctaccagagcgacgtgctggatccgctgaccgccaccatcaacagcatcgccgaacagtttaccagcgcggtcaacagccagctggcggcgggttacgatctgaatggcaatcccggcgcgccgctgtttatttacgatcccaccgatccggacggcccgctgctggttaacccggacatcagcgaagacgaactggcgttttccagttcaccggatgaatccggcaacagcgacaacttacaggcgctgattaacatctccaccgagcctatggagattgagggtctcggcaacgttaccgtcggcaacgcctgctcgacgctgatcagcaatatcggtatttacagccgccagaaccagacggaggcgcagtctgccggcaacgtttacaacgaagcgcagaaccagcagatgagcgtcagcggcgtcagcatggatgaggaggccgttaacctcatcacctatacccagatttatcaggccaacctgaaagtgatttctaccggtgcggagatttttgattccgtacttgagatgttctgagcaaccggaaacgacagactatgcgcgtaagcactcaacaatcctacagcaccatgaccacccgcttcactaacctgtcggcgcagctggagcatgtggtgacgcagatggccaccgggcaacgcattatattgccgtcagatgaccccattgccgcagcaaggatcacccagctcgatcgccagcaggcggccatcgaacagtatcagagcaatatcaacagcgtctcagccagtatgagccagcaggagagcgtgctggacggcgtcaacaacagcctgctggcgatccgcgatgacttgctggcagcggccaacggcaccaataccgccgaatccctggcgggttacggccaggagatccagtcgctgaccgaatctatggtggcggcgctcaactatcaggatgaagacggtcactatatttttggcggcacggtgaacgacaccccgcccatcacctatgacgataccgatggcgacggggaaggggatgaatacgtctatcacggcaatatgaatcaccgcaccgccaccgtctcgaacggcgtggtgatggacactaacgtctcggtgggggagatttttggtcaggggctggcgcttttcaacacccttgatgacctcgcgaaggagatgcaggatcccacggtcgatcccgtggcgatgcaggatgatatttcccatgctatcaacgtgattgatgaaagcgccgactcgctgaacaccgccatcgccagcctcggcgagcggcagaacactatgagtatgctgagcgacgcccagaccggcatttccgatgccaatgccgatttgattggtcagcttggcgatctggattacggcccggccagcatcacctttaccggactggaaatggccatggaagccaccatgaagacttactcgaaagtgagtgagctgaacctttttagcgttatttaacgacttccacgcccaggatcatcatgcaggttggtttacaaacttcaacgcatacccgtaccggcggactgacgtctgccgttcgtcagccgggcgtcgtgcgcaccgcgcccgtcagcgataaagcgccgtctggcgactacccggcgtcgccgctcatcgccacccgtccgcagcgctacagcgtacagcttaacgatcagctcaccacgttacagcaggcggatcactggctggggcaactggagcgcgcgctggtggattatcgccacggcgggcagcgggatccggcgaccgtgcagtcgctgctcgacggtcgtctggcgctgaccggcggcgcggtggaccgggaactgcaaccggtgctacaggggcaggcgcaggtgcgctttcatgcgccgcagctgagccaggcgctggcggcggatggcccgcagaaactgctgttcagcgtacagcacgggcggaaaaccctgctgtccgggctaaatattaacggcgacggcgatgccgggcagcgggcgacgaaaatcagcaccgcattacgccgcgtcggcgtgcagcccctgaaaggacaggagggctttactgccagtgagcagcactgggcgcagctgcaaaacagcttcgccgtgcagcgggaaggggcggggcagaaaatcgccattgcggtggcggcgcatccggcgcagacggaaacccttgccgccgcgctccccagcgggcagcaggcgcagcgcgtggtgcaggagacgctcagtcaggtaagcgcacagcgtcagcagctggcgctccagcaggagaaagtccgccagcgtattgatgatatgtcgcgttttgcgcagtcgcagagtgcggtggaggcctccgcgcggctggcgggaaccctggatgcggccagccataattatgaggtgctggcgcaggcgattaacggccaggcgaatctgtcgaagctgacggtgcgcagcctgctggattaacgtttcgggcagggctgcccgtcaggttgcagcaggcctttttcggtgatcaacatggtggcgctgtcctgattaaacagcagctggcgagcgtcgcccagcggcacgctcacactttgcagatcgttatcattgataaagcccagcaccgggaacagcgtggcgtccgtgccggtgacatgagcattctgcagacgtaaaaacgattcgccgctctgctcgccgccgggggcggtacaggcgatcagctgcatctgcagggcaaaagcctcatcccctggccgggtcaggaccaggcgcgctccccgctccgcgggggcggtggtcaggttataaaccgcgtgttcagccgttgccagatcgtaaatcccgacctgggtgcgggcaataacgggcgcggcctgaaggctaccggcgagaccggcgagcagcagacccgcgataacattacgaacaggcaggcatttcattaagcgtgcgctccgtttccttgtgaattaattgacccagttttttaacatcctgttgccagctgcgaatttccattaacaactgatattctttaccgcactgattttgcaccagcaggatcaccgacattttttgtaccgccccgtaataataaatcgtcagcgttgccttatgcgccgtaagcagcatattgatgccttccagcgactccgcaatatgcgacgacaataccgcgcctgatgtattcacccccgtgcggtgcagtcgaaataatttaattttgtcattttgcggcgacagctcttctttaatcgacagacgggaagtggcaagcggcgcagaattctgccccccgggataaatcagccagataagcccgcagccaagcagcagcaacagcgccgccagggcgatcaggcggggtttattgcgcggcgcaggcgcgctggcgggcggggcatccgtcacgtcggcaaccggttcaggattgggctgagtcaggggctggggcgcagggagcggctcatccggtaacaggacgataaagtctttgttcagcagatagccttttttcgggatggttttgatgatctcctgtacccggccatcgtcccccagcgccacccgcagagcatagacagcggtcagcaggctgttatttccgacgacgcggtttttccatacctcgctcatcagaaaatcacgcgacaccacctccccggcatgattaaccagcgtttcgagcataataaaatggaattcgccgaggcggcggatctcccccgtttcccggtgtaccagaccgtttaacgacggttcaactttccagttattaacaatgatctgcatagtaatctgttaataaattggtgagtaataatttatttttcacaacgtaagattccacttagccgcagggagggtaaatgtatcggatgattatcaccccatcaatctaagaatagtcttaactcataaattaataattaattaatttctaagctaacggattgataaagcttgccgtcagcgcctgggggtattaacgtcgctggtaattgtagacgatcggcccgcaaaggccgtcgcgactggcaagtttgattaatgtaatgaggtcatcatgtttaaagccattcagatcgataaagcggaaggacagtattcggcatccctggtggagctggacgagcaggcgttgccggacggggacgtcaccgtcgcggtggaatactcctccattaactataaagatgcgctggctattaccggtcgcggcccgattgtgcgccagttccctatggtgccgggtattgatttcgccggtaccgtaatcgccagcgacagcgcggcgtttgccgtgggcgaccgcgtgctgctgaccggctggggcgtgggcgagcgtcactggggcggactggcaggcaaggcgcgggtcaaaagcgaatggctgacgaaaatgccgtccggcgcggatgcaaaacaggtgatggctatcggtacggcgggctttaccgccatgctgtgcgtgcaggcggtactggatcacggcgtgaagccggaagacggcccggtgctggtgaccggcgcgggcggcggcgtgggcagctgcgcggtgatcattctgtctgccatgggctatcaggtggtggcgtcgaccgggcgtccgcaggaagccggatggatgcgcgaacagctgggggccagcgacattattaaccgtgatgagctgagcgcgccgggtaaacccctgcagaaagagcgctgggcggcggcgattgataccgtcggcagccatacgctgagcaacgtctgcgccagcgtccgttatgacggcatagtcgcggcgtgcggcatggcgcagggcatggatctcccggcgacagtggcgcctttcatcctgcgcggcgtcacgctgcgcggtatcgacagcgtgatggtgagcagcgaaaaacgtccggcgatctgggagaaagcctgtcagtatttaacgcctgcggcgctggaaaaactgagcgctacttatccgctgagcgatgccattgacgtggcggaaaaactgctgaacgggcagatccgtggccgtgcggtgattgagatttaattctggcggggttgccgggtggcgctgacgcttacccggcctacagtataacgtaggcccggcaagcttgcgccgccgggcaatttgcagcaacgttatttgcgaatatcgtgcgcggtgtcgttttcgcggcaatcgccttcggcgcagtggccgtagaggtaaaggctgtggttggtcaggcggatcccgtgctgagcggcgatttcacgctgacgtaattcaatggagtcatcgctgaactcaataaccttgccgcagtcgaggcagatcaggtgatcgtggtgatgctgctgcgtcagttcaaaaacagatttaccgccttcgaaattatgacgggtcacaataccggcgtcatcgaactggttaagtacacggtagaccgtcgccaggccaatctcttcgcccatgtcgatcagtcgtttgtataaatcttccgcactgacatggtggttgtcaggtccctggagtacctcaaggatctttaaccgaggaagcgtgactttcaggccagccttctttagtgcggtgttattgtcagtcatgcggaatctgtcctgtagctaaacgattcacttccaaatggaagttaatgagaatgacgttgagttaatgcgtctcattatagaactgccatgtctaaatgaaaactgcaagtcctcaagcaaagtatgcgtataaaacgtggtgtcactaacaaacccgtaagcaatcacgttcaatcaggggatattgtacaggtatgcgtgcgaaagttaaaaaattgtagcaattattttgattggttatatctattaatgcggcgcagccaacaggttacgccgcacaaaaatcaggcgttgatgatctcatctaaatgaagttcttcagaaatctgcttcacccatttttccacgcgctcagcggtcagttccggctggcggtcttcatcaatggccagaccgacgaagtggtcgtcgtccgccagacctttggaggcttcgaaatggtagcccgcggtcggccagtgaccgacgatagtcgcgccgcgcggctcgatgatgtcgcggatggtgcccagcgcatcgcagaaatattccgcgtagtcttcctggtcgccacagccgaacagggcgactaatttgccgttgaaatcgacctcttccagcgtcgggaagaaatcgtcccagtcgcactgcgcttcaccatagtaccaggtcgggatgcccagcagcagaatatcgtaaccttcgagatcttctttgctgcttttggcgatgtcatgcacgtccgcaacatctttaccaagctgcttttggatcattttcgcgatattttcggtattacccgtgtcgctgccgaaaaaaatgcctgtgattgccatgagtaaaataacctcttgaaacttaatgatatggtggtggcgcaatgcccacggataagggcaatcatagcagaacagagaaggacgcggaaactgcaaacgcctcagactgcactctgtgctacatgaaagtgatatttagcgggattttcagactatcccctggccgcgcagcagcgcgagctgagccattaaaagctcctcaatcagttcgctacggctgatgtcacgatcctcggccagttcatttaaggcttcgacggcgtccgcgtttagttttagctcgacgcgtttgaggccacgaaccttatcgcgtttcagctgattccgcttattaatgcgcaactgttcgtcacgcgaatgcggattcgttttcggtcgtcctgggcgacgatcattcgcgaacagatcgagtgtcgtgcggtccgtttgttctttagccatgattttgagtgacgtcgggggaaaaacaagctgcctggtggaggccctgcgcaattagcgcgccatcatacatcagggagaggggcacgccaacgaccgggcgcgtcgcggcgctcggtcgccgggtttttaatcaactggcattatcagcaagatagcgacggatcgcccgcagtacggcatcgggtttttccgcatgcacccagtgcccggcaccggcgaccacatgcgcccgcgcctgcgggaattgcgccagcagcgcatcacggtacgcatcggtcacgtaaggggagttgccgccgcgaataaacagggccggtttatcgaaggcggggacggttttccagccgatgatgttctcatactgatcccagagtaccggcacgttaaagcgccacccgccgtcggcccaggatttaagcagaaactggatcacgccttcttcgtccagatgctcgcgcatcacggcggcggcctgctggcgggtgctcaccccggcatcggtaacggcattgatggcggtaaaaatctcgtcgtggcggcgcaccggataagcgaccggcgccatatcaatcgccaccagcctgtcgatgcgttcgggggccagcgcggtcagcgccatcaccgctttaccgcccatggagtgaccaataaaggtggctttttcgatccctgattcgtcaagggtatccagcagatcctgcgccatcgccgggtaggtcatttcaggcgaacgcggggaaagaccgtggttgcgcatatccacctgtaccacatcgtggtcgttaatcaggtcgcgggctaagatcccgaggttgtccaggctgccaaacagaccgtgaacaaggacgatgggagaattgttgtgcgattgttgtgcagtttgcgcgcgggtattcaatttcatggcaaagttctttttttcgctctctcaggttagggtatcatgttgaccattctgccgcccggctgcaagggatcatctttatctgacttttgcgtcagaaaagcctggccgctatccgctgttgagatttgcccctataatctcaatgacttgtattcagaaaagtgacctcactggattaagatgaaaacgatcgaagttgatgatgaactctacacctacattgccagccacacgaaacacattggcgagagtgcatccgacattttaaggcgcatgctgaagttttctgccgccgcgcagtctgcggcccctgtgaccaaagccgcgccggctgccgctgtcagccctgcccctgatgtcgtatccaacccggtaaaagataaagtccgcgccatgcgtgaactgctgctgtctgacgaatatgccgatcagaagcgcgcggttaatcgttttatgctggtgctgtctacactgtattcactggatgcaaaaggtttcgccgacgccaccgagtcattacatggccgtacgcgcgtctactttgccgcagatgcgaaaacactgctgcaaagcggaaaccagaccaaacccaaagaagtgccaggcacaccttactgggtgatcaccaacactaatacgggccgtaaatgcggcatgatcgaacacatcatgcagtcgatgcagttcccggcggaattgatcgaaaaggtttgcggcacaatttaatccttgcataagaaggaccaggcaatggctaaccacccccgtgcaggacaacctgcacagcagagcgatctgattaacgtcgcccaacttacctctcagtactatgtgctgaaaccggaagtgggtcatgcagaacatgcggtcaaattcggcacatcaggccaccgtggcagcgctgcccgtcacagctttaacgagccgcacattctggctatcgcccaggcgattgcggaaaaccgcgcgaaaaacggcattaccggtccctgctatgtgggtaaagatacccacgcgctgtcagagcctgcgtttaactccgtgctggaagtgctggcagccaacggcgtggacgtggtggtgcaggaaaataacggctatacgccgacgcctgccgtatccaatgcgatcctggagcataacaaaaagggtggcgctcaggccgacggcatcgtcatcaccccgtcgcacaacccgccggaagatggcggcatcaaatacaatccgcctaacggtggcccggccgataccaacgtcaccaaagtggtggaagatcgcgccaaccagctgctggccgatggcctgaaagacgtgaagcgcctgtcgctggatgccgcgatggcgtccggtcatattaaagaacaggatctggtgcagccgtttatcgaagggctggcggagatcgtggatatggcggcgatccagaaagcgggcctgacgctgggcgtcgatccgctgggcggctccggtatcgaatactggaaacgcatcgccagccactacaatctgaacctgaccatcgtgaacgatcaggtcgatcagaccttccgctttatgcaccttgataaagacggcgcgatccgtatggactgctcctctgagtgcgcgatggcgggcttgctggccctgcgcgataagttcgatctggcgtttgccaatgacccggactatgaccgtcacggtatcgtcacgccagccggcctgatgaatccgaaccactatctggcggtcgccatcaactatctgttccagcaccgtccgcagtggggccaggatgtcgcagtgggtaaaaccctggtgtcctcggcgatgatcgaccgcgtggtgaacgcgctgggccgtaagctggtggaagtgccggtgggctttaagtggttcgtggatggtctgtacgacggcagcttcggcttcggcggcgaagagagcgcgggcgcgtccttcctgcgtttcgacggcaccccgtggtccaccgataaagacggcatcatcatgtgcctgctggcggcggaaatcaccgcggtaacgggtaaaaacccgcagcagcattatgacgagctggccgcgcgctttggtgcgccgagctacaaccgtttacaggcgtctgcctcttcagcgcaaaaagcggcgctgtcgaagctgtcgccggaaatggtcagcgccgacaccctggcaggcgatccgatcaccgcacgtctgacggcggcgccgggtaacggcgcgtccatcggcgggctgaaagtgatgaccgaaaacggctggtttgcggcgcgtccgtccggtacggaagatgcgtacaagatttactgcgaaagcttcctcggtgaagagcaccgtaagctgatcgagaaagaagcggtagagattgtcagcgaagttctgaaaaacgcgtgatcctgttgccgggtggcgctgcgcttacccggcctacatggctgaaaaacgcgtgatcttgttgccgggtggcggcttcgccttacccggcctacatgacctgtaggcccggcaagcctgcgccgccgggcgaaaaacaccaaagcctccctttaccgggaggctttttttcagccgtgcttatctttgagctcaaagcgcggcgacaccagcccgtacagcgtccagcccatgaaggtcacgatcgcgccatacagcatggcttccggcccggaggagtagagcgcatagaagctgtagagcgcgcccatcagcgccaccacgttagccgccttcgctttacgcggttccaccttcgcgaccttctgaatgatcaccagcgccgccatcgatagaatatacggaatgatgttggtcaccaccgccagattcaccagcacgttgaactgtttgttcagcgacgggctgatggtcatcagcgacagtccactctgaataatgacaatggtcagcattccttttaccggcgcatccgctttactcaccttcgagaagattttcgggaagtagccttcatcagcggaagatttgaacacctgcgcgatagtgaactgccagccaagcagcgaaccgcagcaggacatcaccatcagccccatgatcactttcccgacgccgggcgtgaacatctgcgaaaaagccagcccgaacggggcagtggagtttgccagatccatattcggcacaattcccgcgataacgttggtggagacgacataaatcaccgccgcccccagggtgccgcccatcaccgcgatgggcacgttgcgctccggattttccaccacctcggtattggcgcaggcggattccagccccagaaaagcccacagcgtcatggcaatggacgaccccacagcatcaaagaacggcacctgatgcgggttccaggactgagcgtacatctccgggctgaaccagaaccagccgatcaccgacaggccgatcaccggaatgatcactccccagatggtgatactgctgagctgcccggtaatgcgcgcgccgccaaagttcgccaccgtgcagatccacagcacgcaaatagtggcgataccgatctgcaccgggctgagcgtggcgccgagcagttcgctgccgtagccgacggcggaaatggcaatggcgacgttagcaatcagcagcgatacgccataggtgtagttcgccataaagttgccggacttaccgaaagcgtactccgcgtaaccgcccatccccccggacttgcggctgaacatcccgcatttggcgaacgcccacgccagcgccgtggagccgaccgccgtcaccagccaggagataatcgagatggtgcccacttccgcaagcttggtgggcagcataataatgccggagcccatcatattgaccatcgtcagaatggtgagcggcacaacgcccatcttgttggatttgctcataatgtttcccctttcaacagcgccggttcagcggtttgcggcttaatgacgtagcaccacacctgtttacgtccgtcgatctctttgatgtagacaccctgcagttcaggcgcaaagcccggcagcaaattgatgccttcttccagcgcggcgaagtaacgcagcaccgcgccgccccagatctcgccaggcaccacgcacagcacccccggcgggtaggggagcgccccttccgcggcgatccgcccctcggcatcgcgcagcgtcaccagctccacttcgccacggatgtaggcatagttcgccgcctgcggattcatcttcaccggcgggaagtgatctttacggaacatctctttttgcagctgtttgacgttgttacgcgcatagagatcgtgcatctcctggcacagctggcgcagcgtgtagccttcataacgctgctgatgctggcgatagagcgacggcagcacctcctgcatcggcgcatcgttttccagcagtttctcgaactgcaccagttgcgataccagttgctgaagtttgcccatgccttccgccggggtgagcaggaagaggatcgagttcagatcgcacttctccggcacaatggcgttctcacgcagatagttcgccagaatggtggccgggacgccaaagcggtcgtactcgccggtgcgggcattgatgcccggcgtggtaagcagcagtttgcagggatcgacaaaatactggtgcggcgcgtagccttcgaaggcgtgccagttttcccccggcacgaaatggaagaagcgcagatcgcggcaaatgtcgtgcgtctcgaaggtttcccacggacggccatcgacggtggcgggcacaaaggggcggatgaacttgcagttttgcaggatcattttgcgtgcttccacgccctgttcgacgcagcgcatccacattcgtttcccgctttcgccttcatgcatccgggcgttaacgtccagcgcggcaaacagcggataaaacgggctggtggaggcgtgcatcataaaggcgttattgaggcgcttatggggcacatagcgcggctggcctttgatatggctgtcttttttatggatctgcgaggtctgggaaaatccggcctgctgtttatgcaccgactgggtgaccagaatgcccggatccttttcattcagttccagcagcagcggcgagcagtcggccatcatcgggataaactgctcgtagccgacccaggccgaatcaaacaggatgtaatcgcacagatgcccgatcttatccaccacctgacgcgcgttataaatggtgccgtcataagtgccaagctggatcaccgccatgcggaacgggcggggcgtattcctgtgttgcggggcaacttccgcaatctgctcgcgcagatagttttctgcaaaacagtgcgcgtctatgccgccgataaagccgtaggggttacgcgccgtttccagatacaccggcgtcgccccggcctgcaacagcgcgccgtggtggttggatttgtgattattacggtcgaacagcaccagatcccccggcgtcagcaacgcattgagcaccactttgttcgccgatgaggtgccgttcagcacgaaataagttttatcggcattaaaaacttttgccgcatgctgctgggcaatacagggcgcgccttcgtggatcagtaaatcgcccatcgccacgtcggcattacagagatccgcgcggaacagcgtctcgccaaagaaatcgacaaactgattaccggcaggatggcggcgaaagaattgtccgccctgatggccggggcaatcaaaggcgctgtttccctgttttacgtaatccactaacgcactgaaaaacggcggacgtaaggcgcgctcatatttttgcgcggcggcttcgagctggcggccataataatcatggcaggcatcctgatattcaaataccccttgaatgcgcgccagatactccgacggcacaaattccccttcgtggctgacgacaaaaagcggaatgccaaaaccggtttcttctatttcttcgacgatccctttataaatatcgttaatggataatacgaccgcggcgacatccatataatcggtgtcgttaacatttactatttcacgctgggtggtaaaacagtccggacaggcgcggctgaccgcaatttttaagcgttgcataatctttccttgtttaaagggacagggcgtcccgcaactcccgtaaggggaattgatatgatttttaaataagcgtcagcgccggaaaataaactccggggaaaacgttatttttatttatgttgggcgtgcacgaaaccagacgtcagctaactcgctgaaatcaggaaaagaaggcagacccgaaaccggaacggttatcgggcgttaaagaaatgaaagtcgaagctgttacggtgggcaaacatcataatatgggtggtgcgtcttatatggggcatcagcctgctgttattttccataataaaatccttttgctgtttgaaagcgcggtcattttatcctggaaatacgggtagtctgtgagggcgatcaacaaaaacagcgcagatcagaaatatttagtcggtaaaagtgaataatgccgtacggatcgcctggtggcgtgaaaaggttaattagatgttataaagctgcttttaatatatttttgctgttttattcacctggtggaaataaatggcctccaggcctcaaataaatgaataaagcgggcaggattgcgtgtttttattcaaacgcaagagaagacgtgttaacagggacgcttacagcataaaacgatagccgatgccggtttccgttaacagatgacgcgggcgcgccggatcgctttccagcttctggcgcaggtggcccatatagatgcgcagatagtggctgtgctcaacagcattcggcccccacacctggcttagcagctggcgctgggtcagcactttgccgtgattatttaacagcaccgccagcaggcgaaactcaatgggcgtgaggtggatctcttcgtcattacgggtaatgcgccgcgccgccagatcgacctgaatatcggaaaaactgaccagcggatcgctttgccgcgccccggcatgacggcgcagcgccacccgaaggcgcgcctgtaactcgccaatgccgaacggcttgctgagataatcgtcggcaccggcatcgagggcggcgatcttgtcgctctcctcaatgcgcgccgacagcaccagtaccggcacctggctccactggcgcagatcgcgaataaaatcaatgccgtcgccgtccggcaggccgaggtcaaggatcaccaggtcgggcttgcgcgtgacggcttcgagcagaccgcgctgtaaggttccggcgtcgtaaacgcgcaggccatcggcctccagcgcggtgcgcagaaagcggacaatggcctgttcatcttcaacaatgagtacgcttatcacagatcctcggggagttcagtcagggccgggggggatccctgcggcagtgtaacacagaaacaggccccgccttccgggcggttagcggcggtaatagtgccgccgtgcacgctgacaatcgcctggcaaatggccagccccagcccgacgccgggaatagccgactctttatgaccacgggcaaatttatcaaaaatactcgcctgttgcccctccggaatgccggggccgttatcccataccgccagccggaattcctctttttcgacacgggcggaaatgccgatctgcgccgtcggcccggcgtatttcagggcgttttccagcagattgatcagcacccgctcgaacaacggcccgtcgatatgcaccagcatcagcggatccggcatctcaagggcgatctgccggctgccgggcagcgcctccatggtgcgcagcgcgctgccgatcacttcttccagcgtcagccactcctttttaagattaaatccgccggactgaatacgcgccatatccagcagattattcaccagccgcgtggtgttcagcacatgctgacggatttcactggcctgggtggcgtggggcgagccttcgctggccagatccagcgtcaggatctccgcctggccgaacagcaccgtcagcggcgtacgcaggtcatgggacagcgccgccagcagcgcattgcgcacgctttcccgctcgctcgccagccgcgattgctgttcgctggcggtgagcgccagacgctccagggcgttcgccaccagcagggtaaaggtttccagcaaccgctgctgttcagggatcatcagctggcgcaggctggtgggctccaccaccaccaggccgcgggttttatcggcgctgttcagcggcaaaatttgatagggcacgccgggcagcgtatcggtgcccgcgcccgcaggctggcctttggtaaagctccactgggcgatggcgtcatcccagggcgtcagccccggctggcgggtgagggcggtcagcgtgccgtccggtccggcgatcagcaactggctttgcgcgtgaaaggtggagcggataaaggcttcgctggtggcggcgatgtcgcgctcgttacgcccggcggccagcgctttcgacagctcatacagatgccgggtacgctgctcgcggtaacgcgccacccgcgcctgatagcgcacgccagcggtgagattaccgatcaccagcccgacggtgagcatgacgccgaaggtcagcagatactgcacgtccgacaccgccagggtaccgcgcggggcgatgaaaaacagatcgaagctgaccacgttaatcaccgtcgccagcaccgacggccagcggccataaaacagcgcgactatcaccacgcccagcaggtagagcatcaccaggttggcggcgtcaaaggccatcagccactggctggcgatcagggtgatcagcgcgcacagcccgacggccaccagcgtaccggtgagctgcacgcgccagcgatccagccacggccgggtgtccgtcgtacgggcggcggcaggggcgggtttatcttccagggcgacgatcatcaaatccagatcgggagccagccgcgccagcctttcggcaaaggtttcatgctgccagaaacggcgcgatgtacggcggccggtgataattttgccgagattatgctcacgggcgtagcggacaatcgccttttcctgctgtggatccgcaagggtggcggtttccgcgcccagttcctgagctaagcgtaacgcgctgagaatggcgcggcgctgcgcttccggcagtttgtgcagagtgggggtttccacgtacaccgcatgccattcgctgccgagtttggccgccagacgcgcggcagtacgcaccagtttttcattaccggtgccgtgaccgatgcacagcaaaatggcgtcccgcgtatgccagactttctcctcgccggggcgaccgcgaaaggcgcgcatctgcgaatccacccggtcggcggtgcggcgcagcgccagctcgcgcagggcgatcagattgcctttacggaaaaagtgttcgatggcgcgctcggcttggccgccgaagtagactttgccatcgtgcaggcgctggcgcagatcgtccggcggcagatccaccagcaccacttcgtcggcggcatcaaaaaagggatccggcacggtttcccgcacctggatcccggtgacgccgctgaccacatcgttgaggctttccagatgctgcacattaacggtggtgaacacatcaatgcctgcttccagtaactcttctacatcctgccagcgttttggatggcgtgagccgggcgcattggtgtgcgccagctcatccattaagatcagcgccggacgccgcgccagggcggcatccaggtcaaactcatccagctcccgccgccggtgagcgatacggcggggcggcagcgtcgccagccccgtcagcatcgccgcggtttccgggcggccatgggtttccaccacgccgattaaaatatccagcccctgcgcccgcaggcgctgcgcttccgccagcatggcgaaggttttgccgaccccggcgcaggcaccaaaaaacaccttcagcttgccgcgatggggggcagcggcctgctccagcaggcggtcaggatccgggcgcaacggctcgtctgtcattcaggattatccttaagcgcgtccagcgcgaggtttaactcaacgatattcaccaccggctcgccgctaaacgcgatgagcggctgctgcgtatggcgttcgaccagctgcgacagcacctctgccgacagcccacgggcctgcgccacgcgcgggatctgccagcgcaccgccgcagggctgaggccataatccagcccgctcgacgaggcggtgaccagctctaccggcacgcgctgatccgcctgggggttggccgcccgcagcgcggcgacgcgctcacggatcgccgtatccagcgccggattgctggccgccagattactgccgccggacgccagcggattataaggcgaatctgaagttacagaagggcgaccgtgaaaatatcccggcgcgctaaagttttgcccgatcagccgcgagccacgaacctcatcttccacgcggatcagcgagccgttcgcctggtcgcggaaccaccactggcccagcacggtagtgaccagcgggtacagcccgccggtgatcaaggttaagaataacaacagcagaacagcaggacgtaaaacagccattttcaggatccttacaccagaccggtgagcgacaacagcaggtcaatcagcttgatgccgataaagggcaccaccaggccgccgagaccgtaaatccacaggttacggcgcagcatggcggaggcgctcaggggcttatagctcacgcctttcagcgccagcggaatgagaaacacgatgatcagcgcgttaaagatcaccgcgcttaaaatcgccgacgccggggagtgcaggtgcatcacgttcagtgcgttcagctgcggataagtcaccgcgaacgccgccgggataatggcgaaatacttcgccacatcgttggcgatactgaaagtggtgagcgagccgcgtgtcatcagcatctgtttaccgatatgcaccacttcgatgagcttggtggggtttgagtccagatccaccatgttacccgcctctttcgcggcctgggtaccggagttcatcgccactgccacatctgcctgcgccagcgctggcgcatcgttggtgccgtcgccggtcattgccaccagacggccatcggactgatactggcggatcagcgccagtttcgcttccggcgtcgcttccgcgaggaaatcatcgacgcccgcttcggcggcaatagccgcagcggtcaggcggttatcgccggtgatcatcacggttttgatacccatggcgcgcaactgggcgaaacgcgccttgatgccgcctttgacgatatctttcagggcgatgacgccgagcaccgttgcgccgtccgccaccaccagcggcgtggagccctgacgggcgacggtttccaccagcgcgtcgacatccggcgggaagtgcccgccgttggcctcgatatggcggcgcagcgcatccaccgagcctttacggatcagacgatcctgaatattgatgccgctcatgcgcgtctgggcggtgaagggcacgaaagtcgcattcaggctctgaatatcccgctcgcgcagattaaagcgctgacgggcgaggatcacgatgctgcggccttccggcgtttcatccgccagcgaggagagctgcgcggcgtctgccagcgcccgttcttccaccccttttaccggcaggaaggcggaggcctgacggttgccgagggtgatggtgccggttttatccagcagcagcacatcgacatcgcctgccgcttccaccgcgcgtccgctggtggcgatcacgtttgcccccagcatacggctcatccccgccacgccgatggcggataacagcccgccgatggtggtcgggatcagacagaccagcagcgccaccagcaccgtcacgctgaccgccgtgccgccgtaagccgagaacggccacagggtcgccgtcgccagcaggaaaacgatggtcagcgccaccagcagaatggtcagcgcgatttcgttcggcgttttgcggcgttgcgcgccttccaccatggcgatcatgcgatcaaggaaggtttcgccagggttaacgctgcactggatcaccagccagtcagaaagaatgcgtgtgccgccggtcaccgaggcaaaatcgccgccggattcgcggatcaccggcgcggattcaccggtaatggcgctttcatccaccgacgcgccgccttcgatcacttcgccgtcgcaggggataatgtcaccggcttccaccagcacaatatcgcccttgcgcagatcggcagcgggcacctgatcctgctgcgcatcgtgacgcggggcgcgcagcttgcgggcaaacgccgttttctgtacccctttcaggctgttggcctgggctttactgcggccctccgccagcgcttcggcaaagttggcgaacaatacggtaaaccacagccagaggctgatggtgccggtaaatccggcgctgcccgacatctgcccggtggccatcgccacgcacagcagggtggtgagcaggctgcccagccagaccataaacatcaccgggttgcgccactgcgcacgcgggcttaatttgcggaaagaatctaaaagtgcctgacgaaccagcgcgggttcgagcagggcaagttgcttgcggctcattgtgtgcgccttaacgtaaggaaagatgttctgcgaccgggcctaaggccagcgcgggaataaaggtcagcgcacccaccagcagcacggtgccgatcagcagaccgacaaacaatgcgccgtgcgtgggcagggtgccgttaccggcgggctggcgttttttcatcaccagcgacccggcgatagccatgaccgggatgatcaccccgaagcgcccggcgaacatgcagaccgccagcagacagttccagaacggcgtgttggcgctcagtccggcaaaggcgctgccgttgttgttcgcggcagacgacaccgcatacagcacttcgctgaagccgtgggtgccggggtttaacatgcctgcgcgtccggcctcggtcatcatcgccagcgcggtgccgagcagcaccagcagcggggtgacgaggatcgccagcgcggtcattttcatctcgcggacgtcgatttttttgccgaggtattccggcgtgcggccaatcatcagcccggcgataaagactgccagcaggacgaacagcaacatgccgtacagaccggatccgacgccgccgaacaccacttcgccgatctgcatcagccacagcgggatcatgccgcccagcgcggtgaaagagtcgtgcatggcgttcaccgcaccgcaggaggccgccgtggtgaccactgcatacaggctgctcgccagaatgccgaagcgactctctttgccttccatattgatgtggctgtctgcgccaaacgccgtgaggttagcgttgccgtgcagctcgccccacattaccagcgcaacgcagaccacgaagatgatggacatcgcccagaggatcatgtgaccctggcgtttatcgccgaccgcgtcgccaaaggcgaagcagagcgcggcggggatgataaagatcgccagcatctgcaccaggttggtcagcgcggtggggttttcaaacggatgcgaggagttggcgttaaagaaaccgccgccgttggtgcccagcagtttaatggcttcctgcgaggccaccggtcccatcggcagcaccgacttcgccccttccagcgaagtaaagggctgataggcatcgatgttttgcagtacgccctgttgcataaagaacagcgccagcagcagcgagagcggcagcaggatccacagggtaatgcgcgtcagatcgacccaggcgttacccagcgtattaacgctttgtcgggcgaacgcgcggatcagcgcaaagagcaccgcaatgccggtagcggcagagaggaagttctgtaccgtcagcccgaccatctggctgaaatagctgagcgtgctttcaccggcatacgactgccagttggtgttagcgacaaaactcaccgcagtattcagcgccagatgccatgacaggccaggcagttgctgcgggttcagcggcagatgatcctgcaccatcagcatcgcgaacagcagcaccagcccgcaaatattgatcgcaagaatggcgaacagatattgccgccagttcatcggcgacggattaatgcccagcccgcgccacagcaggttttcaacgccccccgtgcctgcaaggggcgcaccgcgcaccatttttgccagtacgccgcccagcggtcgtgccagcaccatcagcaccagcataaagctggcgatcagtaaaaacgcctgagccgccatcagaaggcctccgcgtttatcagggcgtaaaccagatagcccaacaacaggaaaaccagtaccacaccggttattacgcctgcactcacaatccacctccaggtgtcttttgttaacgtagtgaaggtaggattttcggtgcaaagatttcgcaaaaatcaggcgggcgggtgtaaaaaaagtataaaaatgaaaaatggcacaatttaactaaggtttagtatttatttaactattttgtaacttaattacggtgggttgtgtaaatattggctaaacaggtgaaaaatagtggtcggatgagtagtaaaattacaaacaaaacggtactattttaaccagttcagcagattcatttttacggtgaatgttaccgaccaacaaaagggggaagcttatgtctttatatcgggaatatcctgcacacgtcattttcgtacgccgcgctttcgccgttgcggcaggcatcatcgcattaccggtgatgttattctggaaagatcgtgcacgtttttacagctatctgcatcgggtctgggcgaaaaccagcgataagccggtgtggatggatcaggccgagaaagtcgcctgcgatttctactaagaagcaaagcgcacacagcaaactacaagcccatgcggcaaaaaaagaaaaaccgccaaatctgatttggcggtttttttatgcctgtagatccgctattcattgtgaaacgtgttcggttgctgcttttaccagcagtcagctgttcatcacgtgttccacgcaaaccggcgcggtattttttgatgttctcaggctacactcattttacgggctaaaaggagtcgttatgagtgagaaaatccctgttggcatcagcgcctgtctgttaggggaacaggtgcgttttgatggcggccataagcgtctggcgtttgcggttgaagagttatcgccgctgatgaaatttgagccggtatgcccggaaatggcgattggcctgccggtgccgcgtccggcgctgcggctggtaaaaaaggatacgggtgacctctcgctgcgcttcagcgacgggcgcgaaggcgacctgacgcaggacatgatcgactttgcggaaaaacgcatcagtcagtttgaccgcctgtgcggttatatcgtctgcgccaaatcccccagttgcggcatggagcgggtgcgcgtctacgaactggaaaacaataataaccgtaaagccgggcgcggcatctataccgacgtgctgatgaaaactttcccctggctgccggtggaagaagacgggcggctgcacgatcccatgatccgcgaaaacttcgttgagcgcgtctatgccctgcatgaactgaacagcgtgcgcgagcgcggcctgacccgcggcgagcttatcgcctatcacagccgctacaaactcctgctgctggctcattcacagcccaaataccgcgaactgggacgcttcgtggcggccatacatgaatggtcatcgctggaggagtggtttgtcgaatatcgtctgcggctgatggatctgctttcccatcaggccacgcgccgcaaccatacaaacgtgctgatgcacgtgcagggctatttccgcaaacagcttaacgcgcgccagcgcgaagagctctcctcgcttattgaccgctaccgtcagggcacgcagccgctgctcgccccggtcaccttacttaaacactatatggccgaattcccggacgcttatctgtcgggacagcgctattttgatccctggccggaaacgcttcgtcttcgctacggacattaattcaggagagttatgaccacgcatctggtctggtttcgcgcggatctccgcgtgaacgataattttgcgctcgcggcggcctgccgcaatccccatgcccgcgtactggcactctttatcgccacgccacagcagtgggaaaatcacctgatggcgccccgtcaggcagcctgtatgcaggcgcagttaaacgatcttcaacagtcgctggcggagcgcggcattccgctgatttttaaagaagtggatgactttgctgccagccagcaggtagtaaaagaactctgcgaggcgcagcaggtcacgcatcttttttataattatcagtatgaaatcaacgagcaccagcgcgaccgcgcggtggaaaaactgctgccggaggtggtgtttcagggcttcgatgacagtgtgctgcttgctccgggcagcgtcgtcaccggcaatcatcagatgtacaaagtcttcacgccctttaagaacgcctttttacggcggctgcgtgaggatctccccgaatgcgtccccgcgccaaaagtacgtgaaggcggcgcactcagcgaccctctcacgcccatcgggctgaactatccgcagcaggattttgatcgtgagctgttcccgtgcagcgaaaaagccgccatcgcccgtttgcgggaattctgccagcagggggcaggggaatatgaggcgcggcgggattttccggctatcgacggcaccagccgcttatccgtttgtctggcgattggctcgttatcgccgcgccagtgtctgcatcgcctgctgaaagagcagcccgatgcgctgggcggcggcgcaggggcggtatggctcagcgagctgatctggcgcgagttttaccgccatctgatgacctttcacccggagttgtgcaagcaccagccctttatcgactggacgcgtcgcgtgcagtggcaggataacgacgcgcatttccgggcgtggcaggagggtaacaccggttacccgattgtcgatgccgccatgcgtcagatgaatgaaaccggctggatgcacaaccggctgcgcatgatcaccgccagtttcctggtcaaagacttacttatcgactggcgcgccggagagcggtactttatgtctcagttgattgacggcgatctggcggccaataacggcggctggcagtgggcggcctccaccggcaatgattccgcgccgtactttcgtatttttaaccccacgacgcagggcgagcgattcgataaagacggtgaatttattcgccgctatattccggcgctggcgaaggtgcccgccaccgcgctgcatgagccgtggaactgggccgataaacagggcgtgaccctcgattatcctcgccccattgtcgatcataaaaaggcccgcgttgccacgctggcggcgtacgaagccgcgcgaaaatcgtaaaggagaggcacgatgaaaaatagcgatctggaaaaactgatcaacgacaaactcaacagtggcgcgttcagcgattacggcccgaacggactccaggttgaagggcgcgacagcgtacaaaaaattattaccggcgtcaccgccagccaggcgctgctggatgaagccgtgcgcctgggcgcggacgcggtgatcgtccatcacggctatttctggaaaaacgaagcgccgatcattcgcggcatgaagcgtaaccgcctgaaaaccctgctggccaacgacatcaacctctacggctggcacctgccgctggacgcgcacccggagctgggcaacaacgtgcagctggcgaagctgctcggcatcacggtgatgggccaggtggacgatctggtgccctggggcgagctggcgatcccggtgcccggcccggagctggcttcgtggatcgaagcgcgtctggggcgcaggccgctgtggtgtggcgacaccgggccggaggagatccggcgtgtcgcatggtgcaccggcggcggtcagggctttatcgacagcgccgcgcgttttggcgtggatgcctttatcaccggcgaagtttcggagcagaccattcactccgcccgtgagcagggcctgcatttctatgcggcgggtcatcacgccaccgagcgcggcggtattcgcgccctgagcgaatggctgacggaaaataccgatctggacgtcacctttattgatattcctaatccagcctgatgcgaggagcgaaagtgcagcgagcgcgttgttatctgttaggtgaaacggctgtcgtgcttgaacttgagccgccggtcacgctggccagccagaagcggatctggcgactggttcagcgggcgatgaccatccccgatgtggtggatgtcattcccggtatgaataatgtcaccgtggtattgcgcgatccccagggaaacgcgctggatgccattgagcgtttacagcgctggtgggaggagagcgaggcgctggagccggatccgcgcttgattgaaatcccggtgatctacggcaaagaggacggccccgatctgccgcacgtcgccagccactgcggcctgagcgaaaaacaggtggtggagctgcacgcgtcggtggattaccaggtctggtttctcggttttcagccgggctttccctatcttggcagcctgcccgcacagttagcgaccccgcgccatgcggagccgcgccttagcgtgcctgccggatcggtgggcatcggcggcgagcagaccggcatctatccgctgccgacgcccggcggctggcagctgattggccgcacgccgctggcgctctttgatccgcacagcgctgaacctgttctgctgcgccccggcgacaccgtgcgttttgtgccgcaaaaggagggcatatgctgaagattattcgcgcggggatgtatacctccgtacaggccggaaaacgcaaagggctgcgccagtccggcatcagctatagcggcgcgatggacggcccggcgctggaaatcgccaatgcgctggtgggcaacgaggccgacgccgccgcgctggaaattacgctcggccagtgcgaaatcgaattcacccacgacggctggtttgcgctgaccggcgcaggctgcgacgcgcagcttgacggcaaagcggtgtggaccggctggcgtcaggcgatgagcgcagggcagcgtttgaccctgaaaagcccgcagcgtggtatgcgcagttatctggccgtggcgggcgggatcgatgttccggaagtgatgggctcgcgcagtaccgatttaaaaaccggcaccggcggctttaagggccggttgctgaaagagggcgacgtgctgccggtgctgcccgcgtcgcggcagttcagcggtccgcagggcgtcaaacagttactctggggcaaccgcatccgcgtgctgccggggccggaatatcactccttcgataaaaactcccttgaggcgttctggcgcttaccctggcagttaagcccgcagagtaaccgcatggggtatcgtttacagggggcgcagctgacccgcaccgacacccgcgagctgctgtcccacgggctgatccccggcgtcattcaggtgccgcacaacggtcagccgattgtgctgatgaacgacgcccagaccaccggcggctatccgcgtatcggctgtgtgatcgaagcggatatgtatcatcttgcgcagatccgcctcggcgatccgatccattttgtgccctgcacgttagaagaagcgctgaaggcgcgacgcgagcagcggctgttccttgaccagctggcttacggagtgcgcggtgatcgttgatcttaatgccgatctgggggagggcgcgggctgtgacgccgcgctgctgcaactggtttcttctgccaacatcgcctgcggttttcacgccggtgacgcgcagatgatgcaggacgcggtacgcgaagcgctgaaaaacggcgtcgccattggcgcgcacccctccttcccggatcgggaaaactttggccgcacggcgatgacgctgcctgcggacaccgtttatgcgcagatgctgtatcagatcggcgcgctggcggccattgccagggcgcagggcgggcaggtgcagcacgtcaaaccccacggcatgctctataaccaggcggcgcaggacgcggtgctggcggatgccatcgcccgcgcggtgcacgatctggatccgacgctcattctggtggggctggcgggtagcaagctcatcgacgcgggcaggcactatggcctgccaacgcgcgaagaagtctttgccgaccggggatatcaggacgacggcactctggtgccgcgctcgcagcccggcgcgctcatcagcgatgaagagcaggcgctggcgcagacgctgaccatgatccagcagggccgggtgaaaagcattcacgacaattgggtgaaggtgaacgcgcaaaccgtctgtctgcatggcgacggcgatcatgcgctggcctttgcgcgccgcctgcgacaggcgtttgaggcacataacattaccatttcggcggtgcagcatgcctgaaggcccggagatccgccgggcggcggatacccttgaagcggctatcggcgggcaaccgctgaccgacgcctggttcgcctttgaccgtctgcaaccctacgccgctgatcttatcggccagcatgtgacccatatggagacgcgcggtaaagcgctgctgacgcatttttccggcggcctgacgctgtacagtcataatcagctgtatggcgtctggcgcgtggtaaaagcgggggaaacgccgcagacgacgcgtattctgcgggtgaagttgcagaccgccgaacgcgcaatactgctctacagcgcctcggacattgagatgctgacaccggagcagctggcaagccatccgttcttacagcgcgtcggccctgacgtgctggacatgagcctgacggtggaggaggtgaaagcgcggctgtgctcgccaaaattctgccgccgacagttttccggtctgctgctggaccaggcgtttcttgccgggctgggcaattatctgcgggtggagatcctctggcacagcgggcttgcgccaacgcataaagcggcgcaattaagtgacgcgcagatcgaggtgctggcgcaggcgctgctggatattcccaggctctcgtaccagacgcgcggcaaggcaaaagagaacaaacatcacggggcgctgtttcgctttaaggtgtttcaccgggcagggaagaaatgtgagcggtgcggggggatcattgagaaaaccacgctgtcgtcgcggccgttttactggtgtccggggtgtcagatttgatgtgaaaagccgggtggcgctgacgcttacccggcctgtggttactggctgaattcgtaggcccggcaagcgaagcgccgccgggcgccacaaaccttagcggttcgtcagttccgatttgaaatcacgctgctcgtaaccggtgtacagctggcgcggacgggcgatcttgatgccgtcgtcgtgcatttcgttccagtgcgcgatccagccaacggtacgggccatcgcgaagatcaccgtaaacatggaagacggaatacccatcgctttcaggatgataccggagtagaagtccacgttcggatagagcttacgctcgatgaagtacgggtcgttcagcgcgatgtgttccagctccatcgccacttccagcagatcatctttggtgcccagctctttcagcacttcgtggcaggtttcacgcattacggtggcgcgcggatcgtagtttttgtaaacacgatgcccgaagcccatcagacggaacgaatcgttcttgtctttggcgcgacgcacgaattccggaatgtgctcaacggtgctgatctcttccagcattttcagcgcagcttcgttcgcgccgccgtgtgccggtccccacagggaagcgatacctgccgcgatacaggcaaacgggttcgcgccggaggagcctgcggtacgcacggtagaagtagaggcgttctgctcatgatccgcgtgcagcacgaggatacgatccatcgcgcgttccagcaccgggttcacttcgtacggctcgcacggcgtggagaacatcatatgcaggaagttaccggcataggagagatcgttacgcggataaacaaacggctggccgatagaatatttgtaacacatggcggcgaccgtcggcattttggacagcagacggaatgcagcgatgtcacggtggcgcggattgttgacgtccagcgagtcatgatagaaagccgccagcgcgccggtcacgccgcacagcacagccatcgggtgtgaatcgcgacggaaaccgtggaacagacgggtgatctgctcgtggatcatggtgtgacgggtgacgatggtgcggaaatcgtcatactcttcctggctcggtttttcaccgtacagcaggatgtagcacacttccagatagttggattcagtggctaactgatcaatcgggaaaccgcgatggagcaggataccttcgtcaccgtcgataaaggtgattttggattcgcaagatgcggtagaggtgaaaccagggtcaaaagtaaatacccctttcgaacccagactacgaatatcaataacatcctgaccgagcgtgccttttagcacatccagttcaatagcatcttcactattgtaagtgatggttgctttcttatcagccatttacggtctccttagcgccttatgcttaagactgcacagaagccggatttgcattcatagcgaaaatcaatgttaccaatttgttatttggcacgacactctgcagagaggtggtaccagggtacagagcgatgggcgctggcaggcaaacattgaaaaaccagtgaaacaacagcaaatcagggtcttagcagtccgaatttgtcaaatctgtctatcactaataactgtactgataacgtcggtcaatccttctcactcttacataactaaatctcaggtgaaagagagaccccataacttttacgaattatatgccttttcggctgtcgtttgtaacaataatgtttaactattgtcaaatcccatggttaaaaattaaaaatatgttgttatcgtgatgacggtcactgttccgcataaaacccgacaaactatatgtaggttaattgtaatgattttgtgaacatcctatactgccgccaggtctccggaatcctctgccgtcccgagccacccagcgttgtaacgtgtcgttgagcatctggaagcgatgttatttgcataacgtgcggttattgaaaggacgctgtctgacccgcctgcagaccggaggaaaggaactataagaacagcatgtgggcgttattcatgataaaaaatgtcaaaaaacaaagacctgtcaatctggatctgacaacgatccggtttcctgttacggctatagcgtccattctgcaccgtgtttctggcgtcatcacttttgtggcggtcgggatcctgctgtggttgctgggcctgtcgctctcctctcaagaaggcttccagtcagccgccgccatcatggacggcttcttcgctaaattcatcatgtggggcattctcaccgcgctggcatatcacgccgtcggtggtattcgtcatgcattgatggatgtgggctatcttgaagagaccttcgaagccgggaaacgctctgcctgggtcgctattggtattactgtcgtgctttcaattctcgcaggagtcctcgtatggtaagcaacgcctccgcattcggacgcaacggcgtacatgacttcattcttgttcgtgctaccgccctcgttctgacgctttacatcatctatatggtcggttttttcgccatttccggcgagatcacttatgacgtctggacgggtttcttctcatccgcctttaccaaagtcttcaccctgctggcgctgttctccacgttaattcatgcctggattggcatgtggcaggtgctgaccgactacgttaaatcaacgggcctgcgtcttggtctgcaactcgccattgtggttgcgctgctggtttacgttatttatggatttgttgtggtgtggggtgtgtgatgaatttaccagtcagagagtttgatgcagtcgtcattggtgccggcggcgcaggtatgcgcgcggcgctacaaatttcccagagcggccagacctgtgcgctgctctccaaagtattcccgacccgttcccacaccgtatctgcgcagggcggtattaccgttgcgctgggtaacacccacgaagataactgggaatggcacatgtatgacacggtgaaaggttccgactatatcggtgaccaggacgccattgaatatatgtgtaaaaccggcccggaagcgattctggaactggaacatatgggtctgccgttctcccgtctggaaaacggctctatctatcagcgtccgtttggcggccagtcgaaaaacttcggcggcgagcaggcggcacgtaccgccgcagcggctgaccgtaccggccacgcgctgttgcataccctttatcagcagaacctgaaaaatcacaccaccattttttccgaatggtatgcccttgacctggtaaaaaaccaggatggcgcggtggtaggttgtactgcgctgtgcattgaaaccggcgaagtggtgtacttcaaagcccgcgctaccgtgctggcgacaggcggcgcaggccgtatttaccagtccaccactaacgcccacatcaataccggcgacggtgttggcatggcgctgcgcgctggcgtgccggtgcaggatatggaaatgtggcagttccacccgaccggcatcgccggtgcaggcgttctggtgacagaaggctgccgtggtgaaggtggttatctgctgaacaaacacggcgagcgctttatggagcgttatgcgccgaacgccaaagacctggcgggtcgtgacgtggtggcgcgttccattatgatcgaaatccgtgaaggtcgcggctgcgacggtccgtggggtccgcacgcgaaactgaagctcgaccacctgggtaaagaagtgctggaatcccgtctgccgggcattctggaactttcccgcacctttgcgcacgtcgatccggtgaaagagccgatcccggtgatcccgacctgtcactatatgatgggcggtattccgaccaaagtgaccggccaggcgctgaccgttaacgcccagggcgaagacgtggtgatcccgggcctgttcgcggtaggcgaaatcgcctgcgtatcggtacacggcgctaaccgcctgggcggcaactcactgctggatctggtggtatttggtcgcgcggctggtctgcacttgcaggaatctatcgccgagcagggcgcactgcgcgatgccagcgaatccgatatcgaagcttccctgacccgcgtgaatcgctggaacaacacccgtagcggtgaagatccggtgaccattcgtaaagcgttgcaggaatgtatgcagcataacttctcagtattccgtgaaggggatgcgatggcgaaaggactggagcagctgaaagagatccgcgagcgtctgaaaaccgcgcgtctggacgatacctccagcgacttcaacacccagcgcgtcgaatgccttgaactggataacctgatggaaacggcttacgccacggcagtatcggcgaacttccgtactgaaagccgtggagcgcacagccgctttgacttcccggatcgtgacgacgaaaactggctgtgccactccctgtatctgcctgaatcggaatccatgacgcgccgtagcgtcaatatggaaccgaaactgcgtccggcattcccgccgaagattcgtacctattaatgcggagacaggataaatgaaactcgaattttcgatttatcgctataaccctgatgtcgacgacgcgccgcgtatgcaggattacaccctggaaggcgaagaaggccgcgacatgatgctgcttgatgcgctgatgcagctgaaagaaaaagatccgacgctggcgtttcgtcgctcctgccgtgaaggcgtgtgcggctccgacggtctgaacatgaacggcaagaatggcctcgcctgcatcacgccgatttcggcgctgggtaacggcacgaagaaaattgtcatccgcccgctgcccggtttgccggtcgtccgcgatctggtggtggacatggggcaattctatgcccaatatgagaagattaagccttacttgttgaataatggacataatccgccagctcgcgagcatcttcagtcgccagagcagcgtgaaaaactggatgggctgtacgagtgtattctctgtgcatgctgttccacatcctgtccgtcattctggtggaacccggacaagttcatcggcccggcgggtctgctggctgcgtatcgcttcctgatcgacagtcgcgataccgaaaccgatcagcgcctcgaagggctgagcgatgctttcagcgtatttcgctgccatagcatcatgaactgcgtcagtgtgtgtccgaaggggctgaacccgacgcgcgccatcggccatattaagtcgatgctgctgcaacgtagtgcataagtaagattgccggatggcgctgcgcttatccggcctacagttaagtaggcccggtaaacgcagtgccaccgggcaaaccgagtgaaaatgcaggaaacctctaaaaactgccctgacagagagacagtttttaaaggttccttcgcgggccaactcagtgaaaagagctcgcaagtgaaccctggtacgtgcgcctggcggtgtacggtgtagttatccacggcgaataagcataccaatgcttaagggatcacgatgcagaacggcgcaatgaaagcctggctggactcttcttacctctctggctccaaccagagctggatagaacagctctatgaagacttcttaaccgatcctgattcggtagatgaaaactggcgctctatgttccagcagctaccggtgaccggtatcaaaccggaccaattccattccaaaacacgtgattatttccgtcgtctcgcgaaggatgcctcacgttatacctcttcagtttctgaccctgacaccaacgtgaagcaggttaaagtcctgcaattgatcaacgcctaccgcttccgcggccaccagcatgcgaatctcgatccgctgggactgtggaaacaagagcgcgtggccgatctctccctcgattatcacgacctgaccgaagccgatctggaagaaagtttcaacgtgggatcttttgccatcggcaaagacaccatgaaactgggcgagctgttagaagcgctgaaacaaacctattgcggttcgattggcgcggagtacatgcacatcaccagcaccgaagagaagcgctggatccagcagcgtatcgaatcggcagcgggtcatggcattttcagcgccgaagagaaaaaacgcttcctcagcgaactgacggcggcggaagggatggagcgctatctgggcgcgaaattccctggcgcgaaacgcttctcgctggaaggcggcgacgcgctggtgccgatgctcaaagagatgatccgtcatgccggtaagagcggcacgcgcgaagtggtgctgggtatggcgcaccgcggacgtttaaacgtgctgatcaacgtgctgggcaaaaaatcccaggatctgtttgacgaattcgccggtaagcataaagaacatctgggcacgggcgatgtgaaataccacatgggcttctcctcggatatcgaaaccgaaggcggcctggtgcacctggcgctggcgtttaacccgtcgcacctggagatcgtcagcccggtggtaatgggttctgtgcgcgcccgtctggatcgtctggacgagccgagcagcaacaaagtactgccgatcaccattcacggcgatgcggcggtaaccggccagggcgtggtgcaggaaaccctgaacatgtcgaaagcgcggggctacgaagttggcggtaccgtgcgtatcgtgatcaacaaccaggtgggctttaccacctctaacccgctggatgcccgttccacgccgtactgtactgacatcggtaaaatggtgcaggcgccgattttccacgtgaatgcggacgatccggaagccgttgctttcgtcacccgtgtggcgctggatttccgtaacaccttcaagcgcgacgtgtttatcgatctggtgtgctaccgccgtcacggccataacgaagccgacgagccaagcgcaacccagccgctgatgtaccagaaaatcaaaaaacatccgacgccgcgcaaaatctacgccgacaagctggagcaggaaaaggtcgccaccctggaagatgccaccgaaatggtcaatctttaccgcgacatgctcgatgcgggtgaatgcgtggtgaaagagtaccgtccgatgaacatgcattcgttcacctggtcgccgtatctgaaccacgagtgggatgaaagctacccgaacaaggtagagatgaaacgtctgcaggagctggcgaagcgcatcagtacggtgccggatgccatcgaaatgcagtcccgcgtggcgaaaatttacggcgatcgtctggcgatggcggcaggcgagaagctctttgactggggcgcagcggaaaaccttgcttacgcgaccctggttgatgaaggcatcgcggtgcgtctgtccggcgaagatgccggccgcggcaccttcttccaccgtcatgcggtgatccataaccagaccaacggctccacctggacgccgctgcatcatgtccacaattcacagggcactttccgcgtctgggactccgtgctctctgaagaagcggtgctggcgttcgaatacggctacgcgactgcagaacctcgtaccctgaccatctgggaagcgcagttcggcgacttcgctaacggcgcgcaggtggtcattgaccagttcatcagctccggcgagcagaaatggggccgtatgtgcggtctggtgatgctgctgccgcacggctatgaaggtcagggtccggagcactcctccgcccgtctggagcgttacctgcaactctgtgcagaacaaaacatgcaggtctgcgtaccgtccacaccggcgcaggtgtaccacatgctccgccgtcaggcgctgcgcggtatgcgccgtccgctggtggtcatgtcgccgaaatcgctgctgcgtcatccgctggcggtatccagccttgacgaactggcgaacggcaccttcctgcctgctattggcgagatcgacgatatcgatccgcagggcgtgaagcgggtcgtgctctgttctggtaaggtttattacgacctgcttgagcaacgtcgtaagaacgaccagaaaaacgtcgtcatcatccgtatcgaacagttgtatccgttcccgcaccaggcggtgcaggaagccttaaaaccttatgcccatgtgcatgattttgtctggtgccaggaagagccgctgaaccagggcgcatggtactgcagtcagcatcatttccgcgaagtgatcccgtttgggtccgctctgcgttatgccggtcgtccggcctccgcctctccggcggtagggtatatgtccgttcaccagaaacagcagcaagatctggtcaatgacgcgctgaacgtcgattaattaaaggataaataatgagtagcgtagatattcttgttcccgacctgcctgaatccgttgcagacgcgactgtagcgacctggcacaaaaaaccaggcgatgcggttacccgtgatgaagtgctggtagaaatcgaaactgacaaagtggtactggaagtaccggcgtcggccgacggcattctggacgcggtgctggaagaagaggggaccaccgtcacctcccgccagatcctgggtcgtctgcgcgaaggcaacagcgcaggtaaagagagcagcgcgaagtccgacagcaatgagtccactccggctcagcgccagcaggcatccctggaagaacagaataacgaggccttaagcccggcgatccgtcgcctgctggctgaacatggtcttgaagcgggtgcgattaaaggcaccggcgtgggtggccgtctgacccgcgaagatgttgaaaaacatctggcgaaagcgcctgccgcaaaagaagaaaaagcgccggctgcaccggctcctgccagcgcgccgtcccagtctgcgccagcgctgggcaaccgctccgaaaaacgcgtgccgatgacccgtctgcgtaagcgcgtggccgagcgtctgctggaagcgaaaaactcaaccgccatgctgaccacgttcaacgaagtcaacatgaagccgattatggatctgcgtaagcagtacggtgacgccttcgaaaaacgtcacggcatccgtctgggctttatgtccttctacgtgaaagccgtggtggaagccctgaaacgcttcccggaagtgaatgcctccattgatggcgatgatgtggtgtaccacaactatttcgacgtcagcatggcggtgtccaccccgcgtggtctggtcacgccggtactgcgtgacgttgacgcgctgggcatggccgacattgaaaaacgcatcaaagatctggcggtgaaaggtcgcgacggcaaactgaccgttgaagatctgaccggcggtaacttcaccatcaccaacggtggtgtgttcggttccctgatgtccacgccgatcatcaacccgccgcagagcgccattctgggcatgcacgccattaaagatcgcccgatggcggtggatggcaaggttgagatcctgccgatgatgtatctggcgctgtcgtacgatcaccgcctgatcgatggccgtgaatcggtgagcttcctggtggccattaaagagctgctggaagatccgacgcgtctgctgctggacgtgtagtaataagaagatcacctgctccgtaggcctgataagacgtgacaacgtcgccatcaggcgttgcaccatcgccggatggtggcgttaccgccttatccggcctacggatctaaaaaacgattacctgaaaagtggatagaacacatgaacttacatgaataccaggcaaaacaactttttgcccgctatggtttgcccgcgccggtaggctatgcctgcaacactccgcgcgaagccgaagaagccgcgtctaaaatcggtgccggtccgtgggtggtaaaatgtcaggttcacgccggtggccgcggtaaagcgggcggtgtgaaagtggtgaagagcaaagaagagatccgtgcttttgctgagcactggctgggcaagcgtctggtgacctaccagacagacgcccacggtcagccggttaaccagatcctcgtggaagccgcaaccgacatcgataaagaactgtatctgggcgcggtagtggatcgcagctcccgtcgcgtggtgttcatggcgtctactgaaggcggcgtggaaatcgaaaaagtggcggaagaaaccccgcacctgatccacaaagtggcactggatccgctggccggcccgatgccgtaccagggacgcgaactggcgttcaaactgggtctgcagggcaaacaggttcagcagttcaccaagatcttcatgggtctggcgaacatcttcctggagcgcgatctggcgctgatcgaaatcaacccgctggtgatcaccacccagggcgatctgatttgcctcgacggcaaactgggcgctgacggcaacgcgctgttccgccagccggatctgcgcgaaatgcgtgaccactctcaggaagacgcccgtgaatctcaggcggcacagtgggaactgaactatgtggcgctcgatggcaacatcggctgcatggtgaacggtgcgggcctggcaatgggcaccatggacatcgttaagctgcacggcggcgaaccggctaacttccttgacgtgggcggcggcgcgaccaaagagcgcgtaaccgaagcgttcaaaatcatcctctctgacgacaaagtgaaagccgttctggttaacattttcggcggcatcgtacgttgcgacctgatcgctgacggcatcatcggtgcggttgaagaagtgggcgtgaacgtgccggtcgtggttcgtctggaaggtaacaacgccgaactgggcgcgaaaaaactggctgacagcggcctcaatattatcgcagcgaaaagtctgacggatgcagcacagcaggttgttgccgcagtggaggggaaataatgtccattttgatcgataaaaacaccaaagtgatctgccagggcttcaccggcagtcagggcacgttccactctgagcaggcgattgcctacggtacgcagatggttggcggcgtgacgccaggcaaaggcggtaccacgcacctcggcctgccggtgttcaacaccgtgcgcgaagcagtagaagccaccggcgcgaccgcgaccgtgatctacgttccggcgccgttctgcaaagactccattctggaagctatcgacgcaggcattaagctgatcatcaccatcaccgaaggcatcccgacgctggatatgctgaccgtgaaagtgaagctcgacgaagcgggcgtgcgcatgatcggcccgaactgtccgggcgtgatcacgccgggcgaatgcaaaatcggcatcatgccgggccacattcaccagccgggtaaagtgggcatcgtctcccgctccggtaccctgacctatgaagcggttaagcagaccaccgactacggcttcggccagtccacctgtgtgggcatcggcggcgatccgatcccgggctctaacttcatcgacatcctgaagctgttccaggaagatccgcagaccgaagcgatcgttatgatcggtgagatcggcggcagcgcggaagaagaagcggcggcgtatatcaaagatcatgtcaccaaaccggttgtcggctacatcgcaggcgtgaccgcgccgaaaggtaaacgtatgggccacgcaggcgcgatcatcgcgggcggcaaaggcacggcggatgagaaattcgcagcgctggaagcagcaggcgtgaaaaccgtgcgcagcctggcagacatcggcgaagcgctgaaaagcatcatctgatcttactgaagtaagacaataataacgttcgacatggttggccatcgcaagatggccttttttattgccgccgttttgccaccagcgtgaatttatagtcgtcgcttttgaacagattgcggctgtactcgaacacttccccgcttttcagaaaaccgcgtgagatcttctcaaggatcggtctggcaggatcaatccccagcgcgtcgaccgcctcctcgtcgggcatcaccggcacgatctcctgctcgctgcgatcgataacccgctttttcacctgctcgataaaatggtatttggagttttccatcacctcccaggtgagatcaggaaagagcgcaagcggcatccaggtctcttccagcgccaccggcttttgcctgataaagcgcacccgcttcacatgccaggctttatcaccaggggtaaggtgcagctgcgccgccagcgtttcatccgttttgatcacttcgaacacctgcacttcgctgtgcgtatcggcatgacgatcgccgagcttttccgaaaagctggtcagctgatagatgtcgtaattcacgcgctcctctttcacataggagccgctgccctgaatgctttcaataattccctgttccgtgagctgtttcagcgcctggcgcaccgtgacccgactgacgctaaactgcgcctgtaaggccgactcggtaggcagcgcatcccccggcttcagttcgccgctttcgatctgcgtgcggatcgccccggcgatctggcggtacattggctgtctgctcatggaaccctcgtgttgtaccagacaaatatccccgattatgcccggcgcggcgctgaagtaaataatacaaatttaatacaactattcattaagttgaatttgatcgcaaaattgtatggttagatcgcacagaatgccttcgtctgaagccgtcatggtggcggcttacccaggactcaatgaggaagagatgaacctgacggcattaactcacccggacgcctgcctgatccagacgcagttcgtcagtcgggacgacgccattcgtgcactggccgtgcggctgcaccagctgggcaacgtgcgcaatctggatgaatttgtgaacgaagtgctgcgccgcgaagcggatggcccgacggcgctcggggaagggctggcggtgccgcacggcaaaaccgacgcggttgtagaggcggccttcgctgtcgccaccctgcgtgagccgctgatgtgggaaggtatcgatggcccggagccggtgacgctgattgttctgcttgccattccctgcgccgaagccgctaccacccatatgcaactgctgacccggctgaccagtctgctggcggatgacgccctgcgcgaacaggtgcagggggcaaacaacgccgacgaactgctggcgctgctggcagaggcacccgcagagaaaacgccgctaaccctgcgcgatgcgccgacggtggtctgcgtcaccgcctgtccggcgggcatcgcccacacctatatggcggcggaatatctggaaaacgccgggcgcaggcgcggcattcaggtgtatgtcgaaaagcagggggcgaacggcattgaggggcgcttaaccagcgagcagctgaaagccgcccgcgcctgtatcctggcggctgatgtggcggtaaaggacgccgaacgctttcagggtatcccgacgctggcggtaccggtggcggaacccattaaacaggccgatgcgctgcttacccgggcgctggcgcttgatgccagcaccgaaccccggacggcggcaccccttagcgttaaaaccgagctgaagcaggcgctgctgagcggtatttcctttgccgtgccgctcatcgtcgcgggcggaaccgtgctggcggtgtcggtgctgctggcgcagattttcggtctgcaacacctgttcgagctggaaaactcctggctgtggctgtaccgcaaactgggcggcggcatgctcggcaccctgatggtgccggtgctggcggcctacactgcgtattcgctggcggataaaccggcgctgaccccaggcttcgcggcggggctggcggccaatatgataggcgcgggctttctgggcgcggtggtgggcgggcttatcgctggctacctgatgcgccaggtgaaaatccatatccggctgggcagccgttataacggctttctgaccttttatctctatccggtgctgggcacgctgggggcgggcagcctgatgctgtttgtcatcggtgagccggtggcatggctgaaccagggactcaccgcctggctgaacggcttgtccggcagcaatgcactgctgctgggcgctattatcggctttatgtgttcctttgaccttggcggcccggtgaataaagccgcttacgccttctgcctgggggcgatggcgaacggcgtatacgggccttacgccatttttgcggcggtaaaaatggtctctgcgtttaccgtcaccgcctcgaccctgcttgctccccgcctgttcagagcatttgaaatcgaaaccggtaaatctacctggctgctggggctggcggggatcaccgaaggggcgatcccgatggcgattgacgatccgctgcgggtgatcggcgcttttgtgatcggatcgctggtcacgggggcgctggtgggtagcgcgggcatcgggctgtcgacgccgggggcggggatcttctcgctgtttttactgcatgacaacgggctggggggcgttaccgccgccgccatctggtttgccgcggcgctgctgggcgcggcaatttccaccgctattttgctggcatggcgtgctcacgcggtgcgtagcggcacatatcttaccgatcgccattaaaggacagaacgatgaaaaaggtatcgcgcgtgcacatcacgccgcatatgcactgggatcgtgaatggtacttcaccagcgaagagtcgcgcattttactggtcaacaatatggaggagatcctcacccgcctggagcaggatgcggagtacaaatactacgtgctcgacgggcaaacggcggtgctggaagattatctcgccgttaaaccgcagaacgcgccgcgcataaaagcgcaggtccaggcgggaaaactgatcgtcggcccctggtatacccagaccgacacctgcatcgtggcgggggagtcgattgtgcgcaatctgctgtacggcatgcgcgactgccgggcctttggcgagccgatgaaaattggctatctgccggactccttcggcatgtccggccagctgccgcacatctataacggttttggcattacccgcgccatgttctggcgcggctgttcagagcggcacggcaccgacaaaaccgagtttatctggcaaagccgcgacggcagcgaagtcatcgcccaggtgctgccgctgggctatgcgatcggcaaatatctgccggaagacgaagcgggtttgcgcaagcggctggagagttactttgcggtactggaaaaggcctcgctgaccggggagatcctgctgccaaacggtcacgaccagatgccgctccagcagaatatttttgccgtgatggaaaaaatgcgccagatctggccgcagcgcgaatttgtgatgagccgcttcgaagacgtatttgaactgatcgaacagcaacgggagaggctgccgcggctgaccggcgagtttatcgacggcaaatacatgcgcgtgcatcgcaccatcggttcgacgcgcatggatataaaactggcccacgcgcgcatggaaaaccgcattgtaaacctgctggagccgctgtgcgccatcgcctggcggctgggctttgagtatccgcacgggctgctggagaagatgtggaaaacgattttaaaaaatcacgcccacgacagcattggctgctgttgcagcgataaggtgcatcgcgaaatcctggcgcgctttcagcaggcggaggacatggcagaaaatctgctgcgcttcacccagcgcaaaatcgccgacggccagcccggcgatggcgacaagctggtgctcttcaacctgatgccgtacccgcgcgaagaggtgatcaacaccaccctgatcttacgcgccagccagttccgcctgcgggatgtcgacgggcgcgaggtggcgtattttattcgcggtaagcgggagatcgatccgggacagattgaccggcaaatcgtccattacggcaattacgatccctttatggcctttgacatacagctgatacagacgctgcccgccatgggctacagcacgctgtttatcgagcctgacgtgcccggcatgctggccgcgccgctcgcatccccgcgcacggcgcttatggaaaacagcttctgggaaatcagcctgaatgacgatggcacgctgcatctgcgcgataaagcgaacgggcaggtttatgaccgggtgctgaccctggaagaaagttctgacgacggcgatgaatatgactactccccggcgcgcaaagagtggctgctcacctctttacagtcgacacatacccatgaggtgatccacgaggcctggcagagcagggcggttattcgcgtcgcgctggcggttccacttaacctggacgagcgggcggcgcgtcttaccagcgggtcgctcggggcggaattccatgtcacgttaagtcacaacagccgccgtatcgacattgaggtacagctggataaccaggcggatgaccaccgcgtgcgggtgctgatccccacacctttcgtcaccgatcacgtgctggcggatacgcagttcggtacggtttcgcgcccggttaatgacggcgcgatggcggactggcaggcgcagggatggaaagaagcgccggtgtcggtgtggaatatgctcagctataccgtgctgcaacaggcggagcacgggctggcgctgttcagcgaagggctgcgtgaatttgaaattgtcggggaaggggagaaaaccttcgccctgacgctgctgcgcggcgtgggaatgcttggcaaaagcgatctgctgctgcgccccggcagaccgtcgggcattgggctgccggtccccgactctcagctgcgcggacggctgcaaagccggttcagcctgtggagcttcagcggcgatccccttgacgccggggtggcgcagcaggcgcgccgctggctgacgccggtgcagtgctataacaaaatcccatggaacgcgatgaagctcaacccttcgccgcaggtgacgccggcgcattacagtctgctgactctgccgccgcatggctgccagctgagcgcgctcaaaaaagcagaagatcgggacaggttaatcatcaggctgtttaacccgtccgcgaccaccctctgcgggacgcggctggccttcagcggtccggtgagcctgcgcgaaaccggtatggatgagcaaccccgtgagcggggtgaagaggaatggcagcgcttatcgccgggacagtccgtgacgctggaagtggcatttcctgaataagctcattctcatctcgtattaattatcggttttttaacatttatccctttataaaagtcgcgccccgggaaattattttcgtggcgcgaacacctcgttgtgaaattaaaaattacgttgtgcgaaatttattattaaaatgcagaaatcaggtaaatattgactccttttataaacataattttaacatggtttttaccaatacattcattggtgacacaacgttaacaaacgcgccaaaaattgatttaaatcaatatttaaatcgtggaaaaagactttaaaaaacgttaaattgctcccgatcaaattggttgaaaagtagtagaatgccgataaattgatccccgtcgaaaaactcaaaagagcatcaataaaaacctgtttattgtaagggttttgcggcgtaatatattgcgggatcaatttagggtgttttttaacgtatctttaacttttctttgcgcctgtcactttcattcgaataacagcgacaaagaacagcgcggatatttttgtaatggggcatgtgtgtaaatccgtttgccgggtttactcccgaagtcttcatgcgttgagcaaggagtcatgatgttagatatagtcgaactgtcgcgcttacagtttgccttgaccgcgatgtaccacttcctttttgtgccactgacgctcggtatggcgttcctgctggcgatcatggaaacggtgtacgtcctctccggcaaacagatttataaagatatgaccaaattctggggcaagttgtttggtatcaactttgcgctgggtgtggcaaccggcctgaccatggagttccagttcgggactaactggtcttactattcccactatgtgggcgatatcttcggtgcgccgctggccattgaaggtctgatggccttcttcctcgaatccacctttgtaggtctgttcttcttcggttgggatcgtctgggtaaagttcagcacatggccgtcacctggctggtggcgctgggctctaacttatccgcattgtggatccttgttgctaacggctggatgcaaaaccctatcgcgtcggatttcaacttcgaaaccatgcgtatggaaatggtgagcttctccgagctggtgctgaacccggtcgcgcaggtgaaatttgttcataccgtagcctcgggttacacctgcggcgccatgttcatcctcggcatcagcgcctactacctgctgcgcggccgcgatgtcgcctttgccaaacgctcttttgccattgcagcgagcttcggtatggcggcgatcctctctgtgatcgtgctgggtgatgaatccggttacgaaatgggcgacgtgcagaaaaccaaactggcggcgattgaagccgagtgggaaacgcaaccggctccggcggcatttaccctgtttggtattcccgatcaggaaacccaggaaaataaatacgccatccagatcccgtatgcgctgggccttatcgccacgcgttccgttgatacgcaggttatcggcctgaaagatctgatggtgcagcatgaagagcgtatccgtaacgggatgaaagcctaccagctgctggaagagctgcgtgccggatcaaccgatcagaacgtgcgcgatcagttcaacagcatgaagaaagacctgggttacggcatgctgcttaagcgctataccgagaatgtcactgacgccaccgaagcgcaaattcagcaggcaaccaaagattctattccgcgcgttgcgccgctctacttcgccttccgtatcatggtaggtagcggcattctgatgctgtttatcatcggcttctctttctggaccgtctgccgcaaccgtatcggttctaaaccctggctgctgcgcgctgccctgtacggtatgccgctgccgtggatcgccatcgaagcaggctggtttgtcgcagaatatggccgtcagccgtgggcgattggtgaggtgctgccgactgccgtggcgaactcctcgctgaccatcggcgatctgctgttctcgatgatcctgatttgcggtctgtacacgctgtttatggtggcggaagtattcctgatgttcaaattcgctcgccttgggccgagcagtctgaaaacaggtcgttatcatcacgagcagcctaccgtggcttctcagccggcacgctaagacaggagtcgtcaaatgatcgattatgaagtattacgttttatctggtggctgctggttggcattctgctgattggttttgcggtcaccgacggcttcgacatgggcgtagggatgttaacccgcgtgctgggtcgcagcgacacggaacgccgtatcatgattaacgccatcgccccgcactgggatggcaaccaggtatggcttatcaccgctggcggcgcgctgttcgctgcctggccgatggtctatgccgccgcgttctcgggcttctatgtggcgatgatcctcgtgctggcgtcgttattcttccgtccggttggttttgactaccgctcgaagatcgaagacacacgctggcgcaacatgtgggactggggcattttcatcggcagcttcgtaccgccgctggtcattggcgtggcgttcggcaacctgttacagggcgtgcctttccatatggatgaatacatgcgcctgttctacaccggcaacttcttccagctgctgaacccgtttggcctgctggccggtgtggtgagcgtggcgatgatcgtcacccagggggcaacctatctgcaaatgcgtaccgtcggtgaactgcatctgcgtgtgcgtggcgtggcgcagatcgccgcgctggtaaccctggtgtgcttcgcgctggcaggcgtgtgggtagtgtatggtattgacggttacgtggtgacctcggttatcgatcatcatgccgcctctaacccgctgaccaaagaagtggcgcgtcaggctggtgcctggctggtgaacttcaacaacacgccgatcctgtggctggtgccagcgctgggcgtcgtgctgccgctgatgaccaccctgatgtcacgtcttgagaaaccggcgtttgccttcgtcttctcatcactgacgctggcgtgcatcatcctcaccgcgggcatcgccatgttcccgttcattatgccgtccagcacgatgatgaacgtaagcctgacgctgtgggatgcgacctccagccagatgacgctgaatctgatgacctgggttgcggcggtgtttgtacctgtcattcttctttataccgcatggtgttactggaagatgttcggtcgcatcaccaaagaagacattgaaagcaacactcactctctgtactaagtaaggagcatacaatgtggtatttcgcatggattttaggaacgcttcttgcctgcgcattcggagtgatcaccgccctggcgcttgagcacgtagaagcgactcaggcaggtaaagaagaacactgatgaacgctattatcgcaaaactctatgcggtaatggataagggcccgcttcgggccctttccttagtgatggcgctggtgttggcaggctgcgtattctgggatcctgcccgctttgccgcgaagaccagcgactacgaaatctggcaaggtttcctgatgatgtgggccgtctgtagcggcgtgatccacggggttggttttcgtcctgctgccgttcactggcagggcatattttgcccgctcatcgcagacatcgtgctggctgccgcgctgttttattttttcttttgactaagaactgtccgttaacgtcatgggcttgtaaaagcccataaatttttactctccgttcacctgaacccattccaaagcaacattcccgcgcgtatagtagcaacgtttttgagcgctaacttttattgcattaccgggatgtaaagtgaatacaacgctgtttcgatggccggttcgtgtctattacgaagacaccgatgccggtggtgtggtttaccacgccagctacgtcgctttttatgaacgggcacgcacagagatgctgcgccaccacaactttagtcagcaggttttgctggcagagcgcgtcgccttcgtggtgcgtaaaatgacgctggactattttgcgcccgccagactcgacgatatgctcgaagtccaatcggaaattacatcagtgcgtggaacctctctggttttcacgcagcggatcgtcaacgcagagaacaccgtgcttaatgaagctgaagtactgattgtttgcgttgatccactcttaatgaagcctcgtgcgcttcccaagtctattgtcgcggagtttaagcagtgactgacatgaacatccttgatttgttcctgaaggcaagccttctggtcaaacttatcatgttgattttgattggtttttcaatcgcatcctgggccatcatcattcaacgcacgcgcatacttaacgcagccgggcgtgaagcggaagcctttgaagacaaattctggtcaggcatcgagctgtctcgcctgtatcaggaaagtcagggccgccgcgaaacgctctccggttcagaacagatgttctacagcggatttaaagagtttgcccgtttacatcgcgccaacagccatgcgccggaagcgatagtggaaggggcatcgcgtgcgatgcgtatctccatgaaccgcgaactggaagcgctggaaacgcatattccgttcctgggaacggtcggttccatcagtccttatatcggccttttcggtacggtatgggggatcatgcatgcctttatcgcactgggtgccgttaaacaggccacgctgcagatggttgcgccaggtatcgccgaagcgctgattgccacggcaatcggtctgtttgcggctattccggctgttatggcgtataaccgcctgaaccagcgcgtgaataaactggaacagaattacgacaactttatggaagagtttaccgctattctgcatcgtcaggcgtttaccagcagcgagagcaacaaggggtaagccatggccagaaagcgtggacgaggaagtcgcgaactcaagtccgaaatcaacattgtaccgctgctggacgtcctgctcgtgctgttgctgatctttatggcaaccgccccgatcatcacccagagcgtggaggttgatctgccggatgcgacagaatcacagagcgtcagtaccaatgatgatcctccggtcattatcgaggtctctggcgtgggacagtacagcgtggtgattgaaaaagatcgtctggatcaactgccgcctgaacaggtcattgccgaagcgcagcgtcacctgcaggcgaatccgaaaacggtcttcttaatcggtggtgcgaaagaggtgccatatgatgaaatcatcaaagcgctgaacctgttacacagcgcgggtgtgaagtcggttggcttgatgacgcagcctatttaatcctgcataacaggcgaacagtttttgggaaccgatagtgtcaaaggcaaccgaacaaaacgacaagcttaaacgggcgataaccatctcggcggtgctgcatgtgattttatttgcactgctgatctggagttcgttcgatgagcacatagacgcctctgctggcggcggcggtggttcatccatcgacgccgttatggtcgatcccggcgccgttgtacagcagtacaaccgtgagcagcagcaacaggcgagcgcgaaacgcgctgaagaacagcgtgaaaagcaggcgcaacagcaggcggaagagattcgcgagaagcaggccgccgagcaggagcgtttaaaacagctcgaaaaagaacgtttgcaggcgcaggaaaacgcccgcgaacaggcacaacagcagaaacaggcagaagaagcggcgaagaaagcgcaggagcagcaaaagcaggctgaagaagccgctgccaaagctgccgccgatgcgaaagcgcaggctgacgcccaggcgaaagccgccgcagatgccgcgaagaaagccgaagccgaggctgccaaagccgctgccgccgccgcgaagaaagcggaagccgaagccgccaaagccgccgccgatgctgcgaaaaaagccgaagcggaagctgcgaaaaaagcgcagcaggacgccgagaagaaagcacaggctgaagccgctaaaaaagccgctgccgctgaaaaagctgctgcggcgaaagcagccgctgctgaaaaggctgccgctgagaaagctgctgccgctgccgaaaaagccgcggccgcgaaagctgccgctgctgaaaaggccgccgctgataaaaaagctgcagctgagaaagccgctgccgataagaaagcagccgccgacaaagccgcagcagcaaaagccgccgctgcgaaaaaagccgcggcagagaaagccgccgcgtctgatgtcgacgacctgtttggcgacctcagctccggtaagaatgcgccgaaaaccggcggtggagcgaaaggaagtaatgcagcgccagcaggaagtggtaacactaaaaacaatggcgcttcaggggctgatatcagcaactatgctggtcagataaaagcagccatcgaaaccaagttctatgatgccgcatcctatactggcaaggtatgtacgctgcgcatcaggcttgagccagatggtacgttgaaagatattcagtctgaagggggcgatcccgcgctttgtcaggccgcacttgctgcagcccgtcaggcgaagctcccgaaaccgccgacgcaggcggtgtatgaagtgtttaaaaatgcgccactggacttcaaaccttaagatacacttttccacataacgccggaaaagggactattttagtcacggggtttcgatagttttgtctatttgagtttgttaacattctgctaaattatcgcaggttttcagcctggataagggagatatgatgaagcaggcattacgtgtagtgtttggttttctggtactgtttgcagcggcgctgcatgcagaagtgcgcattgagatcacccagggtgtcgactctgcgcgtcctattggcgtggtcccgttcaaatgggcaggtccgggcgcagcgccggaagatatcggcggtatcgttgccgctgaccttgcgaacagcggtaaattcaatccgctggatcgttctcgtctcccgcagcaaccggcttccgctcaggaagttcagccagccgcctggtctgcgctgggtattgacgcggttatcgtaggacaggttacgcctactccggacggcggctacagcgtgtcttatcagctggtggacaccggcggcgcgccgggtaccgtgctgtcgcaaaacacctttaaggttaacaaacaatggctgcgccttgcgggtcacaccgccagcgatgaagtctttgaaaaacttaccggtatcaaaggtgccttccgtacgcgtatcgcctatgtagtgcaaaccaatggcggccagttcccgtatgaagtgcgcgtgtctgactacgacggttataaccagtttgttgtgcacaaatcaccgcagccgctgatgtccccggcctggtcaccagatggcaaccagctggcttatgtgaccttcgaaagcggtcgttctgcgctggtggtgcagaatctggcaagcaccgcaacgcgtcagattgcctctttcccgcgtcacaacggggcacctgcgttctcgcctgatggcaaaaaactggctttcgctctgtctaaaaccggcagtctgaacctgtacgtgatggatcttgcttctggtcagatccgccaggtgactgatggtcgcagcaacaacactgaaccgacctggttcccggatagccagaacctggcgttcacctccgatcaggctggtcgtccgcaggtttataaagtgaatatcaacggcggtaccccgcagcgtatttcctgggaaggttcgcagaaccaggatgctgacgtgagttccgacggcaaatttatggtaatggtgacctctaacggcggtcagcaacacattgccaaacaagatctggtagcgggtggcgtgcaggttttatcgtcaacgttcctggatgaaacgccaagtctggcacctaacggcactatggttatctacagctcttctcaggggatgggatccgtgctgaacctggtttctacagatgggcgtttcaaagcgcgtattccggcaactgatggacaggtcaaattccctgcctggtcgccgtatctgtaataataaataattgattattaaaggaatcaaagaaatgcaactgaacaaagtgctgaaagggctgatgctcgctctgccggttatggcaatcgcagcgtgttcttctaacaagaacgcaagcaacgaccagagcggcgaaggcatgctgggtgccggcactggtatggacgctaacggcggcggcaacatgtcttctgaagagcaggctcgtctgcagatgcagcagctgcaacagaacaacatcgtgtacttcgatctggacaagtacgacatccgttctgacttcgctgcaatgctggacgcgcacgctaacttcctgcgtagcaacccgtcttacaaagtcaccgtagaaggtcacgctgacgaacgtggtaccccggaatacaacatctccctgggtgagcgtcgtgctaacgctgttaaaatgtacctgcagggtaaaggcgttaccgctgaccagatctctatcgtttcttacggtaaagaaaaaccagcagtactgggccatgacgaagcggcttacgctaaaaaccgtcgtgccgtactggtttactaagagaattgcatgagcagtaacttcagacatcatctgatgagtctgtcgttactggttggcatagcggccccctgggccgcttttgctcaggcgccaatcagtagtgtcggctcaggctcggtcgaagaccgtgtcacccaacttgagcgtatttctaacgctcacagccagcttttaactcagcttcagcagcaactttctgataaccagtccgatattgattccctgcgcggtcagatccaggaaagccagtatcagctgagccagatggtggaacgccagaagcagatgcagtcgcagcttgatggtctgagcagcggtggtgccgccgcacagccagcgacaggcgatcaaacaggcgcagcgaccgcgacgccgaacgccggggcgcaaacgccatcagcgccggtacagagcggtgatgctaatacggattacaatgctgctattgcgctggtgcaggataagtcccgtcaggatgaagccattaccgcgttcggcaacttcgttaaaaattacccggattccacttaccagccgaacgcgaattactggcttggtcagctgaattacaacaagggtaaaaaggatgatgcggcgttttattttgcctccgtggtaaaaaattacccgaaatcaccgaaagcgccggacgcgatgtttaaagtcggcgtgatcatgcaagacaaaggggacactgcaaaagccaaagcggtttatcagcaggtgatcagcaagtaccccggcactgaaggcgcaaaacaagcgcaaaaacgacttagtgcgatgtaatgaatgctgcatgaccagaaatcgcggaatttctggtcttgtcgcatgaatcataagcagttaagtgatctatatcgaaatttttgttgcgccagattcataaaccagtaatatatgccgccgttgccacgggatatgagacatacctgaagcagcgcaaaaaagcgttatagtgggtcgttagctcagttggtagagcagttgacttttaatcaattggtcgcaggttcgaatcctgcacgacccaccaatctttcgattgaacgcagtagtaacagaatgatgagtaatttgagtgggtgattagctcagttggtagagcatctcctttacacggagggggtcggcggttcgagcccgtcatcacccaccactcgggtcgttagctcagttggtagagcagttgacttttaatcaattggtcgcaggttcgaatcctgcacgacccaccaatactcaggtggaaagcagtagttaaacgtgaaggataacgttgcaacagcaacggcccgaagggcgaggcgaagccgagtcatcctgcacgacccaccaatcattcttgcctgatttaaatcttcgaagtcaacaccctgaatgggtcgttagctcagttggtagagcagttgacttttaatcaattggtcgcaggttcgaatcctgcacgacccaccaattcatcggtggaccatgatagtgagacgtgaaggataacgttgcgacagcaacggcccgaagggcgaggcgaagccgagtcatcctgcacgacccaccacttcgaagaaaatcccctaaggggtcgttagctcagttggtagagcagttgacttttaatcaattggtcgcaggttcgaatcctgcacgacccaccactctttaagcaacaaaacagtaataaagcgtgaaggataacgttgcgacagcaacggcccgaagggcgaggcgaagccgagtcatcctgcacgacccaccaatgtggaaaggcgccctaaaggcgcctttttgctatgcgcgaaatgcaggttttttgccgggtggcgctgcgcttacccggcctgcagcgtacgcgtaggcccggcaagcttgcgccgccgggcgtatacctcttcccgcaaaaaaacgtccgccagcatctttatctctgtgactttcccctgctaatcggctatgcttgtttagcatataaaacgcatctggttttttataagcaatttatcgctttatgaaccgatatttgttaagtcagcaaaacgagaaagccacatgagcgtgatgttcgatccggaaaccgcgatttatccctttccgccaaagcctgcgcccttaaaccatgatgaaaaacaggcgtaccgcgaagaaattaaacgtcttctgaaagcgcgggatgcggtgatggtggcgcactactacaccgacccggaaatccaacagctggcggaagaaaccggtggctgtatttctgattcgctggagatggcgcgctttggcgcaaaacatcctgcctcaacgctgctggtcgcgggcgtccgctttatgggcgaaaccgccaaaattctcagcccggaaaaaaccatcctcatgccaacccttcaggcagaatgctcgctggatctcggctgtccggccgatgcgttcagcgcattctgtgatgcccatccggatcgcaccgtggtggtgtatgccaacacctctgccgccgtcaaagcgcgcgccgactgggtggtgacctccagcatcgccgttgagctgatcgagcatctcgacagcctcggagagaaaatcctctgggcgccggaccggcatctcggcaattatgtgcaaaaacagaccggcgcggatgtgctgtgctggcagggtgcctgtatcgtacatgatgagtttaaaactcaggcgctggcgcgcatgaaaggattgtatccggatgctgcgatccttgtgcatccggaatccccgcaggcggtggtggagatggctgacgcggtgggatctaccagccagctgattgccgctgcgaaaacgctgccgcaaaaacagctgattgtggccaccgatcgcgggatcttttataagatgcagcaggccgtgccggaaaaggaactgctggaagcgccgaccgcaggcgagggggcaacctgccgcagctgtgcgcactgtccgtggatggcgatgaacggcctgaaggctatcgctgacggcctcagaagcggtggcgctgagcatgagatccatgttgacgccgcgctgcgtgaaggcgctctcaggccgttaaaccgcatgctggattttgcagctacactacgttcatcaacgtaaacaatcatttggggaaaagatggatttttttagcacgcagaacattctggttcacatcccgattggcgcgggtggctatgatttatcatggatcgaagcggtgggcaccctggcgggattgctttgtatctggctcgccagcctggaaaaaatcagcaactacgcgtttggtttaatcaacgtcacgctgtttgcgattattttcttccagatccagctctacgccagcctgttattacaactgtttttcttcgccgccaatatttacggatggtacgcctggtcacggcaaaccacacaaaacgaagccgtactgcaaatccgctggctaccgctgtcgaaggctatcacgtggcttgcggtctgcgtcgtcgcaatcggtctgatgacggtgtggatcaacccggtcttcgcgttcttaacgcgtatcgccgtggcgctgatgcagagccttgggcttaacgtggcgatgcctgaacttcagccggacgccttcccgttctgggattcctgcatgatggtgctgtccatcgtggcaatgatcctgatgacgcgcaagtatgtggaaaactggctgctgtgggtggttatcaatgtgataagcatggtgatctttgcccgtcagggcgtctacgcgatgtcgctggaatacctgctgctgacgtttattgccctcaacggcagccggatgtggatcaaaagcgcacgggaacgtggttcacgcgcgctcagccgttaatgatggtgatgtgcatgaccggacggcagcgaattcagctcgcagtccggtccgctacagggctgatactccatctgcacggtgacatgctcaatgtcataatgatgcgccagaaagtgctgaatgcgcgtcagaagggcatcatggtcgtgcggcggaaccacctgcacgtgcagcgtcatcaccgtcttttcaccaatcgtccagacatgcacatggtgcgcatcacgcacttccggtatatcccggcgcagatgacgcttgagggcattaatatccagcgacaccggcgcgccttccagtaattcattgacgctttcccgtaacagctgccacgcgctgcgcaacaccagacaggacaccagcaccgacaggatagggtcggcaggcgtccagcccgtccacaggatcaccaccgcggcaacaattgccccgaccgaacccagcagatcgcccagcacatgcagggcagcggcccgcacattcagatttttttccgaactgccccggtgcaggatccagaatgccagcagattggcgaccagaccggcgaaagcaatcgccatcatggtgacgctcgctaccggctgcggatgacggaaacgctggtatgcttcccagacaataagcagagtgatcaccaccagcgcaatggcgttcacaaaggccgccagggtggtcagccgcagccagccaaaggtgtgtcggccgctgggcggcttacgtgcaaatcccactgccagcagggcgaagagcagggcggcggagtcggtcagcatatgaccggcatcggcaagcagcgccagcgagccggaaaccaggccacccacgacttcaataatcataaacagggtggtgacgccaaacgccagcagtaaacggcgtccgttttcatcggcgggcgggtgagaatgagagtgcgaatgcgccatttttataatcccggcatggttaataatcagcgccttacatcattacagatttttttgttttcggcacaaaaaaggagagccgaagctctcctctttatcaacttatggctgccggttactgggacgtgccatcagttttggtgttggtatcgttattcacaccgtcaccggtctgaactttttcattgatgtccgggcatttgccgtctttacactgggtatttttgtggatgtcgtctttactcatcgtctcgccagaggcgctggtgttgccgccagtcatacccggcgctgtagtaccggtggtggtattggtaccagttgcagtattggtattgccggtattgatgtctttattacccacactatttggcgctacattctgatgagcatccggggcaacctgacccgcgctcgctgccgcattcgcgttgccgttgttatcggaagaagcagcatccgccgccagtgctgcgccgctggccagcgttaatgtcgtcgtcaggaaaagtgcagttaatttattcattttcatcatattgctcctgtgctcgtcatttgattggacattgggtccaacagtgcagatgtgatacgaattcatcgcccagtggtgaaagatgccaaatccagccggtaaggcagaatgggatctcgttaaaacaaacaaataaagtgcttacagtaaaaaagtttagctacgaacccgacgttcgctactatctggagctttttaactggttttcaggaattatccgtatcaagtgtaaaagcgcgtttacactttaatgccgagcagttagattgggagtattgcaatcacttctatttgtatggcaaagctgggatccccatgaattatcagaacgacgacttacgtattaaagaaatcaacgagttattacccccggttgcactccttgaaaaatttcctgcgacagaaacggctgccaataccgtctcccacgcccgtaaagcgatccataacatccttagcggtcacgatgaccgtttgctggtggtgatcggcccctgttccatccacgatccccaggctgcgaaagagtatgccgcccgcctgctggcgctgcgcgatgaactgaaaggcgagctggaagtggtgatgcgtgtttattttgaaaaaccgcgtaccactgtgggctggaaagggctgattaacgatccgcatatggacaacagcttccagatcaacgacggcctgcgtatcgcccgtaagctgctgctggatattaacgacactggcctgccggcagcgggtgagtttctggatatgatcacgccgcagtacgtggcggatctgatgagctggggcgctatcggcgcgcgtacgacggaatcccaggtgcaccgtgagctggcatcgggtctttcatgtccggtgggcttcaaaaatggcaccgacggtaccattaaagtggccattgacgccattaatgccgccggtgcgccgcactgcttcctgtctgtgaccaaatggggtcattcggcgatcgtgaacaccagcggtaacggcgactgccatatcattctgcgcggcggcaaagagccgaactacagcgcgcgccatgtggctgaagtgaaagaggggctggttaaggccgggctgccgccgcaggtgatgatcgacttcagtcacgccaactccagcaagcagtttaaacgtcagatggacgtgggcgcagacgtctgcaagcagatcgcgggcggtgaaaaagccattatgggcgtgatgatcgaaagccatctggtggaagggaatcagagcctggaaagcggcgaacccctggtatatggcaagagcgttaccgatgcctgcatcggttgggaagataccggcgtggtgctgcgtcagttagcggaagcggtgaaagcgcgtcgcggctgatcggccaatctgcactctgcagacccggcgcctgccgggttttttatattcgcaccccaagcacgggtgggcgaaaaatgataattgtgaaaattatcatattgccatgtcaaagaatgataatagccgtgccccagtgattatcaccttttgctgccttcagatactcttgagttaattcacaggaagggacacgccataaatatcctttctgctgaatgaccgcattaattactgtttccggtatcagggatcttataaggatatttatgatgagcggtgcaatgagtgctttagaaaaagtgatattgccggtggcgataaagctgggaaaacaggttcacgttaacgccataaaaaatggttttattcgcttaatgccgttaacgctggtgggggcgatgtttgtcctgattaataatgtgttactgaattttggcgaagggtcgtttttctggtcgctggggatccatctggatcaggaaacgataacccggcttgatgcatttaaggtgatcggcggcagcgtttataacggtaccctgggcattatgtcgctgttaacgccgttctttatcggcatggcgctggcggaggaacgaaaggtggatggactcgccgccgggttgttatcgattgcggcgttcatgaccgtaacgccttaccaggtcggtgacgtggctgcgattggcccgggctggctcggtggcgcgaatattatttccgggatgattatcggccttgcggttggcgaaatgttcgcttttatcattcgccgccagtgggttatcaccctgccggacagcgttccggcttccgtggcgcggtcgttcacggcgttggtgcccggatttatcattttgctgatcatggggctgataagcggcggattatcgctggcgggtacgcattttcaccagatcattatgagtatggtttccacgcctctggcctctctgggcggcatagtcggctgggcatatgtcatctttaactctttgctgtggtttttcggtgttcacggtgggctggcattaactgcgctgaacagtggtattcttgggccgtggggtatggaaaatatggccatttataccgaatatggttctgtagaggcggcactggcggcgggcaaaaccttccatttctggacagggccgatgatggaatcctatgtttatctgggcggtacgggggccacgctgagccttatttttgccatctttattgcatcgcggcgggcagattatcggcaggtagcgaaactggcattaccttccggcctgttcaatatcaacgagcctattctctttggtctgccgatcattatgaatccggttctgatgctgccttttgtgctgatccagccgttgctggcggggattacgcttgccgcttattcgctgggtttgatcccgccctcaaccaattttgcaccctggacgatgccgccaggcttaggcgctttctttaattccaatggcagcatagcggcattaattctcgcgctggtaaacctggtgttggccacgctggtgtatttaccttttgttattatcgccaataaggcgcagggcgtgattgccgaagaagaaagcgagaccgacatcagggcagcgctgcaattttgaggaaacggtgatggaaattaataccgtacaggaaagccagtttttgaagggtaatgatttttatttttttatccttgataaatcgacaagcgtgagcgggctgcaccagcatgattattatgaatttacgctggtactgactggccgctgccgtcaggtcattaatggcaaatcagtttctttaaagcgtggtgacgtggtttttatcccggtcggatcgtcacatcagacattttatgattacggcgtcgcgcgcattttaaatatggggattggtcggcgctatttcgaagcgcactattccgcgatgctaccggtgtgttttgtggcctcgcaaagttatgccattgcaccagcttttttaacttatatcgaatccacgttatcgtctttaagtttacagccgggtgaatgtgatgaatttaataagttgttgacctattacgtagtgaatcatttgcatcattatgaacatcctcagtgtcagcaggatattccggcgtggctgacgcgagtgatccgtgagatgcataataaaacgctgtttgccgataacgctctgaagaatatggtgcgcctggcagggaaaacgcagtcctatctgacgcgggctacgcagttttattatcacaaaacgccaggccagatcattaatgaaatccgcatcaattttgctaagcagcaactggaaaccactaatttctcggtggccgatattgctttcgatgccggattcagcagccccggcatttttatcaacaattttaaaaaaatcacctccttcacgccgggacattaccgtcgacaattggcaggccagccgactaacggagcaacagaggaataaggatgaataaattaaaagtagtgaccatcggtggcggcagtagttataccccggaattagtcgaagggtttatccggcgctatcatgaattaccgatcgatgagctatggctggtggatattgccgaaggaaaggaaaaactcgcgatcatctgtgagctgtgtcagcgcatggtagaccgtgccgggctgcccatgaaaatcgttcaaactcttgatcgccgggaagcgttgcgcgatgccagttttatcactacccagtttcgtgtcggccagttagcggcacgggaaaaggacgaacgcatcccgctttctcatggttatttaggccaggaaaccaacggggcgggggggttatttaaagggctacgcaccattccggtgattgttgatatcatcaaggatattgaggaaatctgccccgatgcgtgggtcattaatttcactaatccggctggtatggtcactgaagcggtatatcgtcatactcatttccgccgctttatcggtgtctgtaatgtgccggtaggaatgcacaggtttattcaggatattttatcccttggcaaaaccgatcacctctctcttgatctctttggtcttaaccatctggtatttatcaaagatgttctcgttaatggtcattcccgttttacggaggtgatcgacaaagtggcttccggtaactttagcggcagcacggtaaagaatatttttagcctgccttttgcgggaagccttatccgggggctgaatttactgccctgttcttatcttctctattactttaaacataaagagatgctggccattgagcttggcgaatattacaaaggcgaagtgcgcgcgcaggcagtgcagaaacttgaacgccagttatttaagatctatcaggatccaacccttgcagtaaaacccgccgaactggaggcgcgtggcggagcgtattattccgatgccgcctgtgaagtgattaatgccatctataacgataagcaaagtgaacattatataaacctgccgcataacggccacgttgaaaacattcctgatgactgggtggtggaaatgacctttctgctggggcgcaacggaggaacaccgcacccgcgccttacccgttttgacgataagaccatggggcttatccacaccatcaagggctttgaaatcgccgccgcccgcgccgcgctgaacggcaacctcaatgatctgttactcgcgctcaacctcaacccactggtgaattctgacagcgacgccgaattactggcgcgggagatgctgctggcgcatcagtcatatttgccgcagtttgccgatgctatcgcaacctttactgcaacaagggaggcgtaatgtgacgaatctgttaattgtgaacgccgacgattttggcctgagccaggggattaactacggcattattgaagctcatcgtcacggggtggtcagttccaccacggctatgatgaatgcgcctgcgatcgaacacgcagcagaaatcagcgcagattttccggcattaggcgtggggctgcatttcgtgctcagctttggcgtgcctctaacgcccatgacttcgctcgtccgtgaagggcagctgggcaaatggctggtgcaacaggcaacgctggggctgctcgccagtgatgagattgcggcggaattgcaggcgcaatatcagcgctttatctccttgtttggttatccaccagtgcatatcgacagccatcaccacgcccattttatccctccggtctgggcacaggtggtgtcgtttgcccgtgagaaaaacatcccgctacgcatcgatcgcgaggcgcttcaccagcaggggatcgtcccgcagggtgtgcgcagtaccgacggttttatcggtgatttttatgctgataacgtttcagcgcaggcttttctcttagcgctgtcgcagtcaaaagcgcgcggtgagcgttcagttgagctgatgtgccatccgggttatgtggatcaaggggtcaaacagagccgctattgcgatcagcggctggacgaactggcggtattgaccacagcgtcactcaggcaagccgtggaagcccagggttactggctgggaaactatggtgatctggcgcagatcgatgcatgagacggcaacgaaaccggatagccatgcggtttgtaaataacgcttataacaggtaatgccgtcgctaaaaaagcgtgggaaggtcccacgctttttttattacttcgctttaccctggttagcgacggccgccgcttttgcagcgatttcgtcagcgttacccaggtagtagcgtttcagcggtttgaagttctcgtcaaactcatacaccagcggtacgccggtcgggatgttcagttcgaggatctcgtcttcgctcatgttatccagatatttcaccagcgcgcgcagggagttaccgtgcgccgcaacgatcacacgctcaccggacttcatgcgcggcagaatggactcgttccagaacgggatcacgcgatcgatggtcagcgccaggctctcggtggtcggcagctcctggtcggtcagtttagcgtagcgcggatcgtggcccgggtagcgctcatcatctttggtcagctccggcggggttaccgcaaagccgcgacgccactgtttaacctgctcgtcaccgtatttttcagcggtttcagctttgttcaggccctgtagcgcaccgtagtgacgctcgttcagtttccaggatttttcaaccggcagccaggcctggtcgagctcgtccagcacgttccacagggtgtggatcgcgcgtttcagcacagaagtgtacgcaaagtcgaagctgaagccttcgcttttgagcagtttacctgctgctttcgcttcgctgacgcctttttcggacaggtccacatcgtaccagccggtaaagcggttttcgttgttccactggctttcgccgtgacgaaccagaacaagcttagtaactgccatactctactcctccaaaaactgattgaatgataacaattctcattatattgccctgaggtcgtcagcggcaacgcataaccttaaccatagcgaaaatagtcgcgcagtgtaaggtgcatgtgaatgcagggttatgtttttgtcggtaaatggcgtttatttcagcgaaatgaacaaaaaagtcacggcaaaacagagaacgcccggcaggcgaagcgccgccgggcaaaacgaaaggatcaggatggaataaactggtactcggtaatactcagatattcctcgcccggacgcagaacacaatccggttgcggccactccggatgattcggactgtccggcaacagctcgctttccagcgccagtccctgccaggcctcatacgctttcagctcgcgcgacggcgtcccttcgaggaagttaccggagtagaactgcaatgccggggcggtggtatagaccgacatttgcaggcggttatcgctggaccacaaatgcgccgcaggctggctgagatcgcctttcgcctgcagtaaaaaggcgtggtcgtagcccttcacctttttctgatcgtcatcgctgaggaaatcctgcgccagggttttcgggcggcggaaatcaaagctggtctgatcgacggctttcaggccactgtccggaatgccgtcttcgcccaccggcagatagtgatccgccagcagttgcaattgatgctgacgcacgtctccctgcgcgccatccagattgaaataggcgtggttggtcaggttcaccgggcacggcttgtcggtggtcgcgcgatattcaatgcggatacggttgtcgtccgtcagacggaacagggcgctggcggtgagattgccggggaaaccctgatcgccgtccggcgagtcgatggagaacagcacttcgctgtcgttctgccgcacaatgcgccagcggagcttgtcaaagccctgcgggccgccgtgcagctggttttcgccctggctcggcagcagttgatattcctgcccgtcgaggcggaaacggcttttgctgatgcggttagcatagcgtccgacagacgcgcccagataggcggtctgctccgggtaggtctgcggcgtacggcagccgagcagggtttcacgcaccgagccatccggcagcggtacgcgcgcggagagcagggttgcgccccagtccatcagcgtcaccaccatccctgcgccattgcgcagggtgatcagacgataagccagcccgtccggggccagcgcaggcgtttcgtttagcactgtcctgccccctgtgatgctttgcaaacgtagaaggtttctttgatcccggttttggcttcgtactgttccgccacggctttctgcacttccggcaccatcgcttccggtaccagcgccacgatgcagccaccgaagccgccgccggtcatacgcacgccgcctttgtcgccaatggtcgctttgacgatgtccaccagggtgtcgatctgcggcacggtgatttcgaaatcgtcacgcatagaggcatgggattccgccatcagctcacccatacgggtcagatcgcctttttccagcgcgctggccgcttccacggtacgcgcgttttcagtcagcacatggcgaacgcgtttcgccaccagcggatccagttcatgagccacggcgttaaactgatccagcgacacatcacgcagtttcggctgctggaagaaacgcgcgccgatttcacactgctcgcggcgggtgttgtactcgctgcccaccagcgtacgtttgaaattactgttgatgatgaccaccgccacgccttccggcatggagacggctttggtgcccagcgaacggcagtcgatcagcagcgcgctgccttctttacccagggcagagatcagctgatccatgatgccgcaattacagccaacaaactggttttccgcctcctgaccgttgagcgcgatttgcgcgccgtcgaggggcaggtgatacagctgctggaatacggtgccgaccgccacttccagcgaggccgatgaactcaggcccgcgccctggggcacgttgccgctgatcaccagatccgcgccaccgaagctgttgtcacgctgttgcagatgcttcactacgccgcgcacatagttagaccactgctggctgtcgtgggccacaatgggcgcatccagggaaaattcatctgactgattgtcgtaatcggcggcaattacccgcacggtacgatcctgacgcggcgcgcagctgatcaccgtctggtaatcaatggcgcacggcagcacgaagccatcgttatagtcggtgtgctccccgatcagattcacgcggcccggcgcctgaatggtatgagttgcagggtagccgaatttttcagcaaacagggattgtgttttatctttcagaggcattgttattctccggatgcacgaaaatggatatcactgaccgcgcgcagacgttcggcggcctgttcagccgtcaggtcacgctgggtttccgccagcatttcatagccgaccataaacttacgcaccgtcgcggagcgcagcagcggcggatagaagtgcgcatgcagctgccagtgttggttttcttcaccgttgaaaggcgcgccgtgccagcccatggagtaggggaaagagcactggaacaggttgtcgtaacggctggttaatttcttcaggcacagcgccagatcgctgcgctgggcgtccgtcagatcggtaatgcgcaggacgtgcgcttttggcagcagcagcgtctcgaacggccatgccgcccagtagggcaccacggccagccagtgctcggtttccaccacggtgcggctaccgtcagcctgttcgcgctgaacataatccagcagcatcggcgactgatgctcatcgaaataggctttctgcaggcgatcttcccgctccacttcgttcggcaggaagctgttcgcccacacctggccgtgcggatgcgggttagagcagcccatggccgcgcctttattttcaaacacctgcacccacgggtaggttttccccagatcggcggtctgcgcctgccaggttttgaccacttcttccagtgcaggcaggcttaactccggcagcgttttgctgtgatccggcgagaagcagatcacccggctgacgccgcgcgcgctctgggtgcgcatcagcggatctgtactctccggcgcttccggggtatcgctcatcagcgcggcaaaatcgttggtaaacacgaaggtgccggtgtactgcgggtttttatcccccgtcacgcgcgtgttgcccggacagaggaagcagtcaggatcgtgggacggcagggtttcctgcgacggcgtctcctgtgcgccctgccacggacgtttggcacgatgcggtgaaactaaaatccattgcccggtaagcgggttataacgtcgatgcgggtgatcgaccgggttaaattgcgtcatcactattccttaatctgcatatccctgcggatggcgtgactgccagcgccaggtatcttcagccatttcgtccagtgtgcgggtgactcgccagttcagttctttatcagcacggctggcatcggcccagtaagcgggcagatcgccatcgcgacgcggggcaaagtggtagttaatgggtttaccgcaggctttgctgaaagcgttgaccacgtccagcacgctgctgccgacgcccgcgccgaggttgtaaatatgcacgccggatttacctgccagctgctgcatggctgccacatgaccgtctgccagatccatgacgtgaatgtaatcgcgcacgccggtaccgtcttccgtcgggtagtcgttaccgaaaatcgccagcgactcgcgacggcctaccgccacctgggcgatgaacggcatcaggttgttcggaataccctgcggatcttcccccatatcgcccgacggatgcgcgccgaccgggttgaagtagcgcagcagcgcgatgctccattccggctgcgctttttgcaggtcggtaaggatctgctcaaccatcagcttgctcttgccgtacggactttgcggcgtgccggtggggaagctttcaacataagggattttaggctggtcgccgtagacggtggccgacgagctgaaaatgaagtttttgacattggccgcgcgcatggcgctaatcaggcgcagggtgccgttgacgttgttgtcataatattccagcggtttggcaacggattcgcccacggctttcagaccggcaaagtggatcaccgtatccacggcgtgatcgtgcaggatctcggtcatcagggcttcgttacgaatatctccttcaacgaaggtaacggatttgcccgccagccgctcgatcaccggcagcacgctgcgcttactgttacataagttgtcgagaataatgacctcgtggccgttttgcagcagttgcacacaggtgtgactcccaatgtaaccgctaccaccagtaaccagaactcgcatatgacactccatcaggcgtatgttatgtaataaacatagcataacagagcgggaaaaagtgtgacatgaccgaaaatagtggaatcgtttacactaacgcatttcaggatcgctggggcgtcaaaggctactataaatcaataagatagtagggtggcgctgtaatttgtctgaaagtgagcgcctgccgggcggcaggcgtgaaagggtcagcgcacggcggcgagatggtaacggtatccctcgccgtccggcaaaaattccagccggtgcgtaatacaggccggggcatccgcggcgtggtgggagacaaacagcaactgcgtttccccttcgctaatcagcacatccacaaaacggcgcaccagctggcggttaagcgggtcgaggccctgaagcggctcatccagaatcagtaaggtcggatgtttcaccagcgcacgcacgatcagcgccagccgctgctgcccccacgacaggctatgaaagggcgcgtcggcggtgcgggcgtcaaagcccagaatatccagccacgcctgcgccagcttatgctgcttgtccgataccgcctgatagatgccgatggaatcaaaatagccggacaaaatcacattgcgcacgttggtgctgacgcggtaatccagatgcaggctgctgctgacatagccgatatgctttttaatatcccagatggtttcgccgctgccgcgacgcacgccgaacagcgtcagatcgttgctgtaaccctgcggatgatcgccggtgatcagattcagcagcgtcgatttccccgcgccgttaggcccggtgatctgccagtgctcgcccggttttaccgtccagctcagatgattaatgatcggcctgtcatcataagagaccacgccgtccctgagcacgatgcgcggcgcgtccggcggcagggcatggcgggcggagggggcatccggcggcggcagggcgatgccctgtagccgttcactgtgcgcgagctgggcgatcagcgcctgctgcaacagcgtcgccttttcgccggtttccgccagcgcgcagtccaccaccaccccggcatgctgcacaaattcggggatctcatcaaagcggttaagcaccagcaccagcgtaatgccctggccgttcagcagggcgaggtgttccgccagctgtgcgcgggatgccacatccagcccgtcaaaaggctcatccaggatcagcagttcaggggaggccatcagcgcctggcagagcagggtttttcgcgtctcgccggtggaaaggtatttgaaacggcgatcgagcaggccgctgatgccaaactgcgccgccagcgctgcgcagcgttcgctgtctttgatctcgtcctggatgatgtccgcggtggtgcgcccggtatcggtctcatcgggactttgcatgtcggtgttattgcgctgccactcgtcgctgaccagtttttgcagctgttcaaaggagagacgggtgacgcgggcgtagtcgcactggcgctcgcctttcagcagcggcagttcccctgccagcgcgcgggcaagggcggatttgccgctgccgttgctgccgacaaaggcccagctttccccggtgtgcaggtacaaatcggcgatctgtaaggtgcgggtgtcgctaatgcgaaacgtgccttgcgaaatatgcaataaagacattgtgtatcccgttttttgcagcagaaaatacagaaatacgtggcagcggacgctttgtcaatgcactcagcacaatgtcgcgacaatcacctggtcggcggcaaaacaggcgatgacctcgctgttttcagccagatccttcgcctgcgcctgcggcagggtggcgcacagcgtctgcccgtccgggagtgtcatcagcacttcgcactgggtttccccgcgttcgatatggctgacaatcgcgggtagctggttatccatgcccgccgccaccgccggatcctgtgtcagcttcacccagggcgctttcagcaataccagcacctctttaccttccaccagcccgagccgggcgctgctttgcgcggtgatcgctactttcagacgcgtgctgccatccgccagcaatacctcaatggcgtgctgcacctggtgggattcgcgggcgaccacggtgccgaaccactgattgcgggcgctggtttgcagggaaaaacgtgagatggccgccagcaggctgtccagcggcagggcatcgtcgtcgctcaacacatcaaaggctttttgctggatctgcgccagcagatcataaagcgcgatcagccgctgtccgtaacgggtaagcagcgcgccgccgccgcccttaccgccggtggcgcgttccaccagcgtctgttcgctcagctggttcatctcgttgatggcatcccaggcgcttttatagctgatgccggcgttcttcgcgccctggctgatggagccggtttcggcgatctgtttgagcagggaaatgcggcgcggatcggcaaaaagccgttgctgaagtttgagagtgaggagaatttcggcctgcataacaatgtcctggcaaatagggtattgtgacggaattcgcccctggcgcaacgggcaccgcacaaaagggacgtgtaattttcgcggatcgggttagaataaatgcttaactcactgtggagtcgaccatgttagaattattaaaaagtctggtatttgcggtcatcatggtaccggtggtaatggcgatcattcttggcctcatctacggcctcggtgaagtcttcaatatcttttccggcattggccacaaagataaatccagacaatcacattgatttcaaaaaaagcgcccgctcagcgggcgttttgctattcaggatttgccccagcctgccgataatttctctgccgccccgttaacaccagagtagtaccaattagtcctgtaaatttgtatggctatcgttatattataaagtatataacgaaatgcacaggagttaaaaaatgatccgtaccggtttacgtctgctggcaggcgccacgctctccctctcactggcgggcgctgcgctggccgatgaaagtaaaatcaccgtatttgctgccgcctcgctgaccaacgcgatgcaggatattgccacgcagtacaaaaaagagaaaaacgttgaggtggtgtcgtcctttgcctcatcgtccacgctggcgcggcaaatcgaagccggcgcgcccgccgatctgtttatttctgccgatcagaaatggatggattatgcggtggaaaaaaaagcgattgaaaccgacagccgcgaaacgctgctgggtaacagcctggtggtggtggcatcgaaagccagcgtccaggggccaatcgccattaacgcgcaaacacagtggacaaccctgctgaacggcggccgtcttgcggtgggcgatccggagcacgttccggcaggcatttacgccaaagaggcgttacaaaaactgggtgcctgggatacgctgtcgcccaaacttgccccggcggaagatgtccgcggcgcgctggcgctggtggagcgtaacgaagcgccgctcggcatcgtttacggctctgatgcggtggccagtaaaggcgtgaaagtggtggggactttcccggaagattcacacaaaaaagtggaatacccgctggcgattgtcgaaggtcataaaaacgcaagggtgagcgcgttttacgactatctcaaaggcccgcaggcttctgaaatctttaaacgttatggatttacaacgcaccaatgatactgaccgatcccgaatggcaggcggttttgctgagcctgaaagtctcatccctggccgtactctttagtctgccctttgggatcttctttgcctggctactggtgcgctgcacctttccgggcaaagcgctgctcgacagcctgctgcatctccctcttgtcctgccgccggtggtggtgggctatctgctgctcatcagcatggggcggcgcggggtgatcggcggctggctgcatgactggttcggtatcaccctggcgttcagctggcgcggggcggtgctggcggcggccgtgatgtcctttccgctgatggtgcgcgccattcgcctcgcgctggaaggggtggatatcaagctggagcaggccgcccgtacgctgggtgccgggcgctggcgcgtctttttcaccatcaccttaccgctgacgctgcccggcataatcgtcggcaccgtgctggcctttgcccgttcgctgggggagtttggcgcgactatcactttcgtctccaacattcccggcgaaacgcgcactatcccttccgccatgtacacgctgatccagacgccgggcggggaaagcgccgccgcgcggctgtgcgtgatctccattgtgctggcgttaatttcactgttgatttctgaatggctggcgcgggtcagccgcgaacggacggggcgctgatcatgctggaacttcactttacccagacgctgggcacgcaccgtttacagattaacgaaaccctgcccgccagcggtattaccgccatttttggcgtttccggggccggcaaaacctcgctgattaacgccatcagcggcctgacgcgtccgcagcaggggcgcattgtgctgaaaaatcgcgtgctcaacgacgccgaaaagggcattttcctcgccccggaaaaacgccgcgtgggttatgtttttcaggatgcgcgtctgtttccgcactataaggtgcgcggtaatctgcgctacggcatggcgaaaagcatggccggacagttcgacaagctggtggaactgctcggcattgcgccgctgctcgatcggctgccgggcacgctctccggcggtgaaaaacagcgggtggcgattggccgcgcgctactcaccgagccggagctgcttctactcgacgagccgctggcctcgctggatatgccgcgcaagcgtgagctgctgccctacctgcaacggctggcgcgggaaattcacattccgatgctctacgtcagccactcgctggatgagatcctgcatctggcggataaagtgatggtgctggagggcggggcggtgaaagcgtttggctcgctggaggaggtctggggcagtcgggtgatgaacccctggctgccgccggatcagcaaagcagcgtgctgaaggtcagcgtgctggagcatcacccgcactatgcgatgaccgcgctggcgttgggcgatcagcatttatgggtcaacaggctggatcgcccattgcagtccacgctgcgcatacgtattcaggcgacggatgtttcgctggtgctgcagccgccgctaaacagcagcattcgtaatatcctgcgcgcgaaggtgttgcagtgtctggacgatcaggggcaggttgaagtgcaactggaggtgggcagccggacgatctgggcgcgcatcagcccgtgggccagggatgaactggcgatcaaacccggcctctggctgtacgcgcaaatcaaaagcgtgtcgataaccgcctgatcacaacagatgtttgtagaggtattcggcgatagtctcagtgctgttatcgccgatcaccacatccgcccgcgctttgacctcatcatcggcattgcccatagcgacgccggtgcccgccgcttccagcatactgatgtcattatagttatcgccaaaggcgatcacgtcctgcattgacagcccctgcgccgccacccactgggcaaggcgtttgcctttgctgttgccgcgccgggcgatatccacctgatcgtgccatgaacgttcgcactccagtcccagcgtctgctccacatgcagggcgaaggcatttaacttatcgctgttttcatcggtcagggcgaatttccagatggcctccacctcctgcgccgtctgtttcagggaggccacctgcgtgaaggtcgggcgctgggcttccggtaggttcagcgcccagttgcgggtgcggatcacatggccggtgggcttttcatacaccatcgcatcgtcaacatacatcagggcgtgcacctcatgatcattcagcatatctatcagttgcagcgcctgatcgaccggcagcggatcggactccagcaccgtttttgcatgataatcatacaaataagtgccattacaacaaattgcaggtgtatcaagagccagtgcctgataaaaaggatggatggcaacatgatggcgaccggtcacgataattaactgatacccggcagctttcgcacggttcatggcctcaagcgtggcgggaagcagggttttgccgggggacagtaaggtgccgtctaaatcaagagcgataacgcgcgaggtcatgtcgtattccatatgaatgatgagaaatcagctgccggaatggtacacccgatacggggtcggacaaaatgcacgcgcagaaatccagcattcaccgttaaaaaagactatcctggtaatctacttcactgctttgtgatcaaggagaattcatgaaacaaaccgtttataccgccagcccggaaagccagcagatccacgtctggcgtcttaatccggaaggcgcgctgacgctggtccaggttgttgatgtgccggggcaggtacaaccgatggtcgtaagcccggataaacgctttttgtacgtcggtgtgcgcccggaatttcgcgtgctggcgtaccgcatctcagcggaagacggcgcgctgacctacaccgccgaagcgccgctgccgggcagcccgacgcatatctccaccgatcacagcggtcgcttcctgttcagcggctcctataacgcgggctgcgtcagcgtgacgcgtctcgatgacggtattccgggtgaaaccgtgacggttgccgaagggctggaaggctgccactccgcgaatatctccccggacaaccgcacactgtgggtaccggcgctgaaacaggatcgcatctgtctgttcacgctgggcgaggacggctcgctgtcggcacaggaaccgggcgaagtgaaaaccgtggaaggggccggtccgcgccatatggcgtttcacccgaaccagcagttcgcttactgcgtgaacgagctgaacagcagcgtcgatgtctggcaactgaagaacccgcacggcgagatcgaatgcgtgcagacgctggatatgatgccggccgattttgccgatacccgctgggcggcggatattcatatcaccccggacggacgtcatttgtatgcctgtgaccgtaccgcgagcattatcaccgtgttcagcatctcggaagacggcagcgtgctggcgatcgaaggctatcagccgacggagacccagccgcgcggctttaacatcgatcacagcggtaaattcctgattgctgccgggcagaagtcgcaccatatcgcgctgtatgaaatcagcggcgcgcagggcttactggaagagaagggccgttatgcggtcggccagggcccgatgtgggtggtggttaacgcgtactaaaccggacgaaaaaaaagcccgccatctggcgggcttttttattactcataggttactgcttcggctctgccacaacctgactgcccacgccgcggttgttgaactcccacatgcggttgaactgcgcatcgttcagatcgcgcgtcacgttgcctttgtcatccacgctgccggtgttacccgcaaaggcgcgctgtgtacctgcggccgcggcccagggtttcgccacgttaaagccttcgttgatcacgctgtcgcggatcactacctgaccgttggtcgcggagtcaatatccagcgagcggcccagctgcgccacgccttcaccggcggcgctgaagcggctgttcactgccaggaaaccgtagaagatgttcgcctgagtagccggcgcgaagacataaccttcctgctgggtgcgcgaattcaccacgcggaaatcggtgttgtcaaagaccaccgcgccgcgaccggcaaccagatccacatcgccctcaacgtagctgtctttcaccagcgtacgggtctggcgatcggtacgcagggtattatccacgctgctgttggtgacgaagaaggtgttctggcgacccagaatgttcaccttgttgatctgcactttatcgccatcgctgcgcagagccaccgcctggtggttacccgcatcgacgctgtcgcccaggctgttctggatggtcaggttttgcagttgcaggccattgttctgtgaccagacgaccgccgaacacatcacgcccacggtggcgttacgtttgctctggcaggcatcaaacatataccaggcaggtttacccggcatatatttccctgccggattcaccaggcgacgccaggtgttggtgtccatttcggaatccaccgcgaggccgattttcacgtccagcggtttttcgccggtgccgtacagcgtcaggctgccaggcgctgccggaatatacacggtgccttcatattcgcccggcagaatcgcaatgtactggcgatcgctggtgtgtttattgatagccgcatccacggcggcctggatggtggtatgcgtgacaccggcagtgccagccgggccgacgacaaagttcgcctgctgcggcagacgaatgccggacgggctccatggcgcggcgttcggatccatagacgcgaaatagcgcgccgggacaaaattctgtgcttcattcgcagacaataccggacgggaggcagtccccggcgcggcttgcgtggaaggttgttggtccggtggcgttgagctgcatgcagtcagtgtcacgccaaaagccagtgccagcgtcagacgggaaaccgaaaatgtgttcaagggatgctccaggctatcaggttaaaatgaattccttagaagcctgcttttttatactaagttgagcgaaacgggaagccgattgtttaaatcggctgcaatatcccgaaatatttacccaattttgcacgccgcccgttatggcaggaaatgttccggctcccgaaccgcatcgcataccgcccgcgtcagtgcagagagttgttgcggggtgatgatataaggcggcatcaaatagatcagccgaccgaatggccgcacccatacgccgcgtgacacaaagaagcgctgcaaggccgccatattgaccggctggcgggtttcgacaacgccgatcgcgcccagtacccgcacgtccgccaccgcatccgcctcacggatctctgccagttcacggattaactgggtttcgatagccgccacctgttcgcgccagtcgccgctctccagcagttgtaggctggcattcgccaccgcgcaggccagcggattacccataaaggttgggccgtgcataaaacagcccgcctcgccgttgctgatggtttctgccactgcgcgggtggtcagggtggcggagagcgtcatggtgccgccagtcagggcttttccgaggcagagaatatccggcgcaatgccagcgtgctcgcaggcgaacagcttgccggtgcgcccgaagccggtggcgatctcatcggcgatcagcagaatgccttcgcggtcgcacatcttacgaatacgtcttaaccactccgggtgatacatccgcattccgcccgcgccctgcacgatgggttcgaggatcaccgcggcgatctcatgacggtgtgccgccatcagccgggcaaacggcaccatatcaagctcatcccattcgccgtcaaaacggctttgcggcgcaggggcaaagaggttatccggcaggtaaccctgccacaggctgtgcatggagttatccggatcgcataccgacatcgcgccaaaggtatcgccgtgatagccattgcggaaggtgaggaaacgctggcgcggctcgcctttcgcctgccagtactgcaacgccatcttcatcgacacttcaaccgccaccgagccggaatccgccagaaacacgcactccagcggctccggcgtcatcgccaccagcctgcggcataaatccaccgcgggctgatgagtgatgccgccaaacatcacgtgggacatctcatcaatctgcgctttcatcgccgcattgagctgcggatggttatagccgtggatcgccgcccaccaggacgacatgccgtccaccagtcgttcgcctgtcgccagatgcagctcacagccttgggcagactgcaccgggtagaccggcagcggggtggtcatggaggtgtaaggatgccagatatggcgcttatcaaaggcgagatcgttcggtgtcataatcgacttgtaaaccaaattaaaaacatttaggtttacgagtctacaccaaatcaaaacgtaacacacctttggagacgccccatggctcaccgctggactttgtcgcaagtcaccgaactctttaataaaccgctgctcgatctgctgttcgaggcgcaaaccgtacaccgtcagcatttcgacccgcgtcaggtgcaggtcagtacgctgctgtcgatcaaaaccggcgcctgtccggaagactgcaaatactgcccgcaaagctcgcgctataaaaccgggctggccaccgagcggctgatggaggtggagcaggtgctggattcagcccgtaaagccaaagcggccggttcgacgcgcttctgcatgggcgcggcgtggaaaaacccgcacgagcgcgatatgccctatctggagcagatggtgcagggcgtgaaggcgatggggctggaagcctgcatgacgctcggcaccctcgaagacagtcaggcgcagcgccttgccgccgccgggctggattactacaaccacaacctcgacacctcgccggaattttacggcaacatcatcaccacccgcacctatcaggagcgtctcgacaccctggataaagtgcgcgatgcggggatcaaagtctgctccggcggtatcgtgggcttaggtgaaaccgtcaccgatcgcgccggtctgctgctgcaactggcgaacctgccgacgccgccggaaagcgtgccgatcaatatgctggtgaaggtgaaaggcacgccgctggcggataacgacgacgtggacgctttcgattttatccgcaccatcgccgtggcgcgcatcatgatgccgacctcctttgtacgtctttccgccgggcgcgagcagatgaatgagcagacgcaggcgatgtgctttatggccggcgcgaactccattttctacggctgcaaactgctgaccacgccaaacccggaagaggataaagacgtgcagctgttccgcaagctgggtcttaatccgcagcaaaccgacgtcgtcaatggtgataacgagcagcagtatcagcttgaacaacaactgcgtaacgccgacaccgaccagtattacaacgcggcggcggtatgagctggcagacgcgcatcgatacggcgctcgacaaacgtcgcgcggcgcaggcgctgcgcacccggcgcgtgatggagcagggtgccgggcgctggctgacacacgacggcgagcgcttttgtaacttttcctccaatgactatctgggcctcagccagcatccgcaggtgatccgcgcctggcagcagggcgcggaacgctatggcgtaggcagcggcggctccgggcacgtcagcggctacaccggggcgcatcaggcgctggaagcggagctggcggactggctgggctacccgcgcgcgctgctgtttatctccggtttcgccgccaaccaggcggtgatcgccgcgctggcgggtgaggatgaccggcttgtcgccgacaagctcagccacgcctcgctgctggaagcagcggccttcagcccggcgcagctacggcgctatgcgcacaatgacgtgcaaagcctgacagggctgctggataagccctgcgccggacaacagctggtgatcaccgaaggggtgttcagcatggacggcgacagcgcgccgctggcggaaattgccgccgccgcgcaaagcgcgtccgcctggctgctggtggatgatgcccacggcaccggcgtcaccgggccggaaggacgcggcagctgtcacgccgcaggcatccgcccggaactgctgatcgtcactttcggcaaaggttttggcgtcagcggcgcggccgtattgtgcagcgaggcgctggcagattacctggtgcagtttgcccgccatctgatttacagcaccgccatgccgcccgcccaggcgatggccatcagcgcctcgctggcggtgatccgccaggccgacggcgctgcccggcgggaaaaactcggcgcgctgattgaccgttttcgcgcaggcgcgcaggcgctggatgtcagcatgaccgcgtcacagagcgccattcagccgctgatcgtcggcgataacggacgggcgctggatctggccgcgcggctgcggcaggcgggctgctgggtgacggcgatccgcccgcccaccgtgccgccgggcaccgcgcgtctgcggctgaccctgacggcagatcatgaaccgcaggacattgatcgtttgctggaggcgctgcatgacgccggtgaataaatctgcggtcgccgccgcctttggccgcgccgcgcagggctatgcccatcatgcgcaattgcagacgcaaagcgccgaactgctgctggcgatgaccggtgaacgatccgttgaacgggtgctcgacgccggttgcggtccgggaaccctcagccgttactggcgtgagcagggcgcgcaggtgactgcgcttgatctctccgcgcccatgctcgacgaagcccgccgccagcaggccgcgcatcactatgtgctggcagatattgaagcgatgccctttgaccacgcgcagtttgacctggcgtggagcaatctggcggtgcagtggtgtgacgatctgcatcaggcgttaagcgagctgaaccgcgtggtgcgtcccggtggcgcggtggcctttaccacgctggcggcaggctccctgccggagctgaatcaggcctggcaggcggtggatcatcacccgcacgccaaccgttttttaccggcgcagcagctgactgacacggtgagtggctggcgcggccgcagcgggctcgcgcatatcacgctggattttgacgatgcgctcagcgccatgcgttcgctgaagggcatcggcgccacgcatctgcatgaagggcgtcaggcccaggcgctgacccgcggacaactgcaacgcctgcagctggcgtggccgcaacgcgcgggacgctatccgctgacatattcactattctggggagtaattgaacgtgactgaacgctattttgtcaccggtacggacaccgaagtggggaaaaccgtcgccagctgcgcgctgttgcaggcggcaaccgcgcggggaaaacgcactgcgggttataaacctgtggcctccggcagcgagatgaccctggacgggctgcgcaacagcgacgcgctggccctgcaatgccacgccagcctgacgctggactatgaggcggtaaatccctatatctttgccgagccgacctcgccgcatatcgtcagcgccgatcaggggatccccattgattttggcgtgatgtcagcaggcttacgcgcgctggaaacacaggcggactgggtgctggtggaaggcgctggcggctggttcaccccgctgacagaacgccagagttatgcggactgggtgagacaggaagcgctgccggtaatacttgtggtcggcgtgaagctcggctgtattaatcatgcgatgcttaccgcgctggcggtacgtcaggcggggttacggctggcaggctggatcgccaacgacgtgcagccgccgggcaaacgtcatgcggagtatctggaaacgctgcgacgcgtgctgcccgccccttttctgggggagatcccctggcttgcagacgcgccgctggaacggcaaaacggtcattatcttgatctcagcggtcttgatcctgcgtcatccagtgggaaataagctggtcatctaactgatgcacatgcccctgcgccacgttgcgcccgcgatgcagcaggcagaagcggtcggcaacgcggcggataaacgacaaatgctgctccgccagcaggatggtcatgccgagatcctgattcagccgcaccagtaaattgccgagcttatggataaaggcctggcccgcgccccgcgtcggttcatcaaggatcagcaaacgcggttgggtgaccagtgcgcgggccagcgccagctgatactggtcgtcttcggacaagcccgcgccctttacctggcgcagcgcgtacagttccggaaagagatcgtagatcgccggtgtcaccgcacagcccggctcgcctgccgccagcatcgcaatatgcagattttcctcgaccgtcagctgggaaaagatccgccgatcctgcggcacataaccaatccccatcgccgtgcggtgcgccgccgtcacctgtaacagatccagcggcggggcgctggcttcctgccagataatgctgccgctctctatgggcagattgccggtgatacagtttaccagcgtggttttccccatcccctgtaagcccatcaccgtggtacaggtgccgggcactaaatctaaatccacgttccacagcgtatgctgatcgccgtaatactgatttactgcgcgtagacgtaacatcgggcttctcctgttgctggtggctactggcgctgactctgtaaacgagatgttgcaaaagacttgccacctccgacaaaagtcgtatttttcggagcaggatgaccaaaaagacgggaatttaccgcacgctgagattaccgcagaaaatcctgcacgctgtgggtgcgtggcaggcgaaaagggtgcatcagcgaaacggtttggtcaccgaatcgccaggcttttacccgacggcacactttgttccacgcaaaatttagtgataaaaattttttgttattgccgtctcgcctgaaaccgggaatttgctgagcggcaggggatatggcctggcgggagttatccactattcctgtggataaccatgtgcattagagttagaaaacacgtgagaagcgagagttcatgcggcctggacatgaattgatgcgaaacgcggcttttcagtatatttatttaatatcaataacttgtataaaagcaatgcctgtaaaaaaagtgtcactgactgccacaaaactttcatgacatcacttgacaaatgttaaataggaaaactttttggggataacctttttagcgcagcgttttatgccgcaggcaggataaagtcccgcccgttgcgcgcgcaggtttacgcctccactttcataaactagcctgatactggtttttcatccagtattttttattggcaaaaatcgccgtcgcgagtaaaattaatcacctgcccgctcattcctccaccaggtagccgttcatgagtaaaccgttcaaactgaattctgcgtttaaaccttctggcgatcagccagaggccatccgtcgcctgaaagaagggctggaagacggactggcgcaccaaaccttgctgggggtaaccggttcagggaaaacgttcaccatcgctaatgtgatcgccgaccttcagcgtccgaccatggtgctggcgcctaacaaaaccctggccgcgcagctctatggcgagatgaaagagttcttcccggataacgccgtggaatatttcgtctcctactacgattactaccagccggaagcctatgtgccgagctctgacacctttatcgaaaaagattcgtcggtgaacgagcatatcgaacagatgcgtctgtcggcgaccaaagccctgctggagcgtcgtgacgtggtggtggtggcttccgtatcggccatttacggtctgggcgatcctgatctgtacctgaaaatgatgctgcacctgaccaccggtatgatcatcgatcagcgcgccatcgtgcgccgcctggcggagttgcaatacacccgtaacgatcaggcgttccagcgcggcacattccgcgtgcgcggcgaagtgatcgatattttcccggcggaatccgacgatatggcgctgcgcgtcgaactgttcgacgaagaggtggagcgcctgtcgctgtttgatccgcttaccgggcatgtggaatcgtctatccagcgctttaccgtgtatccgaaaacgcactatgtaacgccgcgcgaacgtatcgtgcaggcgatggaagagatcaaagtcgatctcgccgaccgccgtcagaccctgcttgctaataataaactgctggaagagcagcgcctgacgcagcgcacccagtttgacctcgaaatgatgaacgaactgggctattgctccggggtggaaaactactcccgctacctttccggtcgcgggccgggggaagcgccgccaacgctgtttgactatctgcctgcggatggcctgctggtggtggacgaatcccacgtcaccatcccgcagatcggcggcatgtaccgtggcgaccgcgcgcgaaaagagacgctggtggaatatggcttccgtctgccgtcggcgctggataaccgtccgatgaaatttgaagagttcgaagccctggcgccgcagaccatctacgtgtcggcgacgccgggtccttacgagctggaaaaatcaggggaagatattgtcgaccaggtggtgcgtccgaccggcctgctggatccgattatcgaagtgcgcccggtggcgacccaggtggacgatctgctttccgagatccgcaagcgcgtcgccatcaacgagcgtgtgctggtcaccacgctcaccaaacgtatggccgaggatttgaccgagtacctcgaagagcatggcgaaaaggtgcgctatctgcactcagatatcgataccgtggagcgtatggagatcatccgcgacctgcgtcttggcgaatttgacgtgctggtgggcattaacctcttgcgtgaggggctggatatgccggaggtgtcgctggtggcgatcctcgatgccgacaaagaaggcttcctgcgttctgaacgctcgctgatccagaccatcggtcgcgcggcgcgtaacgttaacggtaaagccattctctacggcgatcgcatcaccgcgtcgatggcgaaagccatcagcgaaaccgaacgtcgtcgcgagaaacagcaccagtacaacgtcgagcacggcattacgccgcagggtctgaacaagaaagtggtggatattctggcgctgggcgagaacatcgcgaaaaccaaagcgaaaggccgcggtaagtcccgctcgccggtggtggaagagagcctggaacgcctgctgacgccaaaagcgatgcagcagaagatccacgaactggaagcgcagatgatgcagcacgcgcaaaatctggagttcgaagaagccgctgccgtgcgcgaccagctgcaccagctgcgggaattgtttatcgcggcgtcctgatcccggccgcgctatgccgctatggtatagcgcggtttgtttattgcgcctcagcatatgccaggcatatacttctctgaatgcagttgtccctgcccgggaggagtaaaagatgagaacggtatcgatattcaaaaatggcaataaccgtgcaatacgtttgccccgtgatctggattttgacggcgtgaacgaactggaaatcataagggaaggcgacaccatcatcctgcgaccagttaaaccctcctggggttcattttcgcaggaagaaaaagccgacaaggatttcatgcaggagcgtgaagatatcgtcagcgacgagggacgttttaaattatgagcatgacctacatgctggataccaatatttgctcatttattatgcgtgagcagccagcgtcggtattaacacggctggagcaggctgtaatgcgccgcaaccgtattgtggtatccgctattacctacgcagaaatgcagtttggcgctatcggtaaaaaagcctcaccgcggcacgggcagctggtgcaggcgttctgcgcccgcctcgatgccatactgccctgggatcgcgctgccgttgatgccaccaccaggatcaaggttgcgctggcggcggcgggtacgcctgttggtgccaacgatgccgctatcgccggacatgctatcgccgccaatgttattctggtgactaataatatacgtgaatttgcgcggataccgggtttgatccttgaagactgggcggaataataatgctacataatattatttaccgctcttattaatcccattaattaaccccaatccctatttttaattgctgtgatctgaataacgctgagctttgcataaatgcctccctgcattaattgatggcaaaatacgcaggatcttttctgcgcttttttattaagctggtttttattatccctcccgtaaaaaccaggaaaagagaatggaatcggtaaaatgtctgttaagagaaaatgaatatgccatggatgatgttcttacctgttcaggtattaacgaagaacatcataaaaattatggcgcggtcagcccaccgctggtgaaaaccagtttattcgtgcagcaggattatcagcgctattgtgacgacatgcagcacgaggcggagcgttatatttattcccgcgggctgaatcccaccacggaactgctggaaaataaactcgccgcccttgagcggggcgaagcctgcaaagcctttgcctccggtatgggggcgattgccgccacgctgttcgcgctgttgcgcagcggggatcacattatcctcgctaataacgtctatggtccgacgctggcactggttaagcaaatgcaggcgcggtttaacattacctttgacgtggtactgagcggcgaagcggcggacatcgcggcaaaaatccgccccggcacgcggattatctataccgaatcccccggcaccatgaccatgcgggtggtggatctgcgcgccatcgcccggctggcaaaagcgcacggcattatcaccgttattgacaacacctgggctacgccgctgttccagaagccgctgacgctcggcttcgatctgacgctgcactcctgcaccaaatacattggcggccacagtgacttaaccgccggggcggtggtgggccgccgcgagcatattgacgcgatccgcgatttttcccatcagctgcttggcgcggtgctggcaccggacagcgcctggctggtgatccgcggtctgcgcacgctgccgctgcgcatgaagcagcatcaggaaaatacgctggcggtactggcctggctgtcggactgcgaagaagtggaaaaactctgtcacccggcggtggcggatacacgcagccgggaattaattgccgcgcaaatgtacgggctctccggtttattcagttttgaattacgtgacggcagctttcagaaagtaaaaacctttattgatagttgtaaaatcttcaaacccggatgcagctggggcggttatgaaagcctaattatttcccccaatcgcggttataacgaggaagatattgcccgcgacggtatggcggcaggattaatccgtatttctgtcggccaggaaagtccgcaattattgatcgccgatttgcatcgcgcttttagcgccattaaaaactgctaaatatacaggaaagatgatgaacgctaacagggaaccgggctttaccgctgcgatgctgttattagcggtagtctttatcgtattttttaccggcatcggtatgttaaattatccggtagaattcattcttattgtcatcactattgtttccggcttttttgcccgctattacggggcaggctggcaggagatcatgcagacgtttatcggcaaaataaaagatgccgtgccggcaatgctgatcctgcttaccatcggcatgttaattggctgctggatggtcagcggcaccattccgctgatggtgttttacggcctggaaattatcaatccggcctatctttacctgacggcctttctggtgacggtgtgcatctcaacctttaccggtacttcatggggatcggcgggcaccattggcgtggcgctggtggcggtggcggccgccatgaacgtttcgttgccggtgaccgccggagcggtgatctccggcgcttactttggcgataagctctcaccgctgtccgacaccaccaacatggcggcgttggcggcaggggcggagctataccagagcattcgccacatgatgtacacctcggtcccggcgtttctgttcgcctgtctcggcttctggattgccggttcggatttgcaggcgacagaggcgctgcaactggacaccattccggtcatgaaaaatgcccttgagcagctattctggctgaacccactgctgatggtcccggcgctgctggtatttgtcggcgccatgcgcaaatgggataccgtgattgtgctggtcgcctcgtcgtttatggcgctcggtcttgccgcttttgcgcagccgttcgcgctggcggatctggttaaggcggcgattaatggctttcacaccagcatgatcccggatttcagttcggtgccgatgaacgaggcgaccagtaaaaatatcaacacgctgcttaaccggggcgggatgtactctatggtcagcccgattgtggtgatgctgtgcgcttttctgtttgcctcggcgctggacgtgtccggcgggcttaacgttattttgcagcggctggtgaaaaagctcacttcggtgaccagcaccgtgctggcaaccatgctgaccagctcgctgctggtggcctgtaccggcaatgcggtgatcagctttttcctcgtcaaaaacatgtacgatccctgctttaaaaccaaaaagctgcatatggtaaacatgtcccgcgccatggagtccggcgcgacgctgctggaagggctgttcccctggaccatttcagggatgtttatggcgaaaaccctcggcgtggcgacgctggagtatgcgccctgggtgctgtttaatctgagctgcttcgtgatggcggtactgtacgcggtgctggcgcgctggtccgctttcggaacgcgttacgaaacggagaatgagaggggcatcacatcgtaacgcatttattcatacggcttaatctaaccttaatcttgcgcagcgacactgtcctcagcttaatgaggacagtgccatgcaaaaaataacttccgtacaattactcgcccttgctgccacgctgatgatcgtcgccagcttcctgcatacctggtttaccgtctgagcgccgcctgagcgcgggcatccggaaaccgtacccctgcacgcagcccaggtcctgggtggcgattatgtaaaaataactccccgtcatgtaactgggcgatacggctgacgatactcagacccagccccatgccgccgtaacggctgtccatacgcacaaaggctttgctcagctcgtggctggaggcttcatcaatgccggggccttcatcttcaacggccagtacaggggcgtcgtcatcgctgacggtgagggtaatggtggccagctccgggctgtaacggtgcgcgttttccaccagatttctcagcagaacgcgcagttgcggcgcatcgccgctcaccgcaatatccccggcgttttccggccacactaatttctgctggcgtgtgctcaccatggtgagcagttcgtcctgcaagggcaggatcacatcgcggatcagcatcacctgctgatagcttcccgccgagaacgactgcgccacccgtgccagttgcagcaactgcgagacgttttccgtcatctgctcaatgcgcaaaatgagatggctgacgtcaatcgcatggcttttcgacaacaattccagatgcagccgcagcccggcgagcggtgtgcgcagctcgtgagccacgtccgcggtgaacaggcgctcccgatcgagagtcaccgtcaggcggcccaccagctggttgatcgccgtggtgaccgcttcgacttccggcacgggtttttccagcgcgatgggttgcagattgtccggcgtgcggatctccagttcatgctgcaaatcttttaatgggcgggtgatgcgttttatcgcctgtaagcacagcaccagcgcaaggccgatgatgaccaggcttgggatgagcaggctggcgaccgcttcgtgcacttcatgtttaatattgctgtgattgttggctttgtagatctcgctttccacaatcagctggatctgctctttgctttcatgccacagccagaacacgctcaccagctggcagaccaccagaatggtgccaatggtcagcagcaagcgacgccgcagcgtccagtgtcggaaattcatgctttactgctctcccggcgtttttaccagcagatagccgaagccccgcaccgtacggatgcgatctttacccactttgtcgcgcagattatgaatatgcacttccagggtgttggtggccggttcgttatcccagctgtaaatatcgttgtatagaatttcccggtgcaccgcgttgcctgcttttaacatcaggcgcgaaagcagggcgtactctttcggcgtcagctccagcggcctgcccgccagcttcacctgacggttattcacattcagttgcagatcgcccacagtcagttcgctgtcgccctgattatgctgacggcgcagcagggcgcggatgcgggcgttgagctcctccagcgcgaagggcttcatcagatagtcatccgcgcccgcatccagtcccgatacgcgatcctcaacggtatcgcgcgccgtgagcaccagcaccggcagggcgcatttttcgcggcggagtcgctgcaaaaaatgcacgccgtcttcatcgggcagtcccagatccagtacgatcaggctgtaatgccccatcgccaggctctgcgaggcctcccgcgccgtagagacgccatcgcaggcgtaaccttcggactgcatcgccagcagcaggccctgcaataacagggtatcgtcttccaccactaagattttcatcagcattaccccctgcacggcgcgagaatatcatctgccgcatgatactcgctggtttgtacgcccactaaccctaacatcgttgagaacagattatcctgggaaaatgcttccgcgctggcgcgttttttcaggcagctgtaattcacagcgtgacctttctgatactggtcggaaagccagatcaccatcggaatatgtttttgtgaatccggcgcgatggaatagggcagaccgtgcaaataaacgccattttcacctaaggattcgccgtgatcggaaagatacatcaggctggtggtgacgttgtccggctgcgcctgcaataatttaatcgccttatcgacaatataatccacgtacagcaccgtattatcataggtgttaaccagctgctcgcgggaacaggtctggatttcattggtgtcgcaggttggggtgaatttgcggaactgcggcggatagcggttatagtaggtcggcccatggctgccaatagtatgtaatacgatcagcccgtcaccgggaaaactgtcgatagatttttgcagatcgtgaaacagaatttcatcctggcattcgcccgcaatgcaataatctgccagattcagtttcgtcatatcctggtgcggcacacggtcgcaggcacctttacagccgccgtcattttcattccactgcactgatattcccgcgcgctgcacaatatccagcaaaccttcacgatgatgcgcgagttgttcattgtaatttttgcgcggcatgccggaaaacatgcagggcaccgaaattgccgtcgccgtcccgcaggaggtggttttcgggaaatagaccacattgtctttcgacagcagcggattagtatctcgtggatagcctgacagcgcgaagttatccgctcgggaagtttcgccaacgatcagaatagtcaggtgtttggtctgcggcttgtgcatcgcgggggtaagtgttgcgtcctcgcccagccggaccagcggcagattatccatacggtgatgaacatcataagacaggagggcgctgatgctgttcgacgggccaagggatttcaccagctctttattattgcgaaacagcgaggcgtaatctttataaaagcaggcggcgataagcaatattatcgccacagacgcgagaatattcacacagcgcatagcggcgctatgtacacgcgtacggctttttttgaatttcaccacaaaggcgaggatcgccatggcaataccggaaaggcctatggtcaaaattaactgcggcgtcatcagggcgaaggattccgctggcgtggtatccagcatattggcaatcatcgagcggtcaataatgatgccgtaggtccagatgaaatactgcgtggcggcgctgagcaaaataaacaccgcgatcaccagccgatccagccacagaaaagaagccagcgttgcgatgatattaatcacgctgaacgccaccagcggcatcgacagaaacaccgccagattgtaagccgagttaacgggtaacagggcccaggcctgacggtaataaatgaggttgaggaaaacagcaatataaacagaaaacagcagcaaaaaagtcaggcgactcattgcagggcggcgaagcggaatacggcgcatagtgaaggtcctgtgagaatataccaggcatgttcacagacaagggttaagccaaccttaagaacttaagaaagcgctgagtaaagtgtttcccctcgtaacaggcgaggggaatgctgtcagccaaggctttgcaccgcacgctccagcgccgcgcgcagcaggcggcggtcatggcggtagggcacgtcgctggcttccagcacgtcctggatcacgatgcggtctgtcaccgacgaaacgtccaccgtcgggccaaccaccaccgcgtcaataatgcgtttgccgacgtactgctccatcagcgccagcttgtcgttcaggctgaggctggcggcggcgacgctgagttctttgccaagattaccgatatagaccaccggagccggagtgcggcgcagcgcctgcgccagattgtcgagcagcagcagcggcagcaggctggtgtaaaaactccccggcccgattaaaatcaaatccgcttcggcaatggcctgcaccgcctcgcgggtggcctgggcgctggggaacagcatcagctcctgcaccggctgcgtcagctgatcgatattcacttcgccatataccgcatggccttcgctgtcgagcgccatcagatccagcggctgctccgacatcgggatcagaaaggcgtccaccttcagcagattacggatcaggttaatggcctccagcggccggacgctgagatgatccagcgctttcagcatcaggttgcccaggttatgccccgccagctcgccgttgccggtgaagcggtactcgaacatcgccgaggcgacgcttggctcggtgataagctggttaagacagttacgcatatcgccccaggcgatgccgccttcagaacgacgaatgcgtccggtcgagccgccattatcggtggtggtcacgatgccggttaaacgggagccgagcgaggagagggaagacatcacccgtcccagcccgtgcccgccgccgagggcgacaaccctgtcgagatccgcaagagtgcgattgcgcatagccagtccttatgtcgaaaaaatcacgttacgttacccgaaatacccctttatgacgatgtcacgtcggggggaagatgacacatatcaatgcaaggccgggattatcgcgtagtctgtaatgaaaatgcacgattatgtcgctatgtagttaattatatagcgctatgcaaggatggcggaacaggtcgtatcgcgatattatcgcctgagcttgctaactaaacacactctagcctctgcgcctacgtcttaatgatagggtgctttggccgtggcgaaccgccaccagggtgcaggaagaaatgactgcacctcccgtatctggaaaggtgtacatggcctcacaacttaccgatgcattcgcgcgtaagttttattacctgcgtttgtctattaccgacgtgtgcaattttcgttgcacctattgtctgcccgatggctacaagccgggtggcgtgacgaacaaaagctttctcagcctcgacgaaattcgtcgcgtcacccgtacctttgccgcgctcggcacggaaaaagtgcgtctgaccggcggggaaccctcgttgcgccgcgatttcaccgacattatcgccgcggtacgcgaaaacgccgctatccgccagattgcggtgaccaccaacggttatcgcatggcgcgcgacgtgcagagctggcgcgatgccgggctgacggcgattaacgtcagcgtcgacagccttgatgcccgccagtttcacgccattaccggccaggataaattccgccaggtgatggacggcatcgacgccgcctttaccgcgggctttgagaaagtcaaagtgaataccgtgctgatgcgcgatgttaaccatcatcagctggatacgttcctggcgtggatccagtcgcgtcccatccagctgcgctttatcgaactgatggaaaccggcgagggcagcgagctgttccgcaaacatcatctctccggcatggtgctgcgcgatgaactgctgcgccgtggctggatccagaagctccgtcagcgcagcgacggcccggcgcaggtgttctgccacccggactatgaaggcgaaatcggcctcatcatgccgtatgagaaagacttctgcgccacctgcaaccgtctgcgcgtctcgtccgtcggcaagctgcacctgtgcctgttcggcgacggcggcgtcagcctgcgcgatctgcttgccgatgacagccagcaggctgcgctggaagcgcgaatttcagaggcgctgacgcataaaaagcagacccatttcctgcatcagggcaataccggtattacgcaaaatctgtcgtatatcggcgggtaacaccgaataaggagatcctttatgagtcaggtcagtgcagattttatcccgacccgtatcgccattttaaccgtcaccagccgtcgcaccgaagaggacgatacttccggccactatctgcgcgacgccgcgcaggaagtcgggcatcacatcgtcgacaaagcgattgttaaagagaaccgctacgccattcgtgcgcaggtttccgcgtggatcgcctcggacgacgtacaggtggtattaatcaccggcggcaccggattcaccgccggcgatcaggccccggaagcgctgctgccgctgtttgaccgcgaagtggaaggtttcggggaagtgttccgtatgctgtcgttcgaagagattggcacctcgacgctgcaatcccgcgctattgcgggcatcgccaataatacgctgatttttgccatgcccggctcgacgaaagcctgccgcaccgcctgggaaaatatcatcgccccgcagctcgacgcacgcacccgtccgtgcaattttcatcctcatttaaagaaataaaccatgtctcagttgacccacattaacgccgcaggcgaagcgcatatggtggatgtgtccggcaaggctgaaaccgtgcgtgaagcgcgcgccgaagcctttgtcaccatgcgcccggaaacgttacagatgatcattgacggcagtcaccacaaaggcgatgtgtttgccaccgcgcgcattgcgggcattcaggccgccaagcgcacctgggatctgatcccgctgtgccatccgctgatgctcagcaaagtggaagtcaatcttcgcgccgaacccgaacatcaccgtgtgcgcattgagtccctctgccggctgaccggaaaaaccggcgtcgaaatggaagcgctgaccgccgcctccgtggcggcgctgactatttacgacatgtgcaaagccgtacagaaggacatggtcattggcccgctgcgcctgctggcgaaaagcggcggaaaatccggcgatttcagggtggatagcgatgattaaggtgctgttttttgcgcaggtgcgcgaactggtggcctgcgacgggctggacgttaaggccgaatatgcaagcgtagaacagctgcgtgcggcgctggcggcgaaaagcgatcgctgggcgctggcgctggagtccggcaagctgctggcggcggtcaatcagacgctggtggattttaaccacccgctgcgcgaaggcgacgaagtggccttcttcccgccggtaaccggaggttaagctgatggaaaatacccgtatccgcgtgggtcatgaaaatttcagcgtcggcgacgaatatcagtggctggccgcctgcgatgaagacggagcggtggtcacctttaccggcaaagtgcgtaatcataatctgggcgacagcgtcagcgcgctgacccttgaacactatcccggtatgaccgagaaagcgctggctgagatcgtcagcgacgcccgcgcgcgctggccgctgcaacgggtatccgttattcaccgcatcggggaattatggccgggcgatgaaatcgtgtttgtcggcgtcaccggcgcgcaccgcagttccgcctttgaagccgcgcagtttattatggattatctgaaaacccgcgcgccgttctggaagcgtgaagccacgccggaaggcagccgctgggtggacgcgcgtgacagcgataagcaggccgccgaacgctggtgacccgctttcgcagggatgtgttaaccttatagtctcttcacttaatcaggagttaatcatggacagatacccaggaagcggttcgattgtcgaggcgcgcagcgggctgcaaacctatatggcgcaggtgtatggctggatgacctgcggtctgctgttgaccgcctttattgcctggtattctgcgaataccccggcggtaatgatgttcgtcttctccagcaaaattacctttttcgggctggtgattgcgcagctggcgctggtgttcgtgctttccggcatggtgcatcgcctgagcgcgggtatggccaccacgctgtttatgctctattccgcgctcaccgggctgacgatttccagtatttttatcgtctacacctactcctctattgccagcacctttgtggtggccggcgggatgtttggcgcgatgagcctctacggttacaccactaagcgtgatttgagcggcttcggcaacatgctgtttatggcgctgatcggtatcgtgctggcttcgctggttaacttctggctgaaaagcgaagcgctgatgtgggcggtgacctatatcggggtgattgtgtttgtggggctgacggcctatgacacgcagaagctgaaaaacattggcgagaatatcgatacccgcgacagcactaacctgcgtcgttattcgatcctcggcgcgctgacgctgtatctggactttattaacctgttcctgatgctgctgcggattttcggtaaccgccgctgataataacagagccgggcggcacgttgtttgcccggcctacgttatctacagaacgcgtaggcccggatcgctgcgcgccaccgggcgatactaatcttacttcgccatcgccttctcgttcttcgcccgtagcttcttcgcccggctttccagcagcaggtaacacaccagcgccagcagcagcgggataaagtaatacagcatacggtaagcgagcagggcggcgataattgcccctttagacgtatgttcccccgccagcagcgcaataaacaccgcttccagcacgccgatacccgccgggatatgaatgatcacccctgcgatactgctcaccagcaggacgcccagcacgaagaaatagttcacttcctggcccagcagcagccagataatagcccccatcgccatccagttggcgctggagatcgccatctgcgccagcgcaaacttccacgacggcagcaccagcttctggcctttgatggtggcatggcgacgtttggcaaaggcgcagaaccacatataggcggcgataaacgccagcagcaccacgcccgcaatacgcagcgtaccttcgtcgatataccagtgggcgggcagttccaccacgccaaaggtgaagataatgccgccaagcagaatatagcccagccagttcgtggtgatactcagggagaaaatacgcgtgatggtgctgcccggcagccccaggcgggaatagagccggtagcgcatgccgataccgccaacccaggtgcttaacgtcaggttaaaggcatagcagacaaaggacaccagcatcacctgccgcgccgccagcttatgcccgcagtaggtgcgcgccagcagatcgtaacagccgtagagcagatagctcaccaccaccagacccagcgcaatcagcagcgtcgtgcggttatagttgcggatcacctcccagacatcttcccagttcaccgtgcgcgcatacaccaccagcagaactgccatggcgataaaaaacacccatgtcaggatttttttggcaagacgccacttcggatgcgattttgccatcagggttttacctcagagttttcgggagtgacacgatcctgggtttcgatttcaggctgtaccggcgcgggcacctgcgccagccgcggcgtatgggctggcaaccatcccaccagcgccgggaatttacgcaggaagtggaacaccaccacgttgatggccaggttccaccaggtgcgcttcggcgccatggtttcatccacgcgcttacagtcattagcgataatcgcgttgagattctcgcgtagcgtctggttaaactcgcggtcatgaatgatcaggttggcttccagattgagcgacaggctgagcggatcgaggttgctggagccgacggtcgcccagtgatcgtccatcagcgccactttgccgtgcagcgggcgacgccggtattcatacacctgcacaccgcctttcagcagatagttgtacagcagttccgcgcccactttcacaatcggcatgtcgggttcgccctgtacaatcaacttcacccgcacgccgcgccgcgccgcattgcgcatggcatgcagcagacgatagccggggaagaaataggcgttggcgatgatcacctcgcgtttggcattggcgagcattttcaggtagtgacgctcaatgtcgtcccggtgatcgtcgttgtcgcgccagacgaacagcgcctgcgcctcgcctggggtgcggttttcctccgccagatgacgacgacgctgctgccaccagcggcgggtttgcgcgttctgcggcaggttttccagttcaaattgcagaatatcctgcaccaccgggccttccacccgtactgcgtaatcctgtttggcttctggtccgtaatcggacatatgttcggcagagtagttaatgccgccgacaaaggcgatggtattgtcgatcaccacgatcttgcggtgcattcggcggaacacgttggtgcgcatgcccatcagcggagggcgcggatcgtaatagcggaacaccacgcccgcagacgtcagttgactgacaaattcgtcgctcaaatccggtgagccgtagccgtccaggagtacttccacatccacgccgcgctgcgccgcgcgcaggatcaccgcgtgcagctgtttgccgacctcatcctcaaaccagataaaggtttcgaggatcactttgcgctgtgcatgatcgattgcatcaaacaccgcgggataatattcgtcaccgttttccagaagctggatacggttcccttctcgccagccacatttcataaatggatctccgcgctcagcggcgcatgatcggacaaatgacgccagttgcgcagcggaagcgccgtgggcgcgctggcactggcatttttcacataaatacgatcaagacgtagcaccgggaaactaaccggaaaagtacgcgccggacggccatgcgcccgcgtaaaaatctcttccagtccggccttcgtttgcaggggacgatttgccttttgcagccagtcgttaaaatcacccgccaccagcaccggctcaccttccgggaaggcatttacccactcagccagcatatccagctgcgcctgccgatgcgcctcgcgcaggcccagatggacgcaaatcacgtggattggccggtcatattgcggcggcacaatgcggcagtagagcagaccgcgattttcgctgccctccaccgacacatcacggttttcatagtgttctatcgggtagcgcgacagcacggcattgccgtggtgcccttcagggtagaccgcattgcggccataggcaaagtcgctccacatggtatcggcgaggaattcataatgcgtggtatccggccagttctcgacgtgcagcgggtgcacttcatgcgcgcccatgacctcctggaggcagacgatatccgcgctgacggtgcgcaccgcatcgcgcaactcaggcaaaatgaagcgtttattaaatgctgtgaagcccttgtgcgtattaatggtgagcactttcaaagaaaactgtcgggtttgttgcgtcatttttatccttcccgcgtcactatcctgatgaaaataaagtgtagtccttgtcacaaaaagatgcggccttacggatttttccgtaaagtccggtactctcaatacagttagatatccgttaaggagataagccatgagatggcaacagcgtattcgtgtcgcaacaggcttaagttgctggcagattgtgttgcatttaatggtcgtcgcagtgctgataatgggctggatgagcaaggcgctggtgcatgtcggcctggggctgtgcgtggtctatggcgtcaccgtgctgctgatgctggcgctgcaacgtcaccatgaggcgaaatggcgcgaactgggggatttcctcgaagagctgaccaccacctggtattttggcgcggcgatgatcgtgctgtggctgctctcccgcgtgctgcaaaataacctgctgctggcgctggcgggcgtggtgatcctcgccggtccggcaatcatttcgctgctgatgaaagataaaacctcaggccactttacgacgaaacatcgcgtacgccgctgaacctgtcgtggccgttatcaccagtaacggccataaacttccccatacgatccccagactcgcatccttgagataaatttgcttggtaatgtcggtgaaatggcggatcggattcacccacgtcagattctgcaaccagacaggcatgttttccaccggcgacacatagccggagagcaaaatcgccggcatcataaacacgaatacgccgataaacgcctgctgctgggtggcgcagagcgacgaaatcaacagcccgaagcccaccagcgacagtccgtaaatcaccatggtgaaataaaacagcagcagcgatccggcaaaggggatctgataggcaaaaataccgatggccagcacgatggtggcctggaaggtggcgacgattaacgccggtaccgccttgccgacgaagatctgccaggtcgccagcggcgacaccagcagctgatccagggtgccctgttcccgctcgcgcgccaccgacagcgaggtgacaatcatcacgccaatggtggtgatcatcgcaatcagcgacggcacgacaaaccatttatagtccagattcgggttataccagttgcgcaccaccagttcgctgttattcggttttggccgatcccccagcaactcctgctgatagtctttgacgatttgctgtaaatagttggcggcgatctgtgcgctgttggagttgcgcccgtcgaggatcagctgcatcggcgcaggctggaagctatccagattgcgcgagaaatccgccgggaagcggaccagcagcagggctttttgctggtcgatggtcggcttgatctcctgcggactgttgagcatgaggacgtgcgtaaaggctttcgcccgcgcaaaacgctgggtcagctcgatggcatgtttgccgttgtcttcgttatagatggctatggtggcgttggtcacttccagggtggcggcaaagggaaacagcagcacctggatgagcaccggcagcacgagaatggcgcgggtttgcggctcacgcagcagcgattgcagctctttgcggattaacgtccagagtcggtgaaacatgtttgctccttaaaacgatcctgacgaccttgttggcccggtaagcgcagcgccaccgggcataatcaatccagccgccgtttggttttcatccacgtcaggccgataaacatcaccgccgaggccaccagaaacagcgtattgatcaccagcaccgtcgggatgtttcccgccagaaacaggctttgcagggtactggcgaaataacgcgccggaataatgtaggtcaccatgcggatggcggcgggcatactgtcgatctgaaagataaagccggacagcattaccgaaggcagaaacgcggcgttcagcgccacctgcgcggcattaaactggttgcgggtaatggtcgaaatcaacagccccatgccgagcgtgctcagtaaaaacagactggtgatcaaaaacagtatcaacagcgagccgcggtagggcacgcccagcacgaacaccgacaccagcatgcacagcagcatcgccagcatgccgagaaaatagtaggggatcagcttgcacaatagcagctcgccgcgcgtcacctcggtggagagcagcgcctccatagtgccgcgctcccactcccgcgccaccaccagcgaggtaagaattgcgccgatcaccgtcataatgatggtcaccgcgccgggaataataaaatgttggctgatggccgccgggttaaaccagtagcgcatctgcacgtcgatcagcggttcaaaggtttccccacgatcgctggcgcgctgggtctgccacagctgccagatgccctgcacatagccctgcacaaagttggcggtattcggctcgctgccgtcggtgatcacctgcaccggcgcatcatcgccggggcgcgccattttttcggcgaaatccaccgggatcaccaccagaccgcgaatgcgtcccgcctgcatcatttcaatcagctgtggacggctgttgctgatggtggcgtcaatatagggggagccggtcattgcatgggtgaaatccagcgcctcctcgctgcgctgctcaagcaaaacgccgacgcgcagcttgctggaatcaaggttaatgccgtagccgaagataaacagcaacagcagcggaatgacaaaggcgatcagccagctgctggggtcgcgcacgatctgccgcgtctctttcacgcacagcgcgcgcacccgccgccagcttatagcggaactactcattggcatgctcctcgtcccagtcgttgatcaggcggataaaggcctgctccatggtcggatccggctgcgcatcgtcggcggcctgcgctttaagatcgtccggcgtaccgctggcgatcagcttgccgcgatacaccaggccaatacgatcgcagtactccgcttcgtccataaagtgcgtggtcaccatcacggtgacgcctttttccaccatgctgttaatgtgcagccagaattcacggcgggtgaggggatcgacgccggaggtcggctcatccagaaacagaatatccggctcgtgcatcagcgagcaggccagcgccagccgctgcttaaagccgagcggcagagagtccgtcgcctgtccggccagcgttttcaggccgaacgcctcgctcatacggttgattttctcctcctgcgcccgcccacgcaggccatagacgccggagaaaaagcgcaggttctgttcaacgctcaggttgccgtacagcgagaatttttgcgccatatagccgagatgctgccgcgctttgccggagctgactttcagatccatccctaacaccagcgctttaccggacgtcggcaccagcaggccgcacatcattttaaaggtggtggatttccccgcgccgttcggcccgagcaggccgaagatctccccgcgtttgacgctgaaatccacgtgatcggtggcggcgaaatcgccgaattttttggtcagggactgcgcttcgatcaccgtttcgtccacgctgccagtaacggtgtgcagaatagcgccgagcggggattctgacgcccccgcgccgccgagcagatcgataaaggcatcctcaaagcgcggcgcggtttcagcgatctcaatgtccggcataccgggcgcctggcgaatatcgtcggcggtggcctcttttttgaggatcaggcgtaccgatttgccctggatcatgccgtcgctcacctgcggcagcttcagcgcgcgctgcaacagacgacggttattttcctgcgggctgtgcagcagaaaactgcgtccggcgatggtttgcgtcagcgcttttggctcgccctgatacagcagctcgccttcgttcatcagcagcacatcgcggcactgttccgcctcgtccagataggaggtgctccacaaaatcagcatgccgtccccggccagctcatgcaccatctgccacagctcccggcgggagatgggatcgacgccgacccccggctcgtccagcagcagcactttcggctcgcccaccagcgtgcaggccagccccagcttctgcttcataccgccggaaagttttcccgccagccgcccggtgaaggggccaagggccgtaaattccagcagccgggcaaaagtttgttttcgcgcttcgccggtgacgctgcgcagatcggcatacagattgaggttttccatcaccgttaaatcttcgtacaggccgaatttttgcggcatatagcccagcaccgcatgcagagcgcggtcgtcctggacaggatcgaagcccagcacccgcgcttccccctcatcaggcttcatcagcccggccagcatccgcatcagcgtggttttgcccgcgccgtccggcccgaccaggccggtgacgtagccggaggcgatcccgcagtccagccgcgccacggcgggcttgtccatcccggcaaagcgtttaaccaggccgcttaactggatgccgtcattactcatgcgccgcggcatcctggaaggtggcggtgatcggcatcccctggcgcaggttatcgtcggcatcggtgacgataatgcgcaggcgatacaccaggtcggtgcgcagatccggcgtctcgacagttttcggcgtgaactccgccgttggcgaaacaaagccgattttgccgtgatagggcttatccgggcggctatcggtatagagcaggatttcgcggcctgggcgcgcctcgccgaggctctgttcattgatataggcgcgcacccacaccgggcgggtgagggacagggttaacaccgtgctacccgcattcagcatactgcccggctccacggcgcgggtcaacaccgtaccgtcggacggcgcgaccagcgtggtgtcatgcagatccagctccgcctgggccagctgcgcctgtgcctgttcaaggcccgcttttgcctgggcgatttcctgcggccggttcccggcgcggaactggctgagcttatcctgcgccgatttcaggctggcctgcgcctgatcccgtgacgaacgggcattttccagatcgttggcggagatcacccggcttttccacagcccctgctggcgctgataaaagttttgcgcatagtcataggccgcgcgcgcctgattgaccgccgccaccgcctgggcgatctcctcatcacggtagcccgcaatggtcagatcgtatttcgcctgcgcggtggagacattggccttcgcctgcaacagcgcgttctcataaggggcgcgatccagcacgcccagcgtctggcccgctttcagccggtccccttcatcgacgttcagcgtctgtaaacggccgccgacgcgaaagctgagattcaccgtgcgaatatccacgttgccgtacagcgtcagcggctgatcctgacggctctgataccacagcgtgcccgcgccgataacagcgagcaccgccaccatcgccagcgcgataatcaccggttttttcatgactcctgactccttaacgttaatccttcgaggataagatcgagatggcagcagatgacttcatagatttgcgcgcattttccggcatcaaacgcctgccagcctgcgcgcagtaaaatggtttcccgtccgagacggaaggcgaggatctcgccgagcagggcgtgagtgtgcagaatcgtgcgcgtatccccggcgtcgcgcccggtaaaggcggcgatcaggcgcgttaaatggctatgtaagggatcgatcacctgctcatggatcaggtgataggcgcgggtaggggagagctgctcgcgggagataaatttgctcagcggcagggtttcatcttcggtcagcagctggatcatattgttgcaggcgcgcaggatcagctcgcggatggcggctttgtccggtgcgggctgcgccagcagacgctcggcggcctcggcatgggcacggaaattctcgccgataaagtcggcaatcgactgggcgcaggcgaggtaaagatcctctttcgaaccaaaatagtaggggatggcggcaatgttttgcccggcctgcgcggcgatctcgcgggtggtggcattcaggccatactcaccgaactgcgccagcgctgctttgatcagcaggccttttgcctgttcgcctttgctggttttcagggatgcattcatggcgtcattaaaaattaatcaatcgattgattaacattatgcctgttttttgaccttgtccagtacagtgaattattttgctgacaaccgccttcgggataatttatgcggtatgtcacaaaagctgctacactccgcctcttcatgacattgtggtttttgtcatccgtcacgttactgatctccctgaaaactacaccggtaacggtcggggcggttcggagttgttatgtcttttgatgaactgggtttaaaccctgagatcctgcgcgccgttgccgagcagggctaccgcgaacctactcctattcagcagcaggccattccggccgtgttgcaggggcgcgacctgatggccagcgctcaaaccggtaccggcaaaaccgcaggcttcacgctgccgttactgcagcacctggtgaacaacgagccgcacagcaaagcccgccgtccggtgcgcgcgctgatcctgacgccaacccgtgagctggcggcccaggtgggcgaaaacgtccgtgaatacagcaaatacctgaatatccgctcgctggtggttttcggcggcgtgagcattaacccgcagatgctaaaactgcgcggcggcgtggacgtactggtggcgacaccgggacgtttactggatctggaacaccagaacgccgtgaagctcgacagcgtggagatcctcgtgctggacgaagcagatcgcatgctcgacatgggtttcattcacgacatccgtcgtgtgctggcgaagctgccgaaaaagcgtcagaacctgctgttctccgccaccttctcggatgagatcaagggacttgcggaaaagctgctgcataacccgctggaaatcgaagtggcgcgtcgtaacaccgcctctgagcagatcacccagcacgttcactttgtggataaaaaacgcaaacgggaactgctgtcacagctgatcggccagggcgactggcggcaggtgctggtgtttacccgtaccaagcacggcgcgaaccatctggcggagcagcttaacaaagacggcatccgcagcgcggcgatccacggcaataaaagtcagggcgcacgtacccgggcgctggctgatttcaaatccggcgatctgcgcgtactggtggcgacggatatcgccgcccgtggactggacatcgaagagctgccgcacgtggtgaactatgaactgcctaacgtgccggaagactatgtgcaccgtattggccgtacaggccgtgctgccgccaccggcgaggctttatcgctggtgtgcgtcgatgagcacaaactgctgcgcgatattgaacgtctgctgaaaaaagagatcccgcgtatcgccgtaccgggctatgagccggatccgtccatcaaggcggaacctattcagaacggtcgccagcagcgtggcggcggcggtggacgcgggcagggcggcaatggccgcagccagcagccacgccgtaacgacagcgcagcgcctggggcacgccgtagcagcgagtcaaaaccagccggtgaaaaaccgcgtcgtccgcgtccgcgcaaaccggcggcccagtaaccggaacgccctctcctgcgggagagggaaaatccgcgttgtcactttgtcagcggatcgctaacatacgcttcactctgtgcggagcgctctgatgatcgataaacattctgccgtcccggtatatttacagcttgaacagtatctgacccgccgtatctgcgccggtgatttacgtccgggcgacgtcattccatcggaaaatgaactctgccagcagttttcggtgtcgcgcatgaccgcgcgcaaagccgtggattatctggtgcgtcagggaaaagtggagcgccgtcgcggtcagggcacctttgtcgcccatccaaaaaaaatcctccgcattccgttacctctcgatcgtcatctctcctccagcgaagccaccctcggtcttgatgatccggtgataaaccgcctgatctgcctgtcccgccagcctgcgcccggtgatattgccgacaaactgcaattgcaggccggggaagaggtctggtttatgaaacgcctgcgcctgctggatgacatccccttcgtgtttgagcagtcgtggatgttactcgccccgttttccgatctgagcgaagccgatctcaacgcttcgaaatacgcttacatcagccgcaagggacataccgtcgcccgctcagagaaagagatccgcgccgagctgccgtcccaggacgtgcgggatatgctcggtattaatcgtgacgaacccgtactacatgccacttccgtcgcctggcttgcggaaggcattcccttcgaagtttctgaaatctattacaaccaacagcattaccgcttcacgcttaccgctgaacggccgtaaataacggcgaatttgtgatccatctctggttataaaataagtgggctagacaactatacatgttaactggctatactcatggcaggtcttcgatccgtaaatcacttacttcaataaggatcacgctatgagtcgcgctggcgagtttttacaagatttaggaaaggcattaatgatgccgatttcggtgattgccgccgccgggatatttcttggccttgcagcggcattgcagaatccggcgattgtcagtgctgacatgatgaatgcgcagatgatgcagcacatcatcggttttattcgtaaggtggccggatcgctgtttgccaatttaccgttgctctttgccattgccgccgccattgggctggcgcgggatgaaaaacccacggcggcgctggcagcggtgatcggctttattacctttcacgtcggcgtcaatttcagcctgctggtgcagggcttaacgcccaccaccacctccgtggccgcctttgttgaaaaaggttatagccagaccgaagcggtgatgtattccgcggaattcgccagcacgctggggatattttcctatcagatgagcgtactcggcggggtgattgccggtatggtcacggtattactgcataaccgtttttatatgattaaactcccggcggccatcgcctattttggtggccgccgctttgtccctattattaccgtggtggtcctgccgctggtcggcgtcttaatgtcgttaatctggccggttattgccacggcgattattcatatcggcgaatttattggcgagtccgggccgttcggcacctttgtttatgcctttaccgaacgcattctgatcccgaccggcctgcaccatattcttaatgaaaccgtgcgtttcaccccggtcggcggcatggtgcatgtcgataacgaaagcgtgatcggcgcgctctctatcttcaactatgcgctggcgcatcctggcgcgctggcagatgacattacccgcgaagccacgcgtttcctggcgcagggcaaaatcccggtgatgatgttcggtttacccgctgccgcgctggctatttatcgctgtgcccgacctgagcataaacagcgggttaaagcgctgatgatggcgggcgcgctggcctcctttaccaccggtatcaccgagccgctggaattcagcttcatctttgtctcacccatcctgttcatattccacgccatcatgtccgggctctcttttgccggcgcgcagttgctggaggtgatgatcggcaatattcagggcggctttatcgactttatggtgttcggcgtactgggcggcacgaaaacccactggtggttcagtctgctacagggcgctatctgggcgccggcgtactacttcgttttcaaatgggtcattttgcgcaccaatgctagaacgccgggtcgtgaagatgaagagagcgtgcgcagcgtactggcaggggcaggggagccgtccggtgaaaccgcactgatcgtgaaaggtctgggcggcagcgagaatattcagcacgttgactgctgctttacccgtctgcgcgtgaaactgcgcgatatggcgaaagtggacgaagccgcgctgaaacagagcggagccagtgggtttattcgtacgacggagaacgatcttcaggttatttacggaccgcaggtggaaagcatcgccagcgccgtaaaacaaaatttaattcaacagacgcaataagagaactgatgatgaaaaacacttttaatatcgtattagttggcggtggttccacctggacgccgggtttattaaaagcattatgcaaactcaaggcgcgtctgccgctgaagaaactggtgatgtttgacgttaatgaagagcgccaggcggtcattggcgagtatgcgaaagtgctgttccgggaagaatacccggaactggaatttacctacaccacggataaagacgtggccttcaccgatatggatttcatcttctgccagatgcgcaccggcggctacgcgatgcgcgaaaaagatgaaaaaattccgctgagcctcggcgtgatcggtcaggaaacatgtggcgcaggcggcttcgcctacggtatgcgctcgatccgcgacatgatccagctggtggaagatgtgcgcgcccgctcaccgaaggcgtggatcctcaactataccaacccggcggccattgtcgccgacgcgctgaaccagcgtttcccggacgacgatcgcatcatgaatatctgcgaccagccggtgaacctgctgcgctcttacggtcgcctgctgggacgcaatccggaaaacttcgagccggtctattttggtcttaaccacttcggctggttcacccacctgtacgatgaaaacggtgtcgatctggtgccggaactgaaagccattatttccgacaacggctttaaaccggcggatgccgagcagcgcgatcagtcctggctggacacctacgccgccgtcgccgatatgctgcgcgatttcccggactatctgccgaatacctatttgcagtactacctctatccggaatacaaattctccaaactggatccgaattttacccgcgccaacgaagtgatgaacggtcgcgaaaaacgcgtgtttgaggagtgccgcacggcggtggcggaaggcaccacccaaaacgttaaagtcgtgcataacgacgcgcatggcgacatgattgttgagctggcggaagccatcgccttcaatctgaagaagaaattcatcgtcatgctggaaaacaacggtctggtggagaaccttgacgacgacgtgatggtggaagtggtggcggaaatcggcgttaacggcgcgcgtccgtatggcgtcggcaaaatccccaccttctacaaagggcttatcgagcagcagtttgcctatgagcgactgacggtggaggcctggtttgaaggctcttacaccaaagcgttgcaggcgctgaccctcaaccgcaccattgtggatgcgaaaaaagcccgcaaagtgctggatgcgctgatcgaggccaacaaagagtactggcctgaactgcgctaagcggagcgggagaaggtaacttctcccgtttttacgagccgccttccagaggcggcaaaaaaaggtactgcctgaacgctaaaaatgccacaatagtggctgtttatacagtgtttcaggtttcccgatgggcttatccgccgcgctaaaaacgcagattgccgcctggtacaaggcgctacaacaacagatcccggattttattccccgcgcaccgcaacggcagatgattgccgatgtggcgaaaaccctcgccggtgaagaggggcggcatctggcgatcgaagcgcccaccggcgtcggtaaaaccctctcctatttgatccccggcatcgctatcgcccgcgaggagcaaaaaacgctggtggtcagcaccgctaacgtggcgttgcaggaccagatcttcagtaaagacctgccgttgctgaagaaaatcatccccgatctgcgctttactgccgccttcgggcgcgggcgctatgtctgtccgcgtaatcttgcggcccttgccagcagcgacgccatgcaacaggatctgctggcctttatggacgacgagctgacgccgggcagcaaagaagagcagcagcgctgtgcaaagcttaaagccgatctcgacagctacaaatgggacggcctgcgcgatcacaccgatcagaacattgaagacgcgctctgggcgcggctctcaaccgataaagccagctgtctgaaccgtaactgccactactacaaggaatgcccgttcttcgtcgcgcgccgggaagtgcaggaagcggaagttgtggtggcaaaccacgcgctggtgatggcggcgatggaatctgaagccgtgctgccggagccgaaaaacctgctgctggtactggatgaaggccatcatctgccggatgtggcgcgggatgcgctggagatgagcgcggagatcagcgcgccctggtaccgcctgcagctggatctgttcaccaaactggtgtccacctgcatggagcagttccgcccgaaaaccacgccgccgctggcgacgccggagcggctgaatgcccactgcgaggagctgtatgaactgatcgcctcgctgaacaatattctgaatctgtacatgcccgcaggccaggcggctgagcatcgttttgcgatgggcgagctgccggatgaaatcatggagatctgccagcggctggcaaagctcaccgacatgctgcgcgggctggcagatctcttcttaagcgatctgagcgagaagaccggccagcacgacatcgtgcgtctgcaccgggtgatcctgcaaatgaaccgcgccctcggcatgtttgaaggccagagcaagctgtggcggctggcgtctatggcgcaggcgtccggcgcgccggtatcgaaatgggcgacgcgcgagctgcgcgacggccagctgcatctgttcttccactgtgtcggcattcgcgtcagcgatcagctggaaaagctgctgtggcgcagcgtgccgcacattatcgtcacctccgccacgctgcgctcgctgaacagcttcacccggcttcaggagatgagcggcctgaaagagaaagcgggggaccgttttgtggcgctggattcgccctttaatcatgtcgagcagggaaaaatcgttatcccgcagatgaagtacgaaccgctgatggagcatgaagagcggcacatcgcggagatggcgacctattttcgggaacagctggagagcaaagtccataaaggcatgctggtgctgtttgccagcggacgcgccatgcagctgtttctgacttttgtcaccgacctgcggctgttgctgctggtgcagggggatcagccacgttaccggctggtggagctgcaccgtaaacgcatcgacggcggcgagcgcagcgtgctggtcggcctgcaatcctttgccgaagggctggatctgaaaggcgattacctgacgcaggtgcatatccataaaatcgccttcccgcctatcgacagcccggtggtgatcaccgaaggcgaatggctgaaaagcctcaaccgctacccttttgaagtacagagtctgccgagcgcttcctttaacctgatccagcaggtggggcgactgatcagaagccatagctgtcacggcgaagtggtgatctacgataaacgtctgctcaccaaaagctatggcaagcgtctgcttaacgcgctaccggtatttcctatttcacaaccggccgtcccggacgttatagtgaaaagtaaaccaaaagcagaagcaaaacagagccgtcgccgacgacgctaatccgggcacaggaaggagatttcatggactatcgcaagatcatcaaagaggtcgggcgcggcaaaaatcacgcccgcgatctggattttgataccgcacgcgcgctgtacacgcacatgctgaacggcgaggtgccggagctggaaatgggcggcattctgatcgcgctgcgcatcaaaggcgagggcgaagcggaaatgctcggcttctatgacgccatgcagcagcagaccatgcgcctgacgccgccagtggcaaagccgatgccgattgttattccgagctataacggcgcgcgtaaacaggccaacctgacgccattgctggcgatcctgctgcataagctcggttttccggtggtggtgcacggcgtcagcgaagatcccacccgtgtggtgacggaaacgattttcgcgctgctcggtattgaggccacgcatctggcaggtcaggcgcaggcgaagctggacggtcatcagccagtttatattcccgtcagcgccctctgtccgccgctggaaaaccagctggcgatgcgctggcgaatgggggtgcgtaacagcgcccacacgctggcgaagctggcgacgccgttccccgaagacgccgccctgcgcctctccagcgtttcccatccggagtatgtgccacgcgtggcgaaattcttcagtgatattggtggacgcggcctgctgatgcacggcactgaaggtgaagtgtatgccaacccgcagcgctgtccgcagatgacattaatagacagccagggcgcgcgcgtcatccttgagcgccagtctgaagagcaaaccggcgtctcgctgccagacgccaaagatccacacaccaccgcgcgctggatcgagcgctgcattgtaggcagcgaagcggtgccgcaatcactgaaaatgcaaatggcctgctgcctgtatgccgcaggtcaggccgattccattgaggcggggctgacgcaggtcaacgcccgtttttaaggcaaaaaaaagcccgtccagggccggacgggcaacaagggtaataacactctggtattgcaaaatacaacatatgatgagggtaaaacgcaccggcgggcgggtagcccgcaggtgtaaagcattcagtcgattatttatagataaccgcggtgccgctcattttgttactggtgttagcggaagtaatgctgtaaccggtcgcgccagcttcagccgctttctgtgccagctgtgcttccagaccgtccagcgtggtcgcgccgtcggctgccacgacgccgattttgctcatattctgcgcctgttcagcagtcactgcctgggcggcaaacgcgccgaatgacagggtggaaagggcgatggcggcaacagcatatttaatggttttcattggtaatctctcgcagataattctgttaaggggacgatgttccgtcgatgtgataagtatcacagtattttgcgaaagataaaatcgaagagaattgacgaccttgttctaaaaaattgaacgatcgttaattaattgattagcaatatatttttcagatgaatgggtataaagccgggcaggacgacgcgacagcggcgttagcggcacgatttgctactttctgagcgattttttatggtctcccccgcaaccgcttgcgctgtcatattacgtcaggaaaggtcaacgtaactggctgtccttggaacctctgcgattatatcctgagttagcctgattttttaaatctttcttctgctggcaatttacgcacagacgcacgccggggatcgccttacgacgcgcgtccggaataggttcgccgcactcttcgcactccttcaggctttcgcccttcggcagatcgcgccgtgcacgtgccacggcgtcttcaacagtgctgtcgatttgatcctgcactgcgccatcatttgcccaaccggatgccatcgccttctccttctctctgtacataccttaagtttagaccatgtacagacaagccaggacgacaggcttagcgggcgtcggggcgaaccaggtcgaagcgctgggattcgtcgatggtgtagtaagccgacgggccgcccgcacgcagtaccggacgggctttagccgtctgataaatcccgttttccagcagggattcatcaatatgaataccaaccacttcgcccagcaccagccagctgtcaatcggcgtaccgtcggcggcggtcagttgaatacactgggacaggcggcattcgaaattgaccgggctttcggcgacgcgcggcacgctcactacctggcttgccaccggcgtcagaccggcacgcacaaattcgtcctcgtcgtggggcagggacgcggagctttcattcatccgcaccgccagatcataagttgtcaggttccagacgaactctttagtttcagtgatgtttcgtacgctgtctttccagccggtgctggagaagccaatgatcggcgggcgatagttaaagcagttaaaaaaactgtagggcgcgagattacgctgcccctggctattctgcgacgcgatccagccgatgggacgcgggccgataatggcattcagtggatcgtgcggcaggccgtgccccagtgctggctgataaaaatacatagttcacccgtttttacgattaaatcagaatagcgagcgtcacttatttaccgcgccgccgtcaacgggtatcttacgccgctgttgaaaggagaatgccatgactgcccagaagccgggattacacccgcgaaaccgccatcacagccgctacgatcttgatgccctttgtcaggactgcccggagctgcgtggctatattattgccacgccaacgggtgaggcgacggtgaactttgccgatcccctcgccgtgaaagccctgaataaagcgctgctggcgcatttctatggcgtcgcccactgggatattccgcaagggtttctctgtccgccggtgccgggccgcgcggattatattcatcatctggcggatctgctggcggaaagcgccgacggcgctgtgccgcgtcaggcgagcgtgctggacgtgggcgtgggcgcgaactgcatctatccgctgatcggctatcacgaatacggctggcgctttaccggcacggaagtcaacaacgaggcctttgccagcgcccaggcgattattaacggcaatccggggctgacccgcgctgtgcgtctgcgtcgccagaaagatcctgcgtctatcctcaacgggatcatccacaaaaacgaacagtatgacgctacgctctgtaacccgcccttccacgactcggccgccgccgcccgcgccggcaacgagcgcaagcgccgtaaccttggtcagagcagcgaggcgctgaactttggcggtcagcagcaggagctgtggtgcgaaggcggggaagtggcctttatcacgcagatgatcgccgaaagccaggcctttggtcgtcaggtgctgtggttcagctcgctggtgtcacgcggggaaaacctgccgccgctgtaccgcgcgctgaccgaagccggggcggtgaaagtggtgaaaaaagagatggcccaggggcaaaagcagagtcgctttatcgcctggacctttatggatgacgcccagcgtcgccgctgggcaaatacccgctttaaagcgtaggggcagcgggcggcggcagttcctgcggcgcggcagatggcggcgtggcaggctgcgccagcacctgataagtctgcaccggcgggcgtacccctgccagatcgaagtatttcttcaccatgctgtcgagcgcaaagcgcaccgtccactgcttgagcggctgcgtggtgaaggtcacgcgcagggtaaaggcggtgttggtcaggccgacgatgccgacaaaagtcggttcgccgatgatcagcccgcgaatatcctcccgcgccatcagttcccccaccgcatccttgagcgcctgattcgcgttatccgcatcttcatggcgatcgacatcgtagttagccacaatcgagccaatgccgcgcacaaagttggcgaaggtggtgatagatgaccaggggatgatgtggtacgcgccggtatcctggcgcacccccaccgaacggatcgacatgcgctccaccgtgccggttagtggcccgatggtcaccagatcgccggtgttcatcccgttttcaaactgaataaacaccccggtaataatatctttcaccagcgtctgcgaaccaaaagagatcgccagacccagcgccccggcacccgccagcagcggcgcgatgttcacgccaatctccgacagcacaatcatcaccgtgatggtgctgatcaccaccgccagcgcattacggaacagcgtcagcagggtacgggtacgggcgctcggcagcgggcggccgtgaatatcggaagacaggcggttttcgataagactggccagcaccgtccagccgacggcggagaagaacaggatcagcgcgatgcggatcagaatatccacggttttctcgcctgcgccgttatgcagccagttccagaaatcaaacagaccccaggcattgagcagcagcatgatcgccacgcagaccaccagaatacgcgccactttcagcgaggcggagatccagccattaacgcgcttttgcagctccggatagttacgttgcacatggggcgacagggtgatggtcttggtgagccagcgcgacaaaattcccgaagcaaaggcggcgacgctgatgatagccagactgtgcagcgacgcgctcatcataaacttcaggctgttgccgggatcgaacagcgagaagaagaacagcaccacgaagtaagcgctggccagccagtgccacaccagcgcaaaggcgcggataaagaggctgaaaaacgacagcgagcgctccgccagatggatgagattttgctggacggtgatcctgttatgaaagatcaaatacagcgcccagctggtgatgcagagcatgataatgacgttcgccaccgcgcccacctgcacattcacctgattggaaatgatgggcaccgccaccagcaggccatagccgatcaggctgcttaaggcgctcaggcgcagatgccagtattttgccgcctcatcctttaccgggaacgggcgcagatcgggaaagcgcgggcagaaaatcagccgcagtatggctttgaaaaactcaatcagcgcgaaagcgttcaggaacagcccctgctggaaggcgatagtgcggttgccgccgttgaggttatcgctcaacagctggccgacaaacagcgtcagggccagcagcatgatgtcgataataaacgcgcctatgatcatcgccggtagctgcaaccagttggcgtgctcgcggtttttacgccgcgcccaggtgcccattttgcggtacagcggcgagacgctaaaacgcaccacccagaagaagacgaacacgctcaccgccagcatcagaaaatgcgaggcggcgttgtaaaaggtctggggattaaacgctttatgcggcgaaccggtaatgttgcggtacaactgcgcgaaacgggaggccagttcatcgccgtaatggcgggtgacggcggtgacgttctccagcacggtagtttcttcgaccactaccggcggcgtgatagtcggcgcttgccctgtggctggcgcggcggccgcattacgtaactgaccgatcaactcctcccgcgaggcgctgttttccagcacatccgccagcgcgccataggcggcttttttttgctcggcatctggctcagcgggggtggtttcggccggggtggcagtagcgcctgacgtgacgccaggaattgtcgccgcgtgcagcggcatgaagaacaggctaagcagcaacaagatccacttcacggactcctcctgagaaaagcacaacaaaaggataagtatagaggattgcagggcggcgacgggaaatgggagaaatccaggcggggtggaaaacagccctctccggaagagagggccgggcagttacgacacgtgctgtaagaattcctgcagacgcgggcttggcggattttcaatcagcgcctgcggattgccgtcttcggcaatgcggcctttatcaatgaagatcaggcgtgaggccactttttcagcaaagccgatttcatgggtcacgatcaccatcgtcatgccttcttccgccagatcctgcatcaccttcagcacttcatggcgcagctccggatccagcgctgaggttggctcatcaaacagcatcattttcggcttcaccgccagggcgcgggcgatagcaacacgctgctgctgcccaccggacagctccgacgggtagtgatgcgcacgttcagcaaggccgactttcgccagcagcgctttggcctgcacttcggcgtcttttttgttcgcgccacgcacgcgcagcgggccaaacatcacgttttccagcgcggtcaggtgcgggaacagataaaactgctggaacaccataccggcttcctgacggatcagccgctcatccaccttcggatcgttcactttcagaccgtcaacaatcagatcgccgctggtgatctcttccagcttgttaatgcagcgtaagagcgtcgatttaccggagccggacggcccgataatcaccaccacttcaccctgtttgatgttcaaatcgatattgtgcagcacctgggtcgggccaaagtgcttggaaacatttttaaattcaatcacaggattttcatccttctttcaagacgacgcagaataaagctcagcaccagggtgatgatcagatagaagaccgcaacggcgctccagatttccagcgcgcggaagttgccggcgatgatctcctggccctgacgtgtcagttcggcgacgccgataacaataaacagggaggtatctttaatgctgatgatccactggttgcccagcggcggcagcatacggcgcagcgccagcggcaggatcacgtggcgaatggtttcgcggcgcgacagccccagcgccagacccgcttcacggaagcctttatggatagacagcacggcgccgcgggtgatctcggcaatgtatgcgccggagttgatcataatggtcacgacggcggcgctgaacggatcgatacgcaggtcgttaaacgccatgggcagcgcaaaatagatgaacatcacctgtacgacgataggcgtgccgcggatcacttcgataaagaccagcgcgatgtggttagccagccagccgccgaaactgcgggcgaaaccggcggcaagaccgataagcaggccgccagcgagaccgaggaccgagatccacagcgtcattttggcgccttctaagagaagcggaatggcaggccagatggcactccagtcaaactgcatgatgaattcctgtaaaccgtggtttaaaaacagcaggggcgaatggtcgcccctgaactaacttgttaaaacttatgattattatttaggctcggtgccgaaccattttttgtagatttcgttgtaggtgccgttctctttcagggttttcagcgcgccgttaactttgttacgcagatcgtcgctgcctttcgggaacgcgataccgtactgctgcgcttccagagaatcgcctaccgctttgaacttaccgttaccggcggttttgatgaagtagagaatgttcggcgtgtcatgcagcaccgcgtcggcacggttggtgcccagttccatataggcattgtcgatgttcgggaactgacgcagatctttggttttgatgttcgcttttgcgtagtcaacagagccggtaccgcctttcacggcaacgactttaccgtccagatcttttacgctcttcacgtcgttgttgtcggctttcaccatcaccagcagaccgctcttgtagtagccatcagagaagtcgatcgcttttttacgttcttcagtaatggtgatacccgccagcgccacgtcgacgtttttggtttgcagagccgggataatgccgctgaaatccataggtttcagctggtaatccagcttcagctctttcgccacggcagcccacagatccacatcgaaaccaacgtatttatcgccttgtttgaattcgaacggaacgaaagcagtatctgttgccacaaccagtttatcggcggcgtgagacgaaaccgcaaatgccagggtcagagcagccagggaaacttttaatacagacttcatagcatttccttttatatccacggggcgatcccctgagagaacctgtgcagtatgaaaaaatcgtgccaggtttacaacctgttgttttgtaaagacgtgtcatcgccagggtgcactaaaagcagcgcaacggcaacggaatgcaccatgatggggcgctattttagtgcagttacgccgggcaccgggagacgtctatttttaacgcaggaaatgggcaggaaacaatcttttattaacgattgtgtgaagtgattattacatctttttcacgattgacggcaggagtggaagaaaggatgcaccataaatgtgcaaaaccccccgccggggcgaggggtcatagcaaatcacaatacttattcgatattggattcaatgaaccacagatactgatccaggtcgcgtgatgcggcggtcagaatgtcagcggtgtcttcatcctgcgcttcgctgatggctttacgcacatcgtttgccactaccgcgtagcggtcggccagctctttcaggtgttcctgaacggaatgaatgtccagcgggtagcttttcagcggggttttgctgttgataacctgagtggtacccagcgcaacaccgcccagctgtacagcacgttctgccatggtatccagatgatccaccaggcctgtacggaagccatccagcatttcgtgaacagcgataaagtttgcgccgcgcatgttccagtgcgcctgcttggtgatcagagacaggtcaatgaactgggccacctgacgattcagcaactcgatagtcgctttcttatcgttatcagagacatcattgcgggtataaagcagatcggaagctttcgtttttaccagtttagcggtactcataatctcatatcctcttgatgtttatgtcccgggtaattactggaactaagtatagcagcggatcctggctttgcttttcgtctctgcctatcggtttaatagcgacaacgataggaaaaattaaatcctattaaatttcagtgttttgatggtttttttaggaatgattcttaattctgaccgggacggaagagtgtgaataaatattactgaaaataaagcgaaacagcgcaggaattattccgggcgcttcgcctggcgcccggaaatataatttaactgatatccactttctcaattttcgcttcacggcgcagcgtcagggtcgatcccatggacgccgtaatgatagcgagcagcgccagccactgggtcagcgtcagggtttccccgaggaaaaccatgcccgacagcgccgccagtccgggttccatactcatcagcgtaccgaaggtgcgggtcggcagacgggttagcgccaccatctccagcgagtagggcagcgccgtggagaggatcgccacgcccagccccagcggtaagaccgaccagtgccacagagcatcgcccgcctgccagacaccgaccggcacaaacaccagcgcggcgatcagcgaaccaatggccaccgttgccggaccgtgttcttccccggcacgctggccgcttagtatatagatagcccagcaggctcccgcgccaagggccagcgccgcaccggtcagatcaacatgtgagacatcctggccgaggggcagcagaaaccacagtccgagcaccgccagcgccacccagataaaatccaccgcgcgccgggacgcgaagagcgccaccgccagcggtccggtgaactccagcgccaccgcgatgcccagcggcaccgtctggatagataagtaaaagagatagttcatcgccccgagggataatccataaagcagcagcggcttgcgctgcgctttagtaaaacgtaagcgccacggcttgaagataaccacaaggatcagggtgccgagggccagacgcagggcggtgacgccgggcgcgccaattaacggaaaaagcgatttcgccagcgaagccccgctctgtatagagagcatggcaatgaggatcaccagtacgggcatccataccggcgttttacgggacaatccaggcatcctttctcctgtcaatttatgtcaaacgaagtaaaagaaggcagtgtaatggaaatacctgcccacggttgaaccttcgttgaaaaaaagtcgccgtaaatccgtacaataggccatagttgatggattaatcgccgtttgattaggattaatctggatgaatatgttgcgtttctcgcgtaaaaatagcgtcctgtgtgggaaaaccgctgcattttgaaagagatagtcagtgctggaaacgttctgttacaggaaaagagcccttagacaacgtaaacctccaggagtttcctgactatttttgatatatttaaaacttaggatttacttgaagcacatttgaggtggttatgaaaaaaattgcatgtctttcagcgctggccgcgattctggccgttaccgcaggttccgcagtagctgcatccaccgtttctggcggttacgctcagagcgatgcgcagggcgtagcgaacaaaacaaacggtttcaacctgaaataccgttacgaaaatgatactccgctgggctacatcggttccttcacttacaccgaaaaagatcgtaccgaagacggcgcttataacaaagcacagtactacggcgtgaccggtggtcctgctttccgtatcaacgactgggccagcatctatggcgtagtgggtgttggttacggtaaattccagcagcgcgaagatggcttcaaaaccgctgacaccagcgattatggcttctcttacggtgcaggtatgcagttcaacccgatggaaaacgttgctctggacgtgtcctacgagcagagccgtatccgtagcgttgacgttggcacctggatcgcaggcgttggctaccgcttctaatcacttctgtgatgataaaaaatccgcccacgggcggatttttttttgctctatggaaacgaatggctacggtcacagcgtttaccgcgttttggtctcaaaaatatccgtgcccagatgggtgtaatccactttctgcagtttgaaattcgtcacccaggtagtgccgcttttttgcgaggacataaaacggtatttattggtgatctcttttgcgctgatgccggtccactgtgagaaaaagttcaggaaatcattggccgagcgacgggctttgatcacgcgatgggtcttgtcatcgctggaaagcaccataaagggcacctggaagttctgctggaaggtgtcgccatgggccagatactgcacatctttgccgcgctctttaatggcaaggccatgatccgagaaatagaccatcgagaaactgtcccccgcgccctgcaactgcgcatagagtttgccgagcaattcatcggtctgggtgatggaatagaggtagcaggaggtctctttcgactgcacaaacaccttatatttaccttcggtgcgatcgcaggcctgagggtgagaacccatcaggtgcaggacgatcagctgcggctggctgcgcggcgtggacaacacctgggccgtcattttcagcagcgcctcatccttgacgtttttatccgcttcgaaatcgccgttcttcaggaactgcacttcatcggcgcgtttcgcgatgctggcgatggcggtatcgtattcgccaatttgtccctgattggagaaccaccaggtctggaatccggcgcggttcgccagggtgacgaagttatcctggtattgcggtttatcgtccaccacgcggttcagggtcaggccgagggatttttgcgtcgagccgctggcggccacgtagtcggtaaagaaggtgccgttaacctggctggcgaagggcgtgttattccagtagccaccaaaggcgcccatcgcgtcgcgtcgcacgctttcgccgatcaccaccacataggtatgatatttcggcttcacgcccagcactgtccaggtatctttcatgccggacagctccgccatgcgggtctgttcttcccgcacttcgcggttattcaccaccacatctttcacgaagcgcactaccggataaccggtgtctttcagatggaagccccagccgtagtagaggttgcttaccggctgcacgaacactaccgcgagacagaaggcgacccccagatgatcccatttaccccaggccggacgttccgccgctttgcggcgcacggcgatcacgccaaggccaaaaataaacaggcctatcacgtagttgtaccacgggaaaattgtcaggatctccgtggactcttccatattggtggagtgcagcgccagcagggtattaaagtttggcgcgccataagcctggccgaatggatagtaggacgccgccaccagggtacaaaggccgatcagcactttctgtacccgcggggcgtgacgccatagtagctgtaacaccagtgcaaaggccacggcatacagcaggctgaaaggatagccaagggcgtagttaataagtaaagactgcaaaaaataaaaacctgtccacgggctgatgttcagcccgcgcgcagcgagggtttcttttatgattaaattcatatgacactatcgcgaaaacgccatgtgctcaccctggcgtcgagggtcaaaacctgcgggacaatgcgtgaagaatgaggagggggccgtcatccgcaagccgcatttgtgcagggctgcgagaagatagagcgagccgccatgaaggtcaacaggcgtcagggctatgttttgcgataatggttacaaaaccgacaaataataagaaaattctatagaaacgatcagtatgacggggagatgtgacagaaaaatgaagcggcgtaccgcgacgccgcgttagcgtgaaggtttatcgtccggctgcggtttgctgtggaacatgtcacacaacagattaaccagcagtaaacgcactttaaaaggggagtgactgaacacggccatacatctcctgaattcgttcattagttacctcctgtccagataaaaaccattccgtccgtgaagggtgactgcattacatacagatatagcataggctatattttatagctatggctaatgcgttaattttttgtactcctcaggcgatggtttacaatggccgctcgcttagaggatgcggtattcgcgtcacgtcaatgaggaagcactatgagtcgtcgcgcaggtacgccaacaataaaaaaagtgacgcaactggttaatgttgaagaacatgtcgaaggatttcgccaggttcgcgaggcgcatcgccgcgagttaatcgatgattatgttgagttgatttccgatctgatccgcgaagtgggcgaagcgcgtcaggtggacatggcggcgcggctgggcgtttcgcagccgacggtagccaaaatgttaaaacgacttgccagcgtaggattgatcgaacagatcccctggcgcggcgtgttcctgacgccggaaggggagaccctggcgcagcaaagccgtgagcgtcatcagattgtagaaagtttcctgctggtgctcggcgtcagcccggataccgcccgccgtgatgcggaagggatggaacatcacgtcagtgaagaaactcttgagcgtttccgtctgtttaccctgcaacaggggcagaacgcagaatgacgctgcctttcgtgcgtgcgctggcccgcgaccgattctttcatctgttactgctggtgggcgtgctcctcagctttttcgtcccctttgccccggcgggctggggtaaagccatcgactggcacaccattattaccctcagcgggctgatgctgctgaccaaaggcgtcgagctgtcgggctatttcgatgtggtgggacgccgcatggtgcgccgcttcgccaccgaacgccgtctggcgatctttatggtgctggcggcggcgctgctgtcgacctttctgaccaacgatgtggcgctgttcattgtggtgccgctgaccatcacgctgaaaaaactttgtgagatcccggtcaaccggctgatcatcttcgaagcgctggcggtaaatgccggctcgctgcttacgcccatcggcaacccgcaaaatatcctgctatggggacgctccggcctgtcgtttgccgccttctgcgcgcagatggcgccgctggcgctggcgatgatgctgacattactggcgctgtgctggtttgccttcccgaaaaaagccctcaattaccatagcggcagccagagcgccgactggcagccgcggctggtgtggagctgtctggcgctctatatcgtgtttcttatttcactggagctgaaacaggagctgtgggggctggcggccatcgctgtcggttttctgatcctcgcacgccgcgtggtgctgagcgtcgactggacgctgctgctggtgtttatggcgatgtttatcgacgtgcacctgctgatccagctgccggtattgcagggggcgctgaacgacgtcggcaacttatccgcgcccggcctgtggctcaccgccattggcctgtcgcagtttatcagcaacgttccggccaccattttactgcttaactatgtaccgccggataagctgctcgcctgggcggttaacgtcggcggtttcgggctgctgcccggctcgctggcgaatctcatcgcgctgcgcatggcgcaggatcgccgtatctggtggcgttttcacctctggtcgctaccgctgctcgtctgggcggcgctggtcggctacggtctttttattctcagttagtgctcaattgtcagtttttcctggcaaatgtatagcaacctcctaactttagttaacggcgcacctgccgcgccgttaactgacaggaacgttgtaacgctatggctgagaacatgaacgcgtctgacgagacgcaaaaagacgacaataaaaccgacaataataacgaaaaagccgaacgcaaacgccccggcaaaaagccgattattattcttggcatcgtggtgatcgtcatggtggtcggcgcgctggtgtggtggctgctgacccgcaatgaagaaaccaccgacgacgccttcaccgatggcgatgtggtgactattgcgcccaaggtcgcgggctacgtgaccgagctgcgtgtgaaagataaccagcgggtgaagaagggcgatctgctggtgaccatcgatccgcgcgatacccgcgcccagcgcgatcaggcgcaggcccagctgggtctggcgacggcgcaactgcatcaggcgcaggcgcagctggcgctctcgaaagtgcagtatcccgcccagcgggatgaagcgcgcgcccaggtgctgaaagcgcaggcagatctggccaatgccgaggccgcgtaccgccgtcagcgcggcgtcgatccccgcgccaccacgcaacaaaatattgataccgccaacgcgcaactgcgcagcgcgcaggcccagctggccagcgctaaggcgcaggcggaagtggccgagcaggtgcagctgcaaattcgccagcaggaaactaacgtcgaagcgcgccagcgtcaggtcgatcaggcgcgggcgcagctggaaaacgccgagctgaatctctcctataccgaagtgcgcgcgcctttcgacggttacgtcaccaaacgtaacgtgcagactggcaccctggtgcaggcgggcagcgcgttgttctcgctggtgtcgccggacatctgggtggtcgctaactttaaagagtcgcagctggagcgtatgcgccccggcaataaagtcaccatcagcatcgacgcctggccggatatggagctggaagggcatatcgacagtattcagcagggcagcggatcgcgtttctccgcgttcccggcagaaaacgccaccggtaactttgtgaagatcgtccagcgcgtgccggtgaaaatcgtcatcgacaaagggctggatcccaacaagccgatgccgctgggtctgtccgttgagccgaaggttacgctggaatgaccgatcacaaccatgaaagctggaaacccgccagcaatccgtgggcggtggcgattgtcgtcaccctggcggtttttatggagatcctcgacaccactatcgttaacgtggcgctgccgcacgtcgccggatcgctctcctccagctacagcgaatcgacctgggtgctgaccagttatctggtggcgaacggtattgtgctgcccatctcagcgtttttaagccgggtttttggccgtaaacgcttcttcctgatctgcatcgtgatgtttaccgtctgctcgtttttgtgcggtatcgccactgaactgtgggaaatcatcctgttccgtatcttgcagggcttctttggcggcggtttgcagccgacgcagcagtcggtgctgctggattactttaagccggaagatcgcggcaaggcgttcggcctgtcatccatcgccattatcgtcgcgcctgtgcttggcccgacgctcggcggctggatcaccgacaactactcctggcgctgggtattctttatcaatatcccggtgggcatcatcacggtgctggcgatctatcagctgctggaagatccgccgtgggagcgtaaatcggaagaaaaactctccatcgactggacgggcattggcctgatcgcgctgggtctgggctgtttacaggtgatgctggatcgcggcgaagatgacgactggtttgcttccggctttatccgcacctttgcggtgctgacgctggtgggcattatcggcgctatctactggctgatttatgccaaaaaaccggtggtcaacctgcagtgtatgaaggataaaaactttgcggtgtcgagcctgctgatggcgggtatggcgatgatcctctacggcagctcggtggtgatcccgcagctggcgcagcaggatctgggctataccgccacatggtccgggctggtgctgtcgccgggggcgatactgatcgtgctgaccattccgctggtgctgaagctgatgccggtggtgcagacgcgctggatcatcgcctttggctttgcctgcctcgcgctgtcgtttttctggtcgcgcaccctgacgccggacatcgattttgaaaccctggtgctgttccgcagcgcccagtcgattggtcttggcttcctgtttgtgccgctgaccaccatcgcctttatcaccataccccggcagctgaacgccgacgccgcggcgctgttcaccatgttccgtaacgtcgcggggtcgatgggcatttcgctctccaccgccgccattaccgaacgatcccaggtgcacagcgcctatctcagcgaacatgcctcgccttttgacgagcagttccagcaggcgatccgcagctcagcagaggcgatacgcaatttcacctcgcaggtgggcgatcccaccgccattgccagcgggcagatgtaccagaccttaatcgagcagtcgcgctttctcgcctacgtggatgtcttcacattgctcagtctggtggccgttctgttgatcccattttgtttactgctttcgccggtgaaaagcgaaggcagcgcaggagcacattaagatgcacaggaaaactcatcccactttcaccctgctggcgctgttgctggcaggctgcgccgtcgggccggattatcagcagcccgccgccccggcggtcagccactggaacgatcagggcgaccgcaacgtgaagtcgcagacggcgtcccaggcggtcaatccccgctggtggacgaccttcaactccccgcagctcaacagcctgatcgagcgggcgatcgccgataacctgtcgttgcagcagaccgtgctgcgtatcgccggggcgcgggagcagatcaaccaggcgggcggggcattgctgcccgcggtaaacggcagtctgaaggccacccgtcagcagctcgggctggaaggggagctgaaatcccatgacgtttatggccagctgaatgacgtcgatcccgaattgcagggggcgcttggcaccctgacgcagccggtgaacctctatcagggcagctttgatgcccagtgggagatcgatctgtggggcaaagtgcgccgccaggtggaagcggcgcaggcgcagcagcaggcggccattgaacagcgcaacgacgcgctggtgtcgctggaagcggaagtcgcccgcgcctggctgcaactgcgcggcgcgcagagcattatcgccaccatgaacacgcagatcgccaccgcccaggaaaccttcacgctgacggaaaaccgtcagcgcgggggcctctcgccgcagctggatgtggaaaacgcccgcgcccagcttggcaaccttgaagcgcaactgccgcaatatcaggcgcaggagcggcaggcgatgaacgcgctggcgatcctgctcggcaagccgccgggcgcgctggacgcggaactgcgcaacccacagccgctgccgaaactgccggatctggtggcgaccggcattccgtccaccctggcgcggcgtcgtccggacgtgcgcgaagcggaagcgaatttacatgccgccaccgcgcagatcggcgtgtcggtggcgcagctgttccccagcctgtcgctgaccggccagtttggcctgcgcaacagcgaaaccaactggctcaccgactggagcagccatttctacagctttggcccgcaggtttcgatcccgattttccagggcggacggctggtttccagcgtcaaactggcgcgggcgcagcaaggggcggcggtgctcaactatcgccagacggtgctgagcgcgctcggggatgtggagaacgcgctggtcagttaccgcaccgatcagcagcgtgaagccggtctgagcaaaactatcaccgcgctgcaaaacgccttcgatctggcgagcgacagctaccggcaggggatcgccacctttatcgatgtgctggatgcccagcgccagttagcccaggcggaacagcagcgggcgcaggcgcgggtgcagaccagcctcgatctggtggcgctctataaagccctcggcggcggctgggagccataccagaacgtgcagatgcctgactacgccgtgtttggcgacgcgccgcgcggataactttcagaggattgggcaagaaacgcgcaggatcgccacattcgcataaccggcagggcgggtataactacagaacattcacggcagcatctttatgaggaaggttctatgcgataccagaaacttggcaataccggtctgtttgtgtcggaactgtgccttggcaccatgacctttggcggcgaagacgacatgtggggcaaaatcggcaagctcagtcagagcgacgcggatcgcctggtcggtagcgcgctggatgcggggatcaatttcattgataccgccgatgtgtactccgggggccgctcggaaatcatcaccgggcaggcgctgaaaaacctgaaggtgccgcgcgagaacgtcattgtcgccaccaaagtgttcggtgaaaccggcacggcaggagtgaactcgcgtggcagttcccgtcaccacattatcacaggcgtgaagcagagcttacagcgcctgcaactggatcatatcgatctctatcagctgcacggctttgatccggcgacgcccatcgaagagacgctgtacgcgctggataatctggtgcagcacggccatgtgcgttatatcggcgtctccaactgggcagcctggcagatcgccaaagcgctgggcatttccgaacgtttaggtcttacgcgctttgcctcgctgcaggcctattacaccctcgccggacgggaactggagcgcgagctggtgccgatgatgcagagtgaaggcgtcggcctgatggtctggagcccgctggcaggcggcctgttaagcggaaaatacagccgcgacgggcaggcggaagcgggcagccgtcgccaggaattcgacttcccgccggtgaataaagatcgcgcgtttgactgtgtggacgtgatgcgcaccattgccgacgcgaagggcgcgagcgtggcgcagatcgccctggcctggctgctgcatcagccggtggtcagcagcgtgatcatcggcgcgaagcgcgaagaacagttgctggataatatcgccgccaccggcattcgcctgagcgacgacgagctgcaacagctggatgcggtcagcgcgctgccgcgggaatatccgggctggatgctggaacgtcagggcgaataccgccgcaagcagctggctgcgcagtaatttattgcaattttgttacatccataacatatcatccataagagcattgccagcgccgtctgacccggcatcatgtcgcgaaagagaggggagtgatgctaatggtccgtgtcgtgctggtggatgatcatgttgtggtacggtcggggtttgcccagctccttggcctggaagaggacgtgtgcgtgaccgggcagttcagcacggctgctgaggcctggcccgcactgcttcagaatgatgttgacgtggcggtgctcgatgtcgccatgcccgatgaaaacggcctcagcctgctaaaacgcctgcggcaacagcggcctggctttcgcgccattattctcagcatttatgataccccggcctttgtgcagagcgcgctcgacgccggagccagcggctatctcaccaagcgctgcggcccggaagagctggtgcaggcggtgcgatccgtcggcatgggcggccactatctgtgcgccgatgccctgcgcgccctgcgcggcggcgaaccctccggtaaagtgctgaatattctcaccccccgcgagcgggaagtattcgatctgctggtcaagggcgacagcgtgaaagagatcgcctttaagctcgaactgagccacaaaaccgtgcatgttcaccgcgccaatgtgctgggcaaattacagtgcagcagcaccattgaactggtgcattttgccctcgaccaccagttgctgacggggcactgatgtcgtcagcgtcccggcgttttatggtgctgtcgctgtttatcgtcctggcctggggaccgggctggctgatgctgtggacgctgagtttttacctcacccataacggccagcaggcggtgctgtttctgccgcagggcgtgtttctggcgctgctgattttgctgtcgcgccgcttctggccggcgctgttactgccgttgctggcgatgattttctggctgcacagcgaacagttgctcactggttacaccatgctggccgcccccttaatcgcgctaccggtggcgcgtgtggcgcactattactggcaccgttttcccctctactggcatcgcctgacgctgctgctgacggcggtcaccgcctgcgccctgctgcaaaccctgctgctggccccctttctggaaagtaaggcgacgctaatcggtcttgccagcttcaccggcggcgtgctgctgacgccgttcgtctacctgatttttgaatttctgcgccagcagcatcgctatcatttgcttgggctggacaccagtaatccgccgctgcgcacctcgctgattatctggtgcagcctgttttttattatcggtattggcacgcagatggtgctgtcgccggaaatcgaacggctgctgctgatcgtggtgtttctgcctaacgtcatcatggcgtggaaattcggctggcagggcggggtgctggcggggctgcttggcagcatgatgatcaccatcgcccgtcaggtgggtatcggttttggcgatctgctggagctggagattttcctcgccacccaggcgctgctcggcatcgggcttgggatcgccatcagccgccagcaacatctggcgcaaaaccttgatcgctatcgccagcggctggaggtggagttacaggcgcgccgcgcgctggcggagaagctgatccacagcgaagaggacacccgtaaaagccttgccagggagctgcacgatgagatcggccagaacattaccgccattcagatccagtcgcagctggtaaaacgcagcgcgggcagcagccaggcgctggacgccgccagccagattaacgatctggcccggcgtattcacacctccacccgccagctgttgcgccagctgcgtccgccggtgctggatgaactctcctttcgcgaggcgctgcaccatctggtgaatgagttcgcctttgccgagcgcggcatcatctgccgctttgattaccggctcagcgcgccgccggaaaacgaaaccctgatttttaccctttaccgcctgttgcaggagctgctgaacaacgtctgcaagcatgcgcaggccagccgggtgagcattgtccttgagccgcgcgacgggcagatctggctgacggtcgcggataacggtatcggcctaccggccgggcagtcccctggcttcggcattcaggggatgcgcgagcgggtgcatgcgctggggggcgatctggtgctggagtccgctcagggaacacgcgtaactgttaacctgcccacacttttgccacaaaccccccgctaaccaggaaaaagtcttagtcagtgcggactttctctcatcccctttttcgttcgctttcatatagtcagtgccaccggaggccttatgcaggaactgtcagccactgccattagccagcgctaccgccgtctacgcccgcgtttattgctgtcgatggtggtgggttacgcggccttttacctgacgcgcaaaagcgtcaattacgtgctgcccgcgctgcaactggatctcagcttaagcaagagtgatatcggcctgctgggttcgctgttttatctcagctacggcctgtcgaagtttgccgccggcctctggcacgacagccacggcagccgggtatttatgggcatcgggctgtttgccaccgggctgttaaacgtgctctttgcgtttggcgattcgctgccgacgctgctgttcatctggacgctgaacggctttttccagggctggggctggccgccatgcgcgcgcctgctgacccactggtattcgcgcaacgagcgcggcttctggtggggctgctggaacacctccatcaatattggcggggcgattatcccgctgatttgcgcctttgccgcccactggtggggctggcaggccgcgatgctgacaccggggatcatcagcatggcgctcggcgtgtggttaaccatgcaactgcggggcacaccgcaggaagaggggttaccttccgtcggggagtggcggcaggatccgctggaattacgtcaggagcagcaaagcccgccgatggggctgtggcagatgttacgcaccaccatgctgcaaaacccgatgatctggttgctgggcgtctcttatgtgctggtgtacctcatccgcatcgcgctcaacgactgggggaatatctggctggcggagaatcacggcgtcaatctgctcagcgccaatgccactgtgatgctgtttgaagtgggcgggctgctgggggcgctgtttgccggatggggatcggatgtgatgttcagcgggcagcgcgcgccgatgattttgctgttcacgctcggcctgatggtctccgtcgccgcgctgtggctggcgccggtgcaccattacgcgctgctggcgatgtgcttttttaccgtgggcttttttgttttcggcccgcagatgttgattggtctggcggcggtggagtgcggtcacaaaggggcggcgggttccattaccggttttctcgggctgttcgcctatctgggagcggcgctggcgggctggccgctgtcacaggtgatcgaacgctacggctggtcggggatgttcaccctgctgtccgtcgcggcggtgctgatgggtttattgctgatgccgctattaatggcgggcattacggcttctaacacgcaaaggataaaaacatgaaagttaccctgctctctacactggttgccaccggtatcgcgcttgccacgttaagcggcggcgcacaggcgaaaggccgtctggtagtctattgcagcgccaccaatgaaatgtgtgaaaccgaaaccaaagccttcggcgacaagtatgatgtgaaaacctcgtttatccgcaacggctccggcagtacgctggcgaaagttgatgccgagaagaaaaacccgcaggcggacgtctggtacggcggcaccttagatccgcagtcgcaggccggtgaaatggggctgttgcagccgtataaatcgccaaaccttgagcagatcatgacgcagttccgcgatcccgccaaagtgaaaggcaacctgtcgtcggcggtgtatgtcggcattcttggcttcggggttaataccgagaagctgaaagagaaaaacctgccgatcccgaaatgctggaaagatctgaccaaaccggaatacaaaggcgagatccagattgccgatccgcaaagttccggcaccgcctacaccgcgctcgccaccttcgtacaactgtggggcgaagatcaggcgttcgattacctgaagcagcttaataccaatatctctcagtacaccaaatccgggatcgccccggcgcgtaacgccgcccgtggcgaaacggctatcggcatcggcttcctgcatgactattcgctggaaaaggagcagggcgcgccgctggagctgatctcgccgtgcgaaggcaccggctatgaaatcggcggcgtcagtattctgaaaggcgcgcgcaatgccgacaacgcgaagctgttcgttgactgggtgctgtcgaaagaggcgcaggagctggcgtggaagaagggcaagtcctatcagatcctgaccaacaccacggcggaaacttcgccgaactcgctcaagctcgacgatctgaagcttatcagctacgacatggacaaatacggctcaacggatgtgcgtaaggcgctgatcaataaatgggtcagcgatgtgaagatggggaaataaccccacgacggtcactgccgggtggcagcgttaacgccttacccggcctacaactttcccaacaccggaacacttatgtcacacactcttgcactccatcccgcgaaaaagcgggatgcggtcttcctttggctgtttttaggctggctggcgttcgcgctgctgccgagctggagcctggattatggcctgtttgaatccacggcggacgaaattcttgatgcgtacgcctggtcgcatcttaacgtcagcctgctgtggtacctgttccccagcctgttgctgctgcgcccgttcagcgcggccagccgcgatcaacgccgtcgccactggtttgacgccggctgggcgctggcctgtatggcgtttatcgttatcagcgcgacgctcgccgggcgtgggctgggctatgccaccatcgtgctgttcatctcccttggcgcgatcatgacgctggcgttgacccgccttgaatggctgagcggcgaccgctttgtgattggctcgctgatcgccattatcgcgctgatcggcatctttatcgtctggccgagtatcgccatctttattccgatgttcaccaccgacagcggggaattcgcgccgctggcctttatgacggtgctgtcgcaggcgcatatcgtgcaggtgatcgtcaactcgatcctgctgtcgatggcggtgggcgtgggctgtaccttcttcgggctggtgctggcgatctacaccacgcgcatcgcccggcgcagcgccattattggccgtattttctctattctgccgatcgttacgccgccctttgtggtcgggctgggggtgacgctgatgatgggccgctccggttatgtcaccgagctgatggtcgactggttcggcctgaccaacactaactggctgtacggttttaccggtatctggatcgcgcaggtgctggcctttacgccgatggcctttatgatcctcgatggcgccatcaaaaccattcatccgtcgctggaagaagcctcttataccctgcgcgccagccgctggcagacctttaacggcgtctttgtgccgctcttgaaaccggcgctggcgaacgcctttttagttgtcatcgtgcagtcgctggcagacttcagtaacccgctggtgctgggcggcaacttcgacgtgctggcgacgcagatctatttctatatcaccggctcgcagctggattatcaggccgccagtacgctgggcgcgttcctgctgctgttctcgctgctggtgttctgcatccagtatatgtggatcggtaaacgctcctacgtcaccgtctccgggaaatcctaccggggcgacgtgcagccgctgccggtgacgctggtgtggggcgtgatggcgctgctggcggtgtgggtggcgttcaatgcgctgctgtacggcagcattttctacggcagctttaccgtcaactggggcgtggattacaccctgacgctggataactttatcaagctgttcggtcaggggatgagcgatggcgcatggccgtcactgctcgatacgctgctgtacgccggtattgccgcacctattaccgctatttttggcctgctgatcgcctgggtggtggtgcgccagcagttccgcggcaaaaagactatcgagttcaccaccatgctgtgctttgccgtaccgggcaccgtggcgggcgtttcttatattctcgcctttaacagcgcaccggtttacctgaccggcaccgcggccattgtcattatctcgatggtgatgcgcaacgtgccggtgggtattcgcgccgggatcgcggggctggggcagatcgacaaatcgctggatgaagcttccctcagcctgcgcgccggatcactacgtaccattacgcacattctgctgccactgctgcgcccggcgatcctctcggcgctgatctacagctttgtgcgcgccattaccacggtgagcgccattgtgttcctcgtcaccccggacacccgtgtggctacggcctacatcttaaaccgtgttgaggacggcgagtacggcgtggccattgcctacggctcgatcctgattgtggtgatgctggcgatcatcttcctctttgactggctgatcggtgaggcgcgtatctcccgttcaaaagctaaaaaccaggcgtaaatttatgactcagaaacattttgttgagctgcgcaacgttggtaaaacctttggcagcaatgtggtgattgaaaatatcaatctggcgatcccgcagggggagatggtgacgctgctcggcccgtccggctgcggtaaaaccacggtgctgcggctggtggcggggctggaaaagccgacttccgggcagatttttatcgacggtgaagacgtgaccgacagttcgatccagcagcgtgatatttgtatggtgttccagtcctacgcgctgttcccgcacatgtcgctgggcgagaacgtcggctatggcctgaagatgctcggcgtgtcgcgcgcggagatcaaaacccgcgtcaaagaggcgctggcgatggtggatctggacgggtttgaagatcgctatgtggatcagatttccggcggtcagcagcagcgtgtggcgctggcgcgcgcgctgattttaaagcccaaagtgctgctgtttgatgagccgctcagtaacctcgacgccaacctgcggcgcagtatgcgcgataaaattcgcgagctgcaaaagcagtttaatatcacgtcgctctatgtcacccacgatcagagcgaagcctttgcggtatccgataccgtgctggtgatgaacaaaggccacatcatgcagatgggctcgccacaggatctctatcgtcagcctgcctcgcgctttatggccagctttatgggcgatgccaacctgttcccggcagcattctccgcagatcatgttgatatttacggttaccggctaccgcgcccggcgcagttcgccaccgtgggaagcgggcaggtgggcgtgcgtccggaggcgatcaccctcgggcagcacggcagcgaaagccagcgctgtgtgatccgtcatgtggcctatatgggaccgcagtatgaggtgattgttgcgtggcatgggcaggagattttgttgcaggtgaatgcgacgcgattgcagccggacgtgggggagaattatttcctggagatccatccgtatgggatgtttgagatgcgggaggcgggttaataagggtggcttttagtggaatgttccgttcaatggaatgttcggtttagtggaatgttccgttcactttgcgttccgtgtcaggcgtaacaccgctgacggtgaacgtgctaagggggccaccgcggcccccttagcaatccccgcggccccgcaaagaaaccggtgctgcgcactgcgctcacctcccgaccgtctgcccgcggtcggctctattcggcctcctgcctcatttcgcctctggccgccatccatggcgtccagcccttgtcatccggcctccggctcgccggtttcagcggggactcaacccctcgcgttaatatctctgttttttataaagcgactgagtggctttgtgtttgtctgaacttacaggaactgctgagttaatttatttagaaatcatgaagtgtggggggagcccgggggtgcagggggcggcggcgactggccgccccttgcgcgctctcgccatccggtgttccgttgttccgcaatattaataagagcgcaacctaccatcatcaataaaagcgcaacctgccgcatgcaagagatcattacgcgatctttacggcgctggtcacaaaaccagcaccctctctttgcctgccttatccgcatccgctatatgactagtcatataaattaaatgactttacataatcaccagcggagatcagatgatgactaaatccttaccggcgggttttttgtggggtaactcggtatccagtatgcagacggagggggcgtggaacgaaggaggaaaagggccgtcggtttacgatattcgcgaagccagcgaatttgcctccgactggaaagtggcaaccgactcctaccatcgttatgccgaagatttcgacctgatgcaggatctcggcatgaactgctaccgcttccagatcgcctggagccgcgtctgcccgcagggcgacggagagttcaacgacgagggcatcgccttttacgatcgttttatcaacgacctgctggcgcgcggcatcgagccgatgatctgcctgtatcacttcgatatgccgctggcgctggcgcagacgtacaatggttttaccgatcgccacgtcatggaggcgttcgttcgctacggcaaaaagatgatcgactgctttggcgaccgcgtgaagtactggctgaccttcaacgagcagaatatctaccatatgccggaggcctttaaggttggcggttatctcgaaggcgaaaaaacgctgcgcgagctgtaccagatttcgcatcacgtgatgatggcccacgtccgcctcacacactatctgcatgacaccaaaccggggcagctgatgggcggcatgctggcgcatcagctgatctatcccgccacctgtaagccgcaggatattttctgcgcccagcagtatgacgaattcctcaaccagaacctgctgcgcgtctttgccggtcagggctacagcccggcggtgatggcggtggtggagcgcgaaggcttcggggatattttcctcgacgaggatctggaagagatcgcccgggtgaaaaacgactatatggcgttcagctactacgccagtaaaacgctggacagcgatgccatccctgacgggacgccggtgaactattacctgttgcacggcgataaaaataacccgttcctgaaggccaccgaatggaactggcagatcgatccgctcggctttcgcaccattatcacccgttattataacgactggcggctgccggtattccccattgaaaacggcatcggcgtgatcgaatcctgggacggcgtaaaccccatcgacgaccagtaccgcatcgactatcaccgtgagcatttgcaggcgatgaaagacgccatttttgaggacggcgcgcaggtgattggctatctcggctgggggctgattgacattctcagttcgcagggggacatgcgtaagcgctacggcgtggtgtatgtgaaccgggaaaaccacgatctgaaagatctgaaacgggtaccgaaaaagagctacgcctggctaaaacgtgtgatccacagtaacggcgacgagatgtgatcccgcctgccggaccgttttgtgactgattgaagggaaggtatctgcgatgtctgatgcaaacatgaaaccgaatatgcagtcgtttgttgatcgatttgttgagttctccgcccgtatcgccaaccaggtgcatctgcgctcgctgcgcgatgcctttgcggcggtgatgcccattttcattcttgccgggctggcggtactggtgaataacgtggtgtttccctgggtgatggacggggagctgctcacgcgctttaaagtgtggggcgatgtcattatcaacggcacgctgaacattgcggcgctgttgatcgcgccgatgatcgcctggtcgctggcgcgcaacaaaaatttcgacaacccggtctcggcagtggtgatcgccttatccagctttatcattatgatgccgatccagctcgacgtggtgccggtgggcggcaagacgacggtaaccgtcggccagatgctgtcgttcgccaacattggcaccaccgggattttcgccggggtgatcatcggcctgctgtccaccgagctgtttatccgcattgccgggatcaaaaagctcgatatttccctgggcgaaaacgtgccgccggcggtgagtaaatccttttccgcgctgctgccgaccatttttacgctctccactttcgccatcatcgccgcgctgctggcgaacgtgctgcataccgatctgatccatctgatcaccacgctcatccagcagccgctgcgtctgatcaacaccagtctgccgggcacgctttttatctacagcttcggcaactttctctttacgctggggatccatcagtcggtggttaacgccgtggtgctggagccgttcctgctgatcaataccaacgaaaatatgatcgcctttgccaacgggcagccgatcccgcatatcatcaacaatatttttgtgccgacgttcggcatgattggcggcaccggcagcacgttgtcgctgcttatcgccatctttctgttctcgcgccagaaggcggcgaaacaggtggcgcgtctgtccatttcgccgggactgtttaacatcaacgagccggtgattttcggtctgccgattgtgtttaacattccgctgatgatcccctttgtgctcttgcctgctatcgggattttctttgcctggatctgcaccaccctcgggttgatgtcgcgctgcgtggtgatgatcccctggaccacgccgccggttttaagcgcctggctggcgacggcgggggactggcgggcggtggtcgttcagttgataatcatcgtctttggtgtattcttctacctgcctttcctcaagatagccgagcgagtggccttaaaaaacagtgggatagtcgaataataaaaggaacgggcaatgtcggcgaaatacgtttctatcgcgcgggaaattaagcagcgcatcatgagcggacagtattctgccagcgagccgctgcccgatcagttcgctctggcggcggagttcagcaccagccgcatgactatccagcaggcgatacgccagctgatcgtcgaagggctggtgtatacccgtcaggggcagggcacctttatccgcaagaatttccttcagctctcgcaatgggatctgcccggcagcgactatttcggcgcgaccaaaacctgggaaaacgtcggcaccgtcaccagcgagatcatccgcttcgatttacgctttgccgatgaaaaagagcaggcctcgctgctgatcgacgccgatgcgccggtctatgacttcgtgcgcctgcggctgcttgacggcgaaccggtctcgctggagtttacgctgatgccggtggcgctggtgcccggccttaaccgcggccatctgcaaagttcagtgtttcgctatgtgcaggacaccctggcgctgaaacttatgggttcgtaccgcgtggtgcgcgccctgaagccgaacgccgaggataaacgttacctgagctgcgacgacaccgatccggtgctggaagtggagcaggtggtttatctggaagatggcacgccgctggagtatgcccactgccattatcgctacgatcatggcggcattatcatggtcaatcacggataaaaaaaagcgatggtttcccatcgctttttttgtttactgccggggcaggatcagttcagacgaaccggcataccggagcggttttcaatcgcctgctcaacaacggcctggtcaacgtcagcctggctggtcacgctctgcacgcttttggtgagggtgatcggtacgatttcgccgccttcaaactgcgcttcggtggtggacagcggattgtgcacttccacataacggctgccatccggctcggtggtggctttcaccggctcatcgataaactgaacgcgggtgccgaccggcacgttctggaacaggaacttaatgtcttcgttacgcagacgcacgcagccgtggcttacgcgcaggccgataccaaagttggcgttggtgccgtgaatggcatacagacggccaatgtagagcgcgtacagacccatcgggttatccgggccagccggaactactgcgggcagcgggttgccggcggcaatatattccgcatgcattttggcggtcggcgtccaggtcgggccggcttttttacgctcaactttagtagtccagttgatcggcgtatctttgcctaactgaccgataccaatcggcagcacgatcaccgtgttggtgcctttcgggtagtagtagaggcgcatttcggcgctgttgatcacaatgccttcatgaacggtgtccggcaggatcagctgctgcgggatattcagtacgctaccgcctttcggcaggtaagtgtccacgcccgggttcgcttccagcaggttagacaggcccatctggtattgcgccgcaaagtactccagcggctgctggttcccttccggaatggtgatgacctggttctggccaaccagacggctgccgtcggttggcagtggataagttactgcagaggcagatttgcaaaaccctactaccgcgaaagccgccgctaaaatcgttgttaatttaattttcatgttgtgcgaggtatctttgccactggccatccggccgttgagttaaagtcttaatggagatgggagcgcattatatgtgcattcccccgcgcatggaattcagatgtgtacgaaatcacatttttttctgaaagctacagtgtagctgcttatcacggtgcgcgatttcaattcggaattgtggcataatgcacggtttgtcacacatttttaggataacgccgtgttagttaccagcaacgtcaccatgcagttcggcactaagccgctgtttgaaaacatttccgtcaaatttggcggcggcaaccgttacggcctgattggcgccaacggtagcggaaaatccacctttatgaagatcctcggcggcgatttagagccgacgctgggcaacgtctccctcgatcccaacgagcgcatcggtaagctgcgtcaggatcagttcgctttcgaagagtacagcgtgctcgacacggtgatcatggggcataccgagctgtgggaagtgaagcaggagcgtgaccgcatctacagcctgccggaaatgagcgaagaagacggctacaaagtggccgatctggaagtacagtatggcgaaatggacggctactctgccgaatcccgcgccggtgagctgctgctcggcgtgggcattccgctggaacagcactacggcctgatgagcgaagtcgcgccaggctggaaactgcgtgtgctgctggcccaggcgctgttcgccaaccctgacattctgctgctcgatgaaccgacgaacaacctcgacatcgacaccattcgctggctggagcaggtgctgaacgaacgtaacagcaccatgatcatcatctcgcacgaccgtcacttcctgaacatggtgtgtacgcacatggcggatctggattacggcgagctgcgcgtgtatgcaggcaactacgacgaatacatgaccgctgcgactcaggcgcgtgagcgtctgctggcggacaacgccaagaagaaggcccagatcgccgatttgcaggccttcgtcagccgctttagcgccaacgcctccaaatcccgtcaggcgacctcccgcgcccgtcagatcgacaaaatcaagctggacgaagtcaaagcctcaagccgtcagaacccgttcattcgctttgagcaggataaaaaactgttccgtaatgcgctggaagtggagcagctcagcaaaggcttcgataacggcccgctgttcaaaaacgtcaatctgctgctggaagtgggcgagaagctggcgatcctcggcaccaacggcgtgggtaaatccaccctgctgaaaaccctggtcggcgatttaacgccggacaccggcactgtgaagtggtcggaaaacgtgaaaattggctattacgcccaggatcacgaatacgagtttgaaaacggcatgaccgtcttcgactggatgagccagtggaaacaggaaggcgacgacgagcaggtggtgcgcggcattctgggccgtctgctgttcagtcaggacgacatcaagaaacaggtgaaagtcctctccggtggtgaaaaaggccgtatgctgtttggtaagctgatgatgcagcgcccgaatatcctggtgatggatgaacccaccaaccacctggatatggaatctatcgaatcgctgaacatggcgctggaaatgtaccagggcacgctgatcttcgtttcccatgaccgcgaattcgtcagctccctggcgacccgcgtgattgaaatcacccctgagcgtgtgatcgacttcagcggcaactatgaagattacctgcgcagcaaaggtatcgactgattttgcccctcactctgctccccgaactgatggggagcagtgcttcatatttatattataaataactcacttcttattattcgccccctgaatatatatttccctgaagccgtgaaataaaagaaaatctctttttctttaaatttgcgacagctcacaaatatgcatttaatttcgtcataacccgctttatcacggccccgctacgttgacaccccatttcaggaggagtaattttccgcgtcatgggaccgataccacggaaagtcaaatgaacggaaacattaacacactgcttcgggaagtttatgccgggcgtttcaccgactcacattatgaaaaattaacggcctgtattgagaaataccggccgcttattactcaaagccgtaaacagaaatgggatgaaagcgatgtggtgttaattacctacgccgatcaatttcatcatgaaaaggctaagcccttagcggtatttaacgatttctattataaatggtttaaatctgttttctcgcatgtccatttattaccattttatccatggtcgtctgacgacggcttttcggtaatggattatcaccgcgtcgctccggaagcaggggagtggagcgatattgccgaattaaacaaacaggcgcggctgatgttcgattttgtctgcaatcatatgtcggcaaatagcgaatggttcaacaattatctgcaacagaagccaggctttgagaatttctttctcgccatggatccgtccaccgatttatcggcggtgacccgcccgcgcgcgctgccgttattaacgcctttcacgctgcatgatggctcgcagcgccacctgtggaccaccttcagcgacgatcagattgaccttaactataacgagccggacgtgctgctggcgatgatcgaggtgctgctgcactatctggcgcagggggcggattacgtgcgcctggatgcggttggcttcatgtggaaaacgccgggcaccagctgcattcacctggagaaaacccatcagctgatcaaactgttccgcgccataacagacgaggtcgcaccgggtacggcgatcatcactgaaaccaacgttccccataaagacaatatctcttatctgggcaacgggcgcgatgaagcgcacatggtgtatcagttctcgctgccgccgctggtgctgcatgccgttcaccgtcaggatgtcaccgcgctgtgccagtgggcgcaggggctgaagctgccaggtcgcgacaccacctggtttaacttcctcgcttcccacgatggtattggtcttaacccgttacgcggcattttgccggaagaagaaattctgcacttagtggaacagctgcgtcaggaaggcgcgttagttaactggaaaaataacccggacggcacccgtagcccgtacgaggtgaacgtcacctatatggacgcgttaagcgcgcgggacagcaccgatgatgaacgtctggcccgtttcctgcttgcccatgccattctgctgagtttccctggcgtgccggcgatctatattcagagcattatgggatcgcgtaacgattatgacggcgttgaacgtttaggttataaccgcgctattaatcgccagaaataccatcaggatgatattgaaagtcagctacaggccagcggctccctgcggcatcgtgtttatcacgctttatccagaatgattgtgctccgccgccagagcagtgttttccatccggacagcgcgttcactatcaatagtctcacgccgcaggtaatgcaaattacccgtaccgctaaaaatggcgagacgctggaggcattatttaatatcagtaacgccgaacaaaaaataaaagtccacagtacaggctttgatttaataagtgaatgtcctgtccctcatgcggaattgaccctgcgtccgtggcaggtcatgtggatcaaaaaacaataaaggaacatcttatgtttaaagcaaaagtcgtgctgttatcagcactggtgtcgtgcgcccttatttccggctgtaaggaagaaaaaaagacggtcgccattgaatttatgcactcctccgttgaacaggagcgccaggcggttatttcccgcctgatcgagcggttccagaaagaaaacccggacatcaccgtaaaacaggtgccggtggaagaagacgcctttaacaccaaaatcattaccctggcgcgtaccggcgcgctgccggaagtgatcgaaaccagccacgactacgccaaagtgatggacaaagaacagctggtggatcgtaaggccatcggcgaagtgatcgccgccgtgggcgagcagaatttctatgacggcgtgctgcgcatcgtgcgtaccgaagacggaacggcctggaacggcgtgccgatcagcgcctggctacagggcgtctggtacaaaaaagatgtgctggcaaatgccggtctgagcgagccgcagaactggcagcaactgctggaggcggcgcagaagctcagcgatccggcgcagaaaaaatacggtatcgcactgccgacggcagaaagcgtgatgaccgagcaggcgttctcccagtttgcgctctccaacgacgccaacgtctttgacgccagcggcagcatcacgttcaacacgccggaaatggaacaggcactgggaatgtaccgtcagctggcggaaaccaccatgcctggctccaacaacgtcatggaaattaaagacgcctttatgaacggtgccgcaccgatggcgatctattccacctacatccttcccgcagtgtttaaagagggggatccggccaacctcggctttatggtgcccactgaaaaatctgccgcggtgttcggcaccatcacctcgctgaccatcagtaacggccagtcggctgacgaaaccgccgccgcagagaaattcgtcacctttatgcataaagctgaaaacgaagcggagtgggtaatgatgtcgcccggcgcggctttcccggccaacaaaggcgtcaccgacaccgcgctgtggaaagacaacgaggtgatcaaggcctttggtcagctgccgtatgacctgatcgcccagtatccgaatatgaaagtcttcggctccgtcggcgataaaaactttacccgcatgggcgatgtcaccggatccggggcgatcaaccgggcggtgcataacgtcacggtaggtaaaaaagatctcagccagaccctttctgaagggcaggcgaagctggaagaacttgtaaaacaacgttaatcaaaggatgtgaattgcagttatgaaaaggttgttttcaggtcgttctgatatgcctttcgccatgctgctactggcccccagcttaattttgctggggggcctcgtagcctggccgatggtatctaatattgaaatcagtttcttacgcctgccgctaaacccgcgcatcgacgcgacttttgtcgggctggaaaactatatccgtatcttaagcgatccgggtttctggcattcattgtggatgacggtctggtacaccgtgctggtggtggcgggcagtaccgtgctcggtctggcggtggcgattttctttaaccgcgaatttcgcctgcgcaaaaccgcgcgttcgctggtgattttgtcctacgtcacgccgtcgatttcgctggtctttgcctggaagtacatgttcaacaatggctacggcatcgtgaactatctgggcgtcgatctgctgcatctctacgatcgggcgccgctgtggttcgataatccgggcagcagctttgtgctggtggtgctgttcgccatatggcgctacttcccctatgcctttatctcctttctggcgattttgcagaccatcgataaatcgctgtacgaagccgccgaaatggacggcgcgaacgcctggcagcgttttcgcatcgtcacgctgcccgcgatcatgccggtgctggcgacagtggtgacgctgcgcaccatctggatgttctacatgttcgccgacgtttatctgctgaccaccaaggtcgatatcctcggcgtctatctctacaaaacggctttcgcatttaatgacttaggaaaagcagcggccatttctatcgtgctgttcgtcattattttcgcggtaattttgctgaccagaaaacgggtgaatctcaatggcaacaagtaaacgtaccctcagccgcatcgggttttacgtcgggctggctgcctttctcatcatcacgctgtttccgtttttcgtgatgctgatgacctcgttcaaaggcgcgaaagaggcgatttcccttacgccgacgttgctgccgcagcagtggacgctggaacactatatcgacatttttaatccgctgattttcccgttcgtcgattacttccgtaacagcatggtggtgtcggtggtgtcgtccacggtggcggtgtttctcggtaccctgggagcctatgcgctctcccgcctgcgctttaagggccgcatgaccatcaacgccagcttttacacggtgtacatgttctccggcattttgctggtggtgccgctgttcaagatcatcaccgcccttggcatctacgataccgaaatggcgctgatcatcaccatggtgacgcagacgctgcctaccgccgtgttcatgctgaaaagctacttcgacaccatccctgatgagatcgaagaagccgcgatgatggacggccttaaccgcctgcaaattatctttcgcatcaccgtgccgctggcgatatccgggctggtgtcggtcttcgtctactgctttatggtggcctggaacgactatctgttcgcctcgattttcctctccagtgccagcaacttcaccctgccggtcggcctgaacaccttgttcagcacgccggactatatctggggacgcatgatggcggcctcgctggtgaccgcgctgccggtggtgatcatgtacgcgctttctgaacgttttattaaaagtggactgaccgccggtggcgttaagggctaaggcggcctgattttaacaggagactggtatgaagaagttagtggcgaccgaaccgcgtgttgcggcgctggtggagtatgaagatcgcgccgtggcggagaacgaagtcaaaatccgcgtcatgttcggtgcgccaaaacacgggacggaagtggtggattttcgcgccgccagcccgtttatcgacgaggaattcaacgctgaatggcagatgtttaccccgcgcccggcagacgcgccgcgcggtattgaatttggcaaattccagctcggcaacatggtggtgggcgaggttatcgaacgcggcgcgcaggtcaccgactacgccattggcgatcgggtatgcggctacggcccgttatcggaaaccgtcatcatcaacgcggtaaataactacaaactgcgcaaaatgccgcagggcagctcgtggaaaaacgccgtctgttacgatccggcgcagttcgccatgagcggcgtgcgtgatgccaacgtccgcgtcggggatttcgtggtgattgtcggcttaggcgcaatcggccagatcgcggtccagctggcgaaaaaagccggggcctcggtggtaattggcgtcgatcctattgcacaccgctgtgatatcgcccgccgtcacggggcggatttctgcctcaacccaatcggcaccgacgtgggtctggagatcaaaaagcttaccggcaaacagggcgcggacgtgatcatcgaaaccagcggctacgccgatgcgttgcagtcagcgctgcgcgggctggcctacggcggcactatctcttatgtcgccttcgccaagccgtttgccgaaggcttcaacctcggccgcgaagcgcatttcaacaacgcgaaaattgtcttctcccgcgcctgtagcgagccgaacccggactacccgcgctggagccgtaagcgcatcgaagagacctgctgggaactgctgatgaacggctatctcgactgcgaagagctgatcgatccggtagtgaccttcgccagcagcgcggaaagctacatgcagttcgtcgaccgtcacccggaacagagtatcaaaatgggcgtcaccttttaaggtaaaggattactgaacatgaaaatcggaacacagaaccaggccttcttcccggaaaacattctggaaaaatttcgctttatcaaagaaatgggcttcgatggctttgaaatcgacggcaggctgctggtcaataatgttgacgcggtaaaagcggccatcaaagaaaccggtctgccggtgaccaccgcctgcggcggctacgacggctggatcggcgactttatcgaagagcgccgtcttaatggccttaaacagatcgaacgcattctggaagcgctggcggaagtgggcgggcaggggatcatcgtcccggcggcctggggcatgtttaccttccgcctgccgccgatgacctcgccgcgcagcctggcgggcgatcgcaaagcggtcagcgactcgcttatttatctggataaggttgcggcgcgcaccggcaccacggtttacctggagccgcttaaccgttaccaggatcatatgatcaacaccctggccgacgcccgtcgctatatcgtggaaaacgatctgaaacacgtgcagatcatcggcgatttctaccatatgaacatcgaagaagacgatctggcgaaagcgctgcacgacaaccgcgatctgctgggacatgtgcatattgctgacaaccatcgctatcagccgggcagcggcacgctgaacttccgcgccctgttcgatcagctgcgcgccgataactatcagggatacgtggtatacgaagggcgcgtgcgggcagaagatccgtgtgcggcttaccgtcagtcactggcctttttgcgcacctgctaagaggttctctgtgatgagtgcaaccacgactttaccgctgcgcgtcgccattatcggcgccggacaggtggcggataaagtacatgcttcctactactgcacccatgacgctgtgaaactggtggctgtctgtgacagccgcctgtctcaggcgcaggcgatggcagagaagtacggcgcgcatatagaggtctgggaagatccccgggccatgctcgacgcggtgaaacccgacattgtcagcgtctgctcccccaaccgttttcattatgatcacgtgatgatggcgctggctgccggttgtcatgtgatgtgcgaaaagccgccggccatgacgccggagcaggcggaagccatgtgcagcgccgcccgccgcgccggaaaagtgctggcttacgactttcaccaccgtttcgcgctggatgcgcaactgctgcgccagcaggtgatcgacggcgcgctgggcgaggtgtacgtcactaccgccaccgcgctgcgccgctgcggcgtgccgggctggggcgtcttcaccaataaagccctgtccggcggcggcccgctgatcgacatcggcattcatatgctggacgcggcgctctacgtgctggggttcccggcggtcaaacgcgtcagcgcccacagctttcagaagatcggcaatcgtaaaaacagcggtcagtttggcgagtgggatccggcgagctacagcgtggaagacgcgctgttcggcaccattgaatttcataacggcggcatcctgcggctggaaacctcgtttgcgctcaacatgaccgcacagtcgatcatgaatgtgaccttctgcggcgataaggccggggcgacgctgttcccggcccaggtgtacaccgacgagggcggcgagctgaaaacgctgtttgcccgtgaacaggccgatgacaaccgccatttacgcagcatggacgcctttgtacgccacgtgcagggcgaagcggtgcccatcgccgacgccgaacagggacgcatcgtgcagcagctggtggccgcgctctatcaggccgccgaaacagggacaagtgtggaattatgatcaagctttcgacgctcaggcatacggaatgcagtctgcatagcctgaacaaatacgcctcgctgatgaccaccggcaacggttatatgggcgtccgcgccagccatgaggaaacctgcccgctgcaaacccgcggcatgtatcttgccgggctgtaccactgcgcgggtaaaggggaaaccagcgaactggtgaacctgccggatctggttggcgtgcagatcgaactcaacggcgagatttttaccaccgcaggcggcgagatcggcgactggcagcgcgaactggatttcgccaccggcgagctgacgcgttcgctgatctggcgctcgcccaacggcgcgcactaccgcatcagcagccgccgttttgcctctgccgcgcagctgccgctgttcgccatgacgctcaccatcacgccgttaaaccgcgacgcccgcgtgtcgctggtcaccggcattgacgccacccagactaactgcgggcgtcagcatctggatgaagtacagctgcgcgtttttggcgaacactggttgcagggcatctacgccacccaggacggcgcggcggatgtcgccattaccagctggtgccgggtgagcggggcggcgagcacctgctttaccgcaaaaaaccgccagcttctgcaacacaacgtggcgaatgtcgcggcgggcgagagcatcacgctggaaaaactgagctggatcgcctggagtgatgaccgcgcccggttgccggaatcgctgagccagcaggggcgggccgagcttgagcgctgcgttgcacagggttatgacgcgctgcgccacgcatcggacaccgcctggcaaagcttctgggcgcgcagccgcgtgcaggtaatgagtcaggatccgcgggatcagcaggcgctggattacgccctgtatcatctgcatatcatgacgccgggccacgacgagcgcagcagtattgcggcgaaaggactgaccggagagggttacaaaggccatattttctgggataccgaagtcttcctgctgccgttccacctgttcagccagccggacatcgcccgtcgtttactgcgctaccgctggcacaatctgccgggggcgcgcaaaaaagcgcggcaaaacggctggcagggcgcgctttttccgtgggagagcgcccgtagcggcgacgaagaaacgccggaattcgcggcaatcaatatccgcaccggcgtgcggcaaaaagtggcgtctgccctggcggagcatcacctggtggcggatatcgcctgggcggtggtggcctactggcacgccgcccgcgaccactgctttatggcgcacgaagggcttgaactgctcatcgacacggcgaagttctggatcagccgcgcggtggaggtgaataaccggctggagatccacgacgtcatcggccccgacgagtacaccgagcacgtcaacaacaacgcctacaccagctacctggcgcattacaacgtggcgcaggcgttacattttgcgcgtcagttcgcctgtggcgacgaggcctttgtgagccaggcggaacgttttctgcagcgtttgtggctgccgcaaccgcaggcggacggcgtgctgccgcaggatgacagcttcctgcaaaaaccggttatcgatctcagcgcctataaagcgaaagcgggcaaacagaccattctgctcgattactcgcgtgcagaagttaacgagatgcagatcctcaagcaggcggacgtggtgatgctgacctatatgctgcctgagctgttcaccccggcgcaatgtctggcgaacctgaacttttacgaaccgcgcaccattcacgactcgtccctcagcaaggcgatccacggcatcgtggcggcgggctgcggcgacaccgacaccgcctaccgtttctggcgcgaaggggcggacatcgacctgggggacgatccccacgcctgcgacgacggtattcatgccgccgccaccggagcgatctggctcggcgcgatccagggctttgccgggctgtcggtgcgtcatggcgaactgcatctgtcaccgcgtttaccccggggctggcagcagctcgacttcccgctgcgctggcagggcgcgtcgctgcacatcactctcgacgcgcagcagatccgcattcgcagcactgccccggtcaggctgtatctccatcagcagccgctgacggtggacggcgagctgacctgtgcgctgcgcgatttttatttacccacgaccgggaccgctaccacggaggggcgctaagccatggcacagcaactacaggccgtcattttcgatcttgacggcgtgatcaccgataccgctgaactgcattttcacgcctggcgacaggtggcgaaagaggtggacatcgacatcgacgaaacctttaacgccaccctgaaaggcatcagccgcatggaatcgctgcggcgcattctggcgcacggcgggcgggagcaggattttaatccggcggagtgcgcggcactggcggcgcgtaaaaacggcatttatgtcgattcactgcgccagcttactccgcacgccgtgctgccggggatcagggcgctgctgaccgaactgcgcagccgcggcattcccgctggcctcgcgtccgtctcccttaacgccccggccattcttcaggcgctggagatgacggatctgtttggcttttgcgccgatgcgtcgcgcatcagccgctcgaaaccggatccggagatctttcttaacgcctgcgccgggctgggcgtcgacccgcaagcctgtatcggcgtggaagatgcgcaggccggtattgacgccatcaatgcctgcggcatggcgtccatcggtattggcgacaccctgaagcacgcaaccttgcgtctttcctctacggaagaactgacgtggccgcgtttatcagcattctggcaacacagaaagtaaggacacaaaatggcacaactctcgttgcgacatatccagaagatttatgacaaccaggtccacgtggtaaaagacttcaacctggagatcgaggataaagaatttattgtttttgtggggccgtcaggctgcggtaaatccacgaccctgcgcatgatcgccgggctcgaggagatcagcgacggcgatctgatgatcgacggcaagcgcgttaacgacgtgcccgccaaagcgcgtaacatcgccatggtgtttcagaactacgccctgtatccgcacatgagcgtctacgacaacatggcgttcggcctgaaaatgcagaagatcgataaggcgattatcgacgagcgcgtcaactgggcggcgcagatccttggcctgcgcgattacttaaagcgcaagccgggcgcgctctccggcggccagcgtcagcgtgtcgccctcgggcgcgccatcgtgcgtgaagccggggtgttcctgatggacgaaccgctctctaacctggacgccaaactgcgcgtgcagatgcgcgcggaaatcagcaagctgcaccagaagctgaacaccaccatgatttacgtcacccacgatcagaccgaagccatgaccatggcgacgcgtattgtgatcatgaaggacggtattattcagcaggtgggcgcgccgaagacggtttataaccatccggccaatatgtttgtcgcaggatttattggctcaccggccatgaattttattcgcggcaccatcgacggtaaccagtttattaccgaaacccttaagttaactattccgcaggataaattaagcgctttacaggccagcggttgtcagcataaagcggtggtaatggggatccgtccggaagatatacatccgcagcatcatgaagaaaattgtgttgccgcgcgtatcagcgtggcggaattaactggtgcggaatttatgctgtacagcaccgtcggggggcatgagttagtggtacgtgccggagcagttaatgattatcatgctggagataatatcaacattcacttcgatatgaataaatgtcatttctttgacgcggaaactgaacaggctatttaactggccgcttaactatataaatatatcgccggatagattcatccggcatgacatttttatttttctaaggaatgaaaatgaaaatcttactgagccgtgccgccttgatcctgtgcgccggaacattctgcgcgcaggcaactgaaaacaacgactggcagtttaatattggcgccatgtacgaaagtgaaaacgtcgaaggtcagggggaggacatggacgggctgtatgaaccgtcggtctggttcaatgcctctaaaggcccctggcgcgtggcggtggcttattatcaggaaggcccggtggattacagcggcggtacgcgtggcacctggtttgatcgtccggaactggaaattcactaccagtttattgaccgggaagatttctccctcggtctgaccggcggcttccgtaattatggttatcacttcaaggatgaacataatgaagatgccggtacggcgaatatgcagcgctggaaaatcgccccggactggaacctgaagcttaacgacgcctggagttttggcggctggctggcgctgtaccagtttgccaacgatctcaacgccaccggctatgcagacagccgcgtggaaacggaaaccggctttacatataaaatcaacgataccttctcggtagtaaccaactactatctggagcgtggttttaacatggacagcgggcgcaataacggcgagttctccacccagcaaatccgtgcctatttaccgatttcgttaggtaataccaccttaacgccttacacccgccttgacctcgaccgctggtcaaactgggactggcaggatgatattacccgcgaagatcatgacatgaaccgtctgggtatgctgtacgcgtacgatttccagaacggcctgtccatgacgctggactatgcgtttgaatggcaggggcatgacgaaggcagcgacgacaagttccactacgtcggagtcggcttcaactacgcgttctgagattgatcgtcagagtggcacgcctgtgccactcttttcatcaggtgccctcaaataatggtcgttgccacaatcacatttcgcgggcagggcttgccggaaatcagcttaaagatcagatcaaagctctgcgcgcctagttcctgggacggcacgtcaataccgccgggcggcgggttgagaataaaagaaagggtttcgttaaggtagcccaccaccgtcaactgctgcgggatacggatgttttgctctgccgccgcgcgatagacgctcatcagcttcaggctgtcggtggcgaagatcgcgtcggggcgtgtgggcaggctcagtaaggcacgggcggcgtccagcgcgctctcctgcctgtagccgccgtcgatgatccactcatcacgcagcggcaactggctggcccgcaaactggccttaaagccgttaacccgatcgatggaaacgtgatagctcagcggggcgtgaatacaggcgatatttttatgaccgcctttaattaacgcatcggtaatggcgatactgtcgtgatagttatcggtatccaccgaatagacgttttcaaactggccttccactttgccgatcaccaccaccggaataccgtgcttatcaagctgcgccagaaataactcattcgccggagagctcagcataataatgcccttgatcatcttctgcatgattttgctttcgcatttttgcagttcatcggcggggcttaacgacgtctgtaatataacgtcaaaacctgcatcttccgctttttcggtaatggcatgtaaggcttcagagaaataaggattaccggcagtggtttttgtcggccgggtataaataaccataatggcgtcaaagccggatgaggtcagcgcacgggcggctttattgggatgataatttagctcgctcatcgctttaagaactttatccctcgcctgcggcgaaatattggtttttttattgagtacccgcgagacggtagattttgaaacacccgccacgcgcgcaatatcataaatggtaggggacataaccttacaagttccattaatagagttacatcgtccatcttacgggagataaggcgggcaagacaaacattaagtggttaattgatgaaatgcatcactgtacggtcagccttactctcagtgaatgattacccggcggaatatcctctccgccgggtaaggggcagattaatgaaccggagaaatatgcatcgcggcggtggagatggcaccggcaaacaccaacagcccgcagccgccgtcggtgaaagcgttgtcgtcgtcatcaatcacgctaagccggagatgatccaccgtggcttcaatcagcctgccctgcaggcgaatatcaaaagcgatctcgcgctcaaaaacgaaggtacgcggcgcttcggccagaaccttaaccttatcgtcgcgcacccgtatcagctggagcttttcatcagcggtgaggcgcacggcataataacggcgcatcccctggaagcggaacgccagcccgccgtagtcgcccaggtgcagggtgagatcgcactggatgcggtagtcgcgccactcgcgggtgccgtggatcaacaccccttcgtcccgttcgctggagatacggatacgatccggatagtgccgggaaagtaaatccgcgccgttcacccaggatcgccaccagaaatcgcttttgcctgccggtttacgcagggtgagctgcggcgttccgtcccagcgcagggtatccatcagcacccgtccggcagagggggccgtcagcgcaatgcccacctcggcaatcggctgaccctggcagtccggcagcgtcatggcgagcgtgatcccgccgcctggcggcaacggctgcggttcgccgtagtaaagttgccgttcactgttttcgtcatacacccggtagcagagccgcaccatgacggtttgccggttatccggcggcgcaaacagcgtggcgcgcaattgctgacccggataaaccagcggcgtcgccagcagatcgtaactggcgtagctcagcatatcggccacttccggcggcgaaaaggtgagggtggtgacgcaggcgggcgcgtccggcggcagggcggggtaatcaaggcacagcatattccggccctgatacgccgcattgcccacctgtaccgacggtgtcagggaacggaaaccctgcacgctgccgggcagcgagaagtgaaactgtgcgccatctttacggggcgccgggcgcggcagcccggcgagctggtgaccaagatcgtacagatcatcggtaatgcgcacggcgttattaatggaaaaaccgccgtccgccgaggagatgagcaaacgatccgccagcggcccgcgccagtccggcccggcgtcaatgcccgccagtccggtcatgatccccgacagacagccgacattaccggcgttgcagtcggtgtcccggccggaggtattgataatgcactgcgcctgctgaaaattatcaggggcatagagcatcgccatgatcatcagggcgtgattaggtaccatcgggcagttgccggggtagttgtcgtaaccgtactgcgcgtcgatcttctcgcgggtgaggtgccagtcgccgtcctcccggtgccagcggcgaacgtcggcgatcatacgggcgatttcacagtcggcaggaataaacgacaggcccacctccagcagctgctgaatatcactacagataaaagcctgggcttccatggctgcccacagcatcgccgcccataccgcttcgccatcgtgactgacgctggcggctttttgcgctaaggaggcggcaagggcgggctgaccgggcgcgaccagcgcccagccatcaataaatatctgtgagccaatctgttcggcaatggttttgccattggtagaggccgcaccgcttaacggcgcgggaatgccttttttgaggttaagccaggccgtctgctcggtggaattcccgttgccgccccaccataaaatggtgcgcttatcgataatgtaattcagccagcactggccgatctgttctgcggtgagcgtatccgcaagcccatagtcttccagggcgcggataaaggtaaaggtaccggccacgtcgtcatccgccaccaccagcgggcggtcgaatttatcatgcacgtagtaatcgacgtggccaagccggtcgacgatctcctgatagcgccagccttcaaacgggcgtcctaagtagacgccgattaatttccccagcacgcccgcgtacaggcgctgataatagtctgccggtaaggccatcatttcctccctgattgataagttgcgacatccgttgtgcgctgtcaggagtggggcgaatcagccaatgcgccactcactggtcgccacgccgttcacccacagctgccgtttttcacctgccggtaacgacacctgcaacgcttgccaggcgggattataatccccgcgccgggtgatattcagtgatatggatccggcatcgcagctcatttcccacgtcagccacagcgcattaccctcctggtaaccccaggattcaccgtcatcctcaaacagcagcccggaagttttaccgacgcctttcagcgggtacagtttcagctcgcggctggtatccgcgcaggcgtcaacgtgagtgatgcgctcgctcagcggcagtcccgccccggcgcgtaccagcagcggcagtttttccagcggcgcgtcgagcgtcacccactgaccgccgctgtaccagtcgccgctgtaaaaatcgtaccagccgctgtggttatccggcagccacaggcggcgctggcgctgacccggttccacgacgctagccaccagcagatcgcggccgagcataaaatcgtcgcactcggcgaaggtctgcgcgtcatgctcatgatcgagaaaggtcggacgcagcatgggctcgtcatcggcatgggcctgccacaacagggtgtagagatagggcagcaggcgatagcgcagttcgatggcgctgcgtatcgctggcgtcaccgccgggtacatccacggctcattcaccgtgcgatcgtcattccatgagtggatggtgaaacgcggatgcatcacgccgttctgcacccagcggacaaacagctcggcatccggtttatcgccggaaaacccaccgacatcatggccgacgttaaacagtcccgacaggctcatgcccacgcccatgcgcgtgttatagcgcagcgtatcccagttggtgcggttgtcgccgctccaggtctgcacgtagcgctgcatcccggcgcagccggagcgggagatcagatacgggcgcttgtgcggcgcgaaccgctgctgggcttccattgaggcgcgcatcattaacagcggcatcaccgggcggatatgcttaatggcgatttcgcgcccgaagccgtgacagcgcgcttcgccgtcccagacttcatactcgttgttatcgttccaggtggaatcaatacccatctccaacagttgcgtggtaacgccgttctgccaccaggcgatggtctttggatgggtaaaatcaagatgcgatccttcgtcatcccagaagctggagcgctccggcgcgtcgctttcggaatcgcggataaacagcccctgctgcgccacttcctcatagcgcgggtgatcctgcaacagacagggtttgatgttggccgccagcttaatgcccgcctcatgaaatgcgccggacatcaccttcggctgcggcactttgtcgtagttccagttaaagacgtagcgcttgttattgatggaggtatagccggacgacagctggaaagaatcgcagggaatggcgtgctctgcgcacaggcggataaaattcatcagctgatgctgggcatccggcgcgtcggtgtagtgcatggtcgaaccgctgtagccgaggctccatttggggccgaacagcgttttgccggtcagacgcacaaaggctttggtgacgtccagcacccgtttaccggtaaagacgtagtaatcaatatcgcccgcttccgcctgccagcggcgataggcggtgtgatagttgtcgatctcattacccagatcgagccagcagctgctgaggttgtcataaaacaggccgtagctgacgtcatcccggcgggtaatggtaaaggggatatgcttgtacagcggatcggtgctgacggcgttatagcccatcgcatccagattgcgcatctcaaaacgcctgccgttgcgctgtaaatccccggctttttcgcccaggccataaaagcgttcagttttctcacgacgcagatagtgcgccacgccgtcgccgtgggcattgagcagataagcgctggtgggacgatcccccgccagccactgccacgcgcctgcgtcatcgcgataatgccactccagccacagcggctggtggacggtgacgcgcatggcggcgctctcgaccgtcaggctgtcatcagtgcgggagagcgtccaggccgggcagctaaaaccgctcagatcgtcccgggcgcggccttcccaggggacgtcctgcgccggggcgatgctccaggttctgtccagcgccagttcgcctttgcgtttcaccagtacgcgaaacagcgtctcttccagcacgtacaggcacagcttgtgctgcccgtcgaccagcaattcaaggtggtggtcagactgcgtgtgcagcgtccagtttttcaacgttttcatatcgatttacatccactatcaggcgcgtttagcgcgacgttcagcaataaatgccaccaggaaaaaagcgccgatcaggtcaaagaatcccatggcgacaaacagcgggttgaagccgatcttgtcggcggtgacgccaatcagcagggagaacaggaagctggcgatccacgcgcaggaaccgcgcatgccgttgaccgtcgccatctgccccttgtcgaaggactccaccaccagcgcgctcagcatgcaggagatgatctgatggccaaaaccgccaatggagatcagcgcgatgataatgatcggatcgcgggtgagggtgacgacagccagcgagatcatcagaaacgcgcctgtcaccgaactggcaacaatagaattgatgcgcgcgcagccaaaccagcgggtataaagtttggtgagatagccgctggcgatactgcccagatcggcggcgaggaacggcagccaggcgaacatggcgatctgtttcagatccatgccgtgctctttcgccagatacagcggcacccagaagctcatcaccgcccaggccggttccgccataaaggccggaatggcgatgccgtaaaaccgtttatttttggagacggttttcagcgcggtaaagaagggcagtttttcggtaagcggctcattatcctgctgaatatgcgccagctcctctttgctcagattggggtgtttatccgggttgtggtagaacgcccaccacagcaccacccacagtaatgccagaccaccggtaaacataaaggcgccctgccagccgaaagaggcatgggcaaaatagataatcggcggggccagcatcgcgccaattgaaaagccaacccccgcccagcctgccgccaccggacgttctgatttcgggaaccactccccgagggttttggcgttggccggtgtcgccgccgcttccgcaccccccataaagaagcgcaggatcgccagctgcagccagcttccggccccggcatgtaaaatacaggccagcgcccagagggcagcgcagatcataaagcccagcttcaggccgatgacatcaatcagccagccacagagcggctgaaaaagggtgtaggcgagctggaacgcgccaacaatgtacgaatactgttctgtggtaatgccgaggctgtcttttaactccggagccagaatacccagcgagttacgggtgatgtagttgacggtgacgccgagcaaaaacagcaccagcacccaccagcgaagattcttgatgatgcgtcgcggcttgccgaccgcgatgtcgttattaatgtcctgactcataacactctccgaaggacggtttgtaggggtatctgtttgatacttatggttttaattacagagttattacacaactagtatggaagttgtgcgtcctgttgagattatgaaaattcattgccgggtaatagcggattttgtgcaagttttctcagtaatttgccttacatccggcgaaaatcacatccagcacagagatagcgtgaaagcacgcttatgaaaattctttcatttaacgaacgggcgcagatcacaaaatggacaaaaagctcagaatcgccgaaatcgctgcccgtacccggctgtcggccagtacggtatcgcgggtgctggcgggaaaagccaataccagcgaaaaagcgcgggcagcggtgctggcctgcgcccgtgaactgggcgtgatggacggtatggccgccggacggctgctgctcaacagtctgctggtgttcgcgccgcagcgggcctttgatgagcgctcggacatcttctattaccgcgtcatccagagcatcagcaaagcgctggcgccgcacgaggtacacctgcgttactgcgcgctggaggagaacgacagcgatgccaacctgtttctggcaaaaatgaatgacagtgacacccaggcggcgatcctgctcggcatcgacgacgaacatattcacgatctggccgccgatctggcaaagccctgcgtgctgatcaacagccgggaccggaaaatgcgcctgcccgccatcgccccggatcaccggctgatcggcgaatttgccgcccgttacctgttcgaaatgggccatcgccacgtgatgaacgtgctctgcctgcggcgctacactatggagctgcggctggcgggcattcgtgacgcctggcgcgcgcagaacctccgcttcagcgataaccgcgacgtgctgctggtgcagagtttcagcgcccgcgaagcggaagatcgggtaggggaatggctcgacgcccagcccgcgaaaacgctgccgacggcctttctgatgggcggcgattttctggcggcgggcgccgtgaaagcgctgcaaaagcgtggtctgcgggtgccgcaggacgtgtcggtgatgagtatcgacggctttaacctggcggcgatccaggaggtgccgctcactgcggtacacgttccgcgcgacgagttgggagaagaggcggtgcatttgttgcagcagcggctgatccgccctgacgggccaaccggtacgctgttacttaacggcaggctggcggtgcgggagtcagtgcggcggatacgcccggacaaaaggcgcaccgccgtggaaagggaagggctgtatgatgattaaaccggcatgcccagcgcgcgcttgccgtgctcgttcagatcgtccagcgtaaagcgatccgcccagttggtttcatagtcttcgcgcgggaagtcgcccggcgatgcgcctttttccagcgccgctttaacgcgtttcgcataggcgaggtttttctcgcacagcggcgcggcaggaatgtacatcacgttgccccagccctgctgatcggtgaccggcgcgaccgagtggatcacatcgcagtgccaccagaccgaatccccggcctccagcgccggaatgctggtcagcgcctcaatgagcagcggatgccactgggcggaaatcggcagcacgcgacctggcgccacgccgcacagctcgtcgtccggcacgtcgtcaagcagcggacgcagcagcacatacgccatcgcttccgggattggcaccacatgcagcaagccctggccgggcagcatatccgacagcgccgtccagccctggaaggtacggaacaccgagcatttggtggtgttatcgacggtgtattcttctacttcggtacggtgcgcggcattccacggatcgtactgctccggtttgccgttaaatacggcggcgaacacctgctgataggcaggcagcagccagcgctcgagcgcgccggaatccgtgtgcgcccccagccctttcgaggtggtgcccggcggacggcggcggatgcggtccgggtaaatcacgctgacatccggatcaaaccactgtttgccttcgctctcaaaggtccacaggcggtttaaaaaagactgcacctgcgccatttcactgctctgccgcgcctgcatctgcgcctgcgaccaataaatcgggtagatctccgggcgggaggcctccagcgtgccgaagaagctgtcgcccggtcctttgtacacctcgtcaaaatggttgcgatcgagatattccagcatcgaacggtcccagcccagcgcctgttcacgtgggaagtggcctttgatcactgcgcagccgcggcgttttacctcctcgcgctgcgcctcgctgagggtgccgtttttaatatcggcaaaagggatcaccggccacaccggttcgccgcgggctttcagggcgttgatttccgcgacgcgggcggcaatacgctcgcttaactggttaaataccgcctgcacgtcgccgatttgcgcgcgcagcgcctgcttgagttgacggatcgccgctttgtgatcggcaggcagcgtttcgctggcaaaggttacagccataatgacctcacttttctttcattcgaaagtaaaataacttacacatgctaatttaagttaaaaaaaagttaatgcaagtttaaaaacttgatgaggtgcacaaagcgggaaaagtgcgatgccagcgcaggacgcaccggcatcagaagggtcaggccgtgaaggggccagtaccgtcgagcaccgcctgaataacgttcagcgcgccctggtgattgttatcatccgtgcgatggcgggcaatggctttaatggcgtcgccggcattgcccatggcaaaggagtaatccgtcatacgcagcatttcggcatcgttgccgctgtcgccgatggtcacgcattcccccggcgatatgccccagcgtttcagcaggcgggtaatgccgttagctttgtgcagaccgggaatgatcagatcgacaaagccaaagccgctggtgacgggcttcatgatgccgtcgagagagacatgcagcgcgtcaataagttgcggaatgtcgctatccggcaggttgagggagaacttaaacattttatcgtcgatgtcgtgataatcgcgcaccggtttcagacggtgataatggtgcgacatcagttcgacaaaggcgtccggggcgcgatcgctcacataagcgctctccagcccgcaggcgacaaagttcagccctttgtccttcagcagctcgccgagcacgatctgatattcatggcgggtcagctcgccgtggaaaagttgctggccgtgttcatagaccagcgcgccattttcggagacgaatgaaatacgatcctgaatttccgggaagaaggagatgagctgataatactggttgccgctggcgaccacgaattcaataccgcggcgctgtagttgctcaaactgtgccagaaaacgatcgcgatcgtaggttttggcatcatcaaggaaagttccgtccatatcggtgacgataactttaacggtcatgcattgcgctcctgaatgtaactgcgaccagaaacattctaataacaatatgagcagaagcacaattttatttcattcgaaagtttgcccgtcgttatcaaacgggtaggcccggtaagcgaagcgccaccgggcaagggggattacaacgtatgttcggtacgggcgataatatcgtcctgcgcatccggcgacagggcggtgaagaacgccgaataccccgccacgcgcaccaccaggtcacgatactgatccggatgctgcttcgcggcgattaacgtctcgcgcgacacaatgttgtactgaatatgccagcctttatacacttcaaagaaggtgcgcagcagcatcatcagcttttggcggtcgctgtcgttttccagcgtcgccggattcagcttctggttcagcaacacgccgcccaggatcgcctccgtcggcagtttacccaccgagcctattaccgccgtcggccctaaatggtcggtaccggaagccgggcttgcgccttccgccagcggggtatgggctttacggccatccggggtcgccatggttgcggcgccaaaaggcacgttggcggaaatggacgaggtaccggcgtagtaattaccgccgatcggaccccggccatagcgcggattgtgatactgcttcagctcctcaatgtaggtctgataggcgcgcgccagcagcagatccacgctgtcgtcatcattaccgtatttcggcgcgctgttgatcagacgctgacgcagctgctcgtgggtcagcccttcgtaatcttccgccaacgcttttgccagttcctgctgacctatcgccccctgatcgaacaccagctttttcaccgccgccaggctgttgccgaggttggcgatccccacctgcaaaccggaaacccagtcatatttcgcgccgccctgtttgatgcttttcgcgcgttcgatgcagtcgtccaccagcgccgagcagagaatatcgtgcacgttctcctccagcatggtgtccaccacatactcgatctcaatggatttgcgcgtgtagtagcggatctgcgtgtcccaggcgtccatcacctgcgaaaagtcgctgaaattgcctttcgacagcgccagttcctgcggcaggaatactttgccgctggtggcgtcccgtccgccttccagcgccgccagcatcacgcgggcgaagttaataaagctcatgccggtgcagcgatagccccacttgccgccgacggcggtttcgatgcagccaatcgccgcataatcgtaagcgtctgccggttcgatcccgagcttgataaattccgggataacgatctcatcgttattgaacgccggcatgccgaagccgcagcggatcacctgcacgcaggcgtcgaggaaatcgttgctcatccccgcgtggtaacgcacgctgaggttcggctgggtggagcgcaggcggccgcaggattcgaggatcgcataagagagcgggttcactgcatccagcggcttaccgttgaccagtttctgaccgccgatggtgacgttctgatacagcgggctaccggccgaggctttggagtgcgagccggaacggattttgttcacttccagcagcttcagccagcaggcatgcagcagttcgatggcgtcttcccgcgccaggctctggtccagctccacgtcacggcggtaatacggatacagatactgatccatgcggccaaaggacaccgagtgaccgttagattcgatctgcaaaatcaactggatgaaatagcacagctgcagggcctgccagtacgttttcggcggctgatgggcaatgacatcgcagttttccgcgatcgccagcagttcgtcgcggcggctttcgcgggtttctgcctgcgccatgttacgcgccagatccgcaaagcgtgcgatatgctggctgacggcttccagcacaatatcaatggctttgaggaactgctcgccgtgcagatcttccagcaccgtcagattgatgcgcgaacgacgctcggcgactttctggcgcagcccgtccatacccagctccagcaccagcgggaagttcaccgccaggtgcgcatcgccggaggtcatattgccttcggctttaatgatgccggtctccagcagtgatttttgctcgtcggtaaacataccgtagcagcgatcctgtaccgtctggccgcgccaccacgggcagatttcatgcagcacgcgcttgttctcttcgctgacggcaaaccctgcgcccggacgatcggcaagatcgtcgatctcgttttctatccaggtcaccgtatattccgggaagatcggcgcggcgcggaccatactcgcctggttgccgacaatcaactcatcatgcttgatccagatggtgcgttccgccagatgatgggcgagggcaagggcgcggcgcaccgggatcggcttatccatatgctgctgataagcctgggtatagtgcagcgcgcgctcggtgcagaccggcggtttggtgatggtgatcagcgcatttttatgcgccttgatgcggtcagtcagggtatcgagacgtaaagtggtcataaggttatcctcgtaacgtggcggtcagcccgcattcgcgcgcgtagtcttctgcaaaagccagcagatccggggcgtcgagcggtttgtctggcgcggtgtaggtctggccgagcaggtgatacttgttcatgcccagcgtgtggtacggcagaaaatgaatatcgcggacgttgagttcgtcggcggcaaaacgggtaatggcgcggatcgacgtctcatcggcgttaaaaccggggatcagcggcacgcggatggtcaacagcttgcccttgcgggcgaggcgtttgaggttctccatcacccgttttgccgagccatcggtccaggctttgaatttctcgccgtcgacatgtttcaggtccgcaaggaacagatcgacattatctaaagagggctcaacgtagtgccacggcacatgcagacaggtttccacggcggtatgaattcccgcttcatggctggccttaaacagcgcggcggccagcgcaggctgcataaagggttcgccgccggagagggtgatgccgccgccgctgcgatcgtaaaagggtttatcgcgcaggacggtggtcatgatctcatctactggttttgtttcgccgcagacggtcagcgcctgggtcgggcagcatgccgtcagcgcgtccaggtgcgcgtcattaagatgctggcgatggatcagcagaccgttcagcgcgcattcaatcaccgtgggggccgcctgctggcacagttcgcagccgtcgagacacagccggtcgtcgtagagcagatcgcgtttcagcgaacggctttccgggttctggcaccagcggcagccgagcgagcagcctttaaggaacactacggtacggataccggggccatcgtgggtggagtagcgctgaatattgaatatcatgattgtgcctcatcttgcgtacgaagattaaatgactttcgaatgaaagttattttgacgccgatcaagtatcattcaggtagcctgaggtaaatttcagcgcatgctacatctcacattttgaaggtcatatcatggaactctatctcgatacctccgacgtcgcggcagtcagacaactggcgcgcattttcccgctggcaggcgtgaccactaacccgagcattgtcgccgcgggtaaaacgccactggaggagctactgcccgccctgcatgacgcgctgggcggcaagggccggttattcgcgcaggtcatggcgaccaccgcggaaggcatggtggtggatgcccgtaaactgcgcagcattatcgcggatatcgtggtgaaggtgccggtcagcgctgaagggctggcggctataaagttgcttaaggcggaaggcatccccacgctcggtacggcggtgtacggtgcagggcaggggctattaagcgcgctggcgggggcggaatatgtcgcgccctatgtgaatcgcgtggatgcgcagggcggaaacggtattcagacggtgggcgatttgcagcggttgttaaccctgcatgcgccaggcgcaaaagtgctggctgccagctttaaaactccgcgtcaggcgctggactgcctgctggcgggctgtgaatctattacgctgccgctggacgtggcgcagcagtttatcgccgctccggcggtggaggcggctatcgcgaagtttgaacaggactggcagggagcgtttgggcggctggggctgtaaattgccgggtggcgctggcgcttacccggcctaccaaacctgaatcgccgggtggcggctgcgcctgacccggcctacggggacgaatgcgacgaatttatgtaggcccggcaagcgcagcgccgccgggcatagcggctaagattgcccgcacacctcgcatccggcatggcgcattaatttcatctcgcggaactggcaggtcatggcgtcgtacatcacgattttcccggcggcgggcgtgccataatgcgccagcagcttgatggcttccatcgcctgtaacgaaccaatcacccccaccagcggggccatcacgcccgcttccacgcaggtcagcgcattctcgccgaacagacggctcaggcagcggtagcacggctcgcccggctgccaggtgaagacgctgatctggccttccatgcggatcgccgcgccggaaaccagcggcactttcgcctgaaaacatccggcattaagctgattacggaccgcaacgttgtcggtgcagtccagcaccagatcgtgggcggcgatctgcgcgttcagggcgtcgtcgtccagctgcgcgttgagcagggtaaaggagacgtgcggattgatacgcgccagcgccgcgcgggccgactctactttgggctcgccaagcgtggcgtcgctgtgcagcgtctgccgttgcagattcgagagggagacagtatcaaaatccagcagcgtcagatggccgacgcccgccgccgccaggtactgcgccgctgcgcagcccagcccgccaagccccaccaccagcacccgtgcgcctttcagccgctcctgaccgtcaaagtcaaagccgcgcagcacgatctgccggttgtagcgcatcatctcgccatcgctcagttcaatggacattacagccctccgaacagatgattaaacggctccacctcaacccattctcccgcttcgacgttctgtcgctccgcttccagcacgataaaacagttgccctggctgaaggagctgaagatatgcgagccctgatgcccggtggtgctgacggttaattcgccctgttcattgcgggttaacaggccgcgctgaaaatcgaggcggcccggtgattttttcaggcgggtggcggtgcgcacgcgcagacgcgtcggcagcgcgctgtcatttttaccgcccagtttcgccagtagcgggatcaccagctgatagaaagtcactgccgctgataccggattgcccggcagcccgcagaaccagctctggctcagcttgccgaaggcgaaaggtttaccgggcttgatcgccagcttccagaagccgatttcacccagctcttcaagcagcgttttggtgtagtccgcttcacccacagatacgccgccggaggtgatcaccaggtctgcctggctgtccgcggcaataaaggcttcccgtaaccgggcgggatcgtcaggaataatgccgaggttgatcaccgtgcagccaagctgctccagcattaaatgcaccgccagccggttagtatcgtagatttgtccgtcgcccagcggctgtcccggcagttgcagttcatcgccggtggaaaacagcgccacgcgcactttacgcaccacgtcgacgctggcgatacccagcgacgccagcactggcagttcggccaccgtcagcgtctgcccggccttaaacaccacctcaccggcgcggatgtcttccccgaggcgacggatattctgcccggcgcgcacctcgcgggtaaaacgcacgcctgcgtcgctctgttcggtttcttcctgcatcaccaccgcatcgcagcccgcaggaacgggcgcgccggtcataatgcgcacgcaggtgccgacaggccacacatcgttaaacggctgcccggcaaaggcctttcccgccaccggcaggggcgcgcccgccgccagatccgtcagccgcacggcgtagccgtccatcgcggagttatcaaagccggggacattcagcggcgaaaccacgtcatgcgccgtgacgcgcccgaaacaggccagcagcggcagcgtatcgtacgcggtgatcggggtaataacggacagcatctgagacagcgctgtctccagcggcaaaaggcctgcggaaaactccatgtgtgctcctgactggcaatctgaacgtgcattcaaaacgcctattatggcagaaaacccggttcggctgaatgtaatcaatatgtgccttaccggtcaggttgctttacttcgttgatttgactttctatagtcaaaattcatgcctgttttcaggcactcaatcagtaagaggtcagaggatggtcgcacgtgcttgagtcagacgccagtgaagtgctgcgggtcagtaaactgaatattcgttttccggacgaaggcggcacgtcgcacgtcgtgcgggatctctccttttccctgaaacggggggaaaccctggcgattgtcggcgaatccggctctggtaaatccgttacggcgctggcgctgatgcgtctgctggcgcagtccggcggcatggtcagcagcgatgagcttcgtctgcaacgccgaagccgtcaggtggtggatctgaatgggttaagtcatgctcagatgcgcagcgtgcgcggagcggatatggcgatgatctttcaggagccgatgacctcgctcaatccggtgtttaccgtcggcgagcagatcgccgagtcgatccgcctgcatcaggggctggggcgcgatgccgcgctgaaagaagcccggcgcatgctggagcaggtgcgtattcctgaggcggacgccattttgtcccgcttcccgcaccagctctcaggcgggatgcgtcagcgggtgatgatcgccatggcgctctcctgtcgcccggcggtgctgatcgccgatgagcccaccaccgcgctggacgtgactatccaggcgcagatcctgcaactgatcagcgtgctgcaaaaagagatggcgatgggggtgatttttatcacccatgatatgggcgtggtggcggatattgctgaccgggtgctggtgatgtaccagggcgaagccgtggaaaccggcagcgtggagcagatcttcaacgcgccgcagcatccctatacgaaatccctgctggcggcagtgccgcgcctcggtgccatgcgcggcagcgatctgccgcgccgtttcccgctgccgtcccgcagcgccgcagtattgcccgacaccggaaacggtcaggacacggtggtggcgggagagcccattttgcaggtgcgggatctggtgtcgcgttacccgatacgcagcggcattctcaatcgcgtgacccgcgaagtacacgcggtggaaggcgtcagctttgatctctggccgggggagacgctgtcgctggtgggggagtccggctgcggaaaatccaccaccgggcgcgcgctgctgcggctggtggcctcccagggcggcaccatcacctttaacggtcagcgcatcgacacgctgcccgacagccagcttcagccgctgcgccgggatattcagtgtattttccaggatccctttgcctccctcgatccgcgtaaaaccatcggctactcgattatggagccgctgcgggtacacgatctgctggatacgcaggcctccgagcgccgtctggcctggctgctggagcgcgtcggcttaaagccggagcacgcctggcgctatccccatgagttttccggcggccagcggcagcgcatctgcattgcccgcgcgctggcgctcaatccaaaagtggttatcgccgatgagtccgtctcggcgctggatgtgtctatccgcgcgcaaatcatcaatttgctgctcgatttgcagcgggaaatgggtatcgcttatctgtttatctcccacgacatggcggtggtggagcgcatcagtcatcgcgtggcggtgatgtatatggggcagattgtggaaattggcccgcggcgcgcggtgttcgaaaacccgcagcatccctatacgcgtaagttaatggcggcggtgccggtggccgatccgggtcaccagcggccgcagcgggtgctgctctcggacgagatgccgagcaacatccgcaaactgggcgatccgccgcgccgcgtgcagctgcaacaggttgcgccggatcacctggtcgcacgcacaacaccaggcagcacttcatctgcattttaatgacaataatattcccggacagacagggaaactcaggagattaacatgacacaatttgttgcgcggaaatggcaggttgcgctcggcgtcgcctctgttcttgctgccgcaccggtgctggccgcgaaagacgtggtggtggcggtggcctctaatttcaccaccctcgatccttatgacgccaacgacaccctctcacaggcggtggcgaaatccttctatcaggggctgttcgggctggataaagagatgaagctgaaaaacgttcttgcggaaagttataccgtgtcggacgacggcctggtctataccatcaaactacgtcagggcgtgaagttccaggacggcaccgattttaacgcggcagcggtaaaggtgaacctcgaccgtgccagcgatccggccagcagcctgaagcgctataacctgtataaaaatatcgcgcagaccgaagccgtggatccgtcgacggtaaaaattaccctgaaacagccgttctccgcctttatcaatattctggcgcacccggcgacggcgatgatttccccggcagcgctctctaaatacggtaaagagattggcttccacccggtgggcaccggtccttatacccttgatacctggaaccagaccgattttgtgaaggtgaaaaaatttgctgattactggcaaaaagggctgccgaagctcgataccatcacctggcgtccggtagtggataacaatacccgcgcggccatgctgcaaaccggcgaggcgcagttcgccttcccgatcccctacgagcaggccgccgtgctgcaaaaaaacagcaagctggagctggtggcaagcccctccattatgcagcgctacatcagcatgaacgtgacgcaaaaaccgttcgacaacccgaaagtgcgtgaagcgatcaattacgccattaaccggcaggcgctggtaaaagtggcctttgcaggatacgccacgccggcgaccggcgtgatcccgccgacgctggcaaatgcgcaaacctatcagccgtggccttacgatccggcgaaagcccgtgaactgctgaaagaagcaggctatccgaagggtttcagcaccacgctctggtcgtcgcacaatcacagcactgcgcaaaaagtcttgcagtttactcagcagcagctggcgcaggtcggcatcaaggcgcaggtcacggcgatggatgccggacagcgtgcgtcggaagtggaaggcaaggggcagaaagagagcggggtgaggatgttctacaccggctggacggcgtctaccggcgaggctgactgggcgctgtcgccgctgttcaccacgcaaaactggccgccaacgcagtttaataccgccttctacagcaatccgcaggtggatcaggatctggttgcggcactgaagaccaccaatccggaagagaaagcccgcctgtataaagcagcgcaggatacgatctggaaagacgctccctgggtaccgctggtggtggaaaagctggtgtcagcgcataacaaagatctgaccgggttctacatcatgccggatacaggcttcagttttgacgatgcggatttgaaatagtgagaatgccccttttgtttgcaaagaaggcagggaaaaggggcatcggattcagggtagaacatgcttaactattttctcaaacgcctgctgggtcttatcccgacactgctgattgtggcggtgctggtgtttttatttgtccatctgctgccaggcgatccggcgcggctggtggcggggccggaggccgacgcgcaggtggtggcgatggtgcgccagcagctcggccttgaccagccgctgtatgtgcagttctggcattacattacggacgtattacggggggatttcggcaactcaatggtgtcacgccgtccggtggccgatgagatcgccagccgctttatgccgacgctgtggctgacgctggccagcatgagctgggcgatgctgtttggcctggcggcggggatctccgccgccgtctggcgtaaccgctggccggatcgtctcggcatggcgctcgccgtcaccgggatctcctttccggcgtttgccctcggtatgctgctgatgcaggtcttttccgtcgaactcggctggttgccaacggtgggcgctgacagctggcggcactatattttaccgtccatcacgctgggcgcggcggtggcggcagtaatggcgcgctttacccgcgcctcttttgtcgatgtgctgaacgaagattacatgcgtactgcccgcgctaaaggggtgagcgagaagtggatcatcctcaagcatggtctgcgtaatgccatgatcccggtggtcaccatgatgggcttacaattcggctttctgctcggcggctcgattgtggtggagaaagtcttcaactggccggggctggggcgtttgctggtggactcggtggaaatgcgcgattacccggtgatccaggcagaagtgctgctcttctcactggaatttattcttatcaacttagtggtggatatgctttacgccgccattaacccggctatcaggtacaagtaaggatgcgacttttaaactggcgtcgtcaggcgatattaaaggccatgcccggtctgaaaccggaccatgtgcgtacgccgtggcatgagttctggcggcgatttcgtcagcagccggtcgccatggcggcggggctgtttgtggtattactgattgtggtggcggcgattgccccctggatcgcgcctttcgatgcggaaaactatttcgactatgaccgcttaaacgacgggccttccatgctgcactggttcggcgtcgattcgctggggcgcgatattttcagccgcgtgctgaccggagcgcagatctcgctggcggcgggcgtcttcgcggtgctgatcggcgcggcgatcggcaccgtgctggggctgctggcgggctattacgagggctggtgggatcggctgatcatgcgcctgtgcgatgtgctgttcgcctttccggggattttgctggccatcgcggtggtggcggtgatgggtagcgggatggcgaatgtgatcatcgccgtggcggtgttttccattccggcctttgcccgtctggtgcgcggcaatacgctggtgttgaagcagcagacctttatcgaatcggcgcgcagtatcggggccagcgatgccaccattctgttcagccacattctgcccggcactatttcgtcgattgtggtctatttcactatgcgcatcggcacgtcgattatctcggcggcgagcctgtcgtttctgggcctcggcgcgcagccgccaacgccggagtggggcgcaatgctcaacgaagcgcgggcggatatggtgatcgcgccgcacgtggcgctcttcccgagcctggcgattttcctgacggtgctggcgtttaatctgttaggcgatggtctgcgggatgcgctggatccgaagataaaagggtagttacccctcaccccggccctctcccacagggagagggtgaattcagcactggacgatcccctctccctgtgggagagggttagggtgaggggagttaaacccgcgtaccccacagatcgtactcgtcggcgttttccactttcacgcggatcacatcgcccggcttcacgttagtttcgccgttcaggtacaccgcgccgtcgatttccggggcgtcagccatgctgcggccaatcgcgccttcttcatccacttcgtcgatgatcaccatgatttcgcggcccactttctcctgcagacgttcagcagagatctgctgttgcagctgcataaagcggttccagcgctcttctttgatctcttccggcacctggtccggcagctcgttagcggttgcgccttcaaccgggctgtatttgaagcagcccacgcgatccagacgcgcttcggtcaggaaatccagcagcatctggaaatcttcttccgtttcgcccgggaagccgacgataaaggtcgagcgcagggtcagttccgggcagatttcacgccactgtttgatacgcgccagctggcggtcaacggagccaggacgcttcatcagcttcagaatacgcgggctggcgtgctgcaacggaatatccaggtacggcaggatcttgccttccgccatcagcgggatcacatcgtccacgtgcgggtaaggatacacatagtgcagacgtgtccagacgcccagcttcgacagctgttcgcacaggctgaccatgctggtcttcaccggctcgccgttatagaaaccggtgcggtgcttcacgtcaacgccgtaggcggaggtgtcctgggagatcaccagcagctctttcacgcccgcgtccaccagacgtttcgcttccgccagcacgtcgccaatcggacggctgtccagatcgccgcgcatcgacggaataatgcagaaggtgcaacggtggttacagccttcggaaattttcaggtaagcgtaatggcgcggcgtcagcttcacgccctgttccggcaccaggcttaagaacgggttatgcttcggcttcggcacatagtggtgcacgtgttccagcacctgctcatagctgtgcgggccggtgatttccagcaccttcgggtgcacttcgcggatctgatccactttcgcgccgaggcagccggtgacgatcaccttgccgttttcagtcagggcttcgccgatggcttccagcgactcctggaccgcgctgtcgataaaaccgcaggtgttcacgatcaccatatcggcgtcgtcgtaattaggcaccacatcgtaaccttcagtgcgcaactctgtcaggatgcgttcagaatccaccaggtttttcgggcagccgagggagacgaagccaatacggggttgttgcatgctcatacgctcacaaagtaaacaggaaaataaaaaccgggcgattttacacgggttttgggcggcgctctacttctgattcgggagggcgaaggttttaacgggttaatgcacggtaaaaaaatgttaacaagactacaattattgatctggtgcatgtatctggctaaaaagtgaacttaagataaatttacaccctgtttgataagtgagaggaggaaggcgatgaacgttgacaggcttcagctccatctgatggagaaactgacccacgccagactcgaactggctgcttacgtccagcttcttaaggcgaaaggctatatgtcggtcagcgaaagtaatcaattacgtgacaacttctttaagcttgccactgaaatacgcgatctggcggagcagccatctgccccctggacccgtcatgagtgggaagcgttgcgacttgcggagggcgcattgtcctctgcggcggtttgcctgatgagcggccatcacgacagcccgacctttatcgcggttaatgccgataaacttgaccgctgcctgaatgccctgaacacctgcattgatgggctggacgagcatacttccctcgaagaggcctgatccccggggggaggcgactcccccttcagtttgctgaagttaaagcttttgtaaaagtcaaagcgcagccgtcctgactggctaatctttatccagtgcgattaaaggagagcaatatgcgccgttcccccctgctggtcattcctgccctgttattgagcacatcaatatttgccgcccctgcgccggtcaaggttgatgccctgcaaaccaaacttgatcacccctggtcactggcgtttttgccggataacaaaggcatgctcattaccctgcgcggcggccagttacgccactggcaggaaaacggcggcctgtcagatccgataagcggcgtaccccgcgtctgggcgaacggccagggcggattactggatgtggcgctggcgccggattttgccagttcccgccgcgtctggctgagctacgccgaagccgacagcgacggcaatgccggtacagcggtaggctacggcaaactgagcgacgatcttaagcggctggagaatttccagacggtgttccgccagacgccaaaactctccaccggcaaccatttcggtggacggctggtgtttgatggtaaagggcatctgtttatcgcgctgggggaaaataaccagcgacccacggcgcaggatctggacaaacaccagggcaaactggtgcgcttaaccgaggatggtcaggtgccggaagataatccgtgggccggtaaagccggtgcgcggccggaaatctggtcgtatggcattcgtaatccgcagggcatggcgatgaatccctggagcgatgccctgtggcttaacgagcacggcccgcgcggcggcgatgagatcaatattcccgaacgcggcaaaaactacggctggccgctggcgacccacggcattaactacagcgggctgaagatcccggaagcgaagggcgagatcgtggaaggcaccgagccgccgatcttttactggaagcagtccccggcggtaagcggtatggcgttttataacagtccgactttcccgcagtggcagaacaaactctttatcggcgcgctgaaggacaaggacgtgatcgtcatgagcgtgaacggtaataaagtcagcgaagacgggcgcattctcggcgatcgcaatcagcgtatccgcgatgtgcgcgtcgggccggacgggtatctctatgtgctgaccgatgagtctgatggcgagctgctgaaagtcagcccgcagacctgatttgcgcgccagcagtaccggcgcgcagggaaggttaacgcatcacgcgtttcaggatgcggttggcctgctgttcaaaatcgctggccgcctcctcgacgctcattttgccgtagtcgagcttttcacgtacggcggtaaagagcgcgccaaactgcatatcttccatatagggggtggcgacaaagttattcggcagggcgtaggactgcaacagcccggcgatcaccggatcgctgtccagcaaaatgcctttttcccgcagcagtttatccgccgcctgactcaaaggcgcgccgcgctccagccccaccgggatcacgccttccggctcgttcaccagaaagttcagcagcagcgccgcctcttttgggtgcttcgtggtacggcctatcgagtacatgatcgccgttttccggaactgtccggcatctttcgcccctggcaacagtggataggggcctggcaccagatcggcgggatttttcagcgtcacgctctgcgacgggtagagcacgttccagttatagctgcccgcccattcgccctccatccagggtttcagctcataaatcggcgtgcttttcgcgccgtaggaggccagcactttggtatcgggcagtacatggttatccaccagctttttatagaaaccgaatgccctggtaagatcggcccgatcccaggccagacgttttctgtttacgtcgatcatcggcttttgatcctgctgatacatccacgaaaacaccagcaacatacagtcctgctcgccgacgtagatcggataggcgttatcgccgagcttttccttaaataccgtccctgccgccagcagttcatcccagcttttcggcagcggcagcccggccttctgccagctggcctgattgtaatagaagcccattacgttggtggacaacggcagggcgttgagcttgccgttgaccgtggtggtggccagcgcggcaggggaaaactggtttagatcgagcgtacccgcaagctgattcagatcgtaaaagccatcgccttttctggacattagcgtcagccagttccagttggtctggatcagatcggcttccgttccgctgttgatctgcgtggtcagccgtgagaagtagccttcccagccggtatattccgctttcaccttaatatccgggtacttcgcttcgaaagcctgcagggcggcgagcgtcgcctgatggcgatctttgccgccccaccaggagaagcgcagcgtcaccgcatcggcgctgaacgcgggggccaccgcgctggcgcagcaacaggcaataaggagaggtaagagtcttttcatgattcactcctcattaccgaaggcgtactgctggatctgctgctggcgggcggtcaggcgtttgacaaggtgcatctcctgctcgcgccagggttcgccttccggcgtcagcacatcgtgaaaccacagcgactgcggatccggatgggttttattcacccccggccacggcagccaggtctgggttttgccctgcaccagcccccagtgataacagccggtctgatagaggctgaacagcggcaactgctcgctgaacacgcagccggtatgacgtgaaagccactcggtgcacagcacgggccggtcgtactgcgccagcgaatgcaggatctccagctgcatcatggtcggcgcgtaggcgtgataagtgatgatgtccgactgctccagcgccgcgatatcaatggggtgcagaaaggctttgtttgccgccacgtccgcatgccatgcgccaatggtgagcggctgaacgggatccacatcccgcgcccagtcaaacgcgcgatagaccagctccagcgcaaagccctccagcgcctcgtcatattcggcatattcgaccggcgagacgaacagcccgcggttgccgggttcgttatagagatcccagatagtgatgcgatcatcgtcgccaaagctgccgatcaggtcgcgcacgtaggcttcgacgcgcggccactggcctggatccatgacgattttgcgtccggggctggccgccgcctggctgttatgcaccgccggtctggggggcttttgcggcccggtgaacggctcatcgcctgaaaaagcgcagtcatccatcagcgtcagcatgactttcagaccgtggcgggcggccaggctgagaaaggtatcaatacgcgacaacaggccatcgcggtcactttcccagacgataaacggcagattggtgcgcagactgttatagccgtagcgctccgcccagcccagctcctcatcaatggtgatcggatcgaaggtgtccgcctgccacatctccgtccagtttaccgccgtgcgcggcagataattaaagccgcaggcccagccgtgttccttataccagccttttgcctgctcactactccagcgtgttctcatgacgtcctccctggttgaatattattagctaatatttattagtgcgcgcagatagtgagcgtttttacgtcccgatactgttattccattcacaaaacagcgatccggaagaaggagcctgatgtggtatagtcaggcggggcttgaggacgaaaaatgcagaagaaaaataaaattaccatgggcgatattgcccgcctggcgggcgtttcccaggcgacggtatcgctggtgctgaataacagccgcaccatccggttaagcgacgccacaagagagcgcgtgtttgatgccgcgaaaacgctgggttatcagaagctggcggtgcagcaccgcccggaagggcaggaggaagtggcgctgctggtgagcggtatgcccggctacgatccctttggcgatgcgctcagtgaagccagcgcctgtgcctggcagcacgatacgctgttgtcagtgtacgattacggcgaggacagcgagctggcgcggcatatcctgcgtcagctggccagccgccgttgcgccggggtgatttttgcaagccccgtgacgcgcccctttgatttctcgccgttcgagggcgtgtgcgattttccggtcgtgctgcttaatcagtacgacgaacagcgcccactgctgcccacctttttacccgacgatcgcgccaacgcctgccagataacacagcatctgctggatcagggggtcacccgtatcgcccatatttccggtgatgaatggatggatgccagcaaggaacgtctcgaaggctatgagcagacgctgcgccacgccgggatcgaaccggatgcggcgctggtgcataaaaccgactggtcgctgaacgcgacttttgccgccacgctggaactgatgcagttgccgcagccgccgcaggcgatcttctgcgccagcgactggatgacgctcggctgctatcaggcgctcgccacgctggggaaacgtattccggaagatgtgctggtatgcggctacgacgatcagcgcatttcgcatcagctgacgccgatgctcaccagtatacagctggcctataacgaactgggcagaatggcggtggagtatctgtgcgccggggaagatgccgcggcgcacattaagctggtgggaaaattgcaggttcgcgccagcagtcagcgcatcaggtgatcgggatcatcaccacgctctgcaccgtcgggcgctcgcacagctgctgataccagcgcgtcaggttcgggcgcggcgtccaggcggtgtgcacattcagcaggctgtaaacaaagggcgcgagggcaatatcccccagaccaaactccttgccggagaaccacggcgtgctggccagcgcctcgtcgaggatgccgagcaggccatcacaatcggcaatcgcctcgtcaatggctgcccgatcgcgctgctccggcggggttctcaccagtcctttaaggatcacgctgtggcggggcgccagcgtagtcgctgaccagtccatccacttttccgcctgcgcacgggcagccggggcgtcgatccataagcgtccctgaccatactgcgcggccagaaaacgcacgatggtattggattcccacagcacgctgtcagtttcgtcatcgcgcagcaacggcaccagaccgttcgggttcatcgccaggtattccgcatcatgattcagaccgtactgtaaaccggccagaatttgcgtgtaaggaagttcaagctcttccagcgtcaggcggacttttttgacgttggtggaattatttcggccccacagggtaatcatataaattccttctcggtggacagcgggaacgcgcgccaggcacgtctgatcctctatgttgaaataaatttaacattcaggcaacgacttacaaaaaaaatcctccacttgcggcgtcgatcccgtaatttgcataaactttaaaaaactttaccggttaatgattggtttccatgcctgagtacgttattactcaccgtttattgcgaagcggtgacgtgacgcgatttgttttgaatggatacacgggtggcatttatgacgcatttcgctttatccctgcgcggcctggcggcgggctctgcgctattatttcttttctccccttcgctgtatgcggttgaacaggttccggcggcaccggcagtggatgcccgcgcctggatactgatggactatgccagcggtaaagtgctggcggaaggcaacgccgacgagaagctcgatccggccagcctcaccaagctgatgaccagctatgtggtcggacaggcgctgaaggcgggaaaaattcatcttaacgatatggtgacggtaggcaaagacgcctgggcaacgggcaacccggcgctgcgcggctcgtcgctgatgttcctcaagcctggcgatcaggtgccggtttccgaactgaataaaggcgtgatcatccagtccggcaacgatgccagcatcgccatcgccgactacgtggcgggcagccaggattccttcgtcagcctgatgaacaactatgcaaaacggctggggctgactaataccacctttaaaaccgtgcacggtctggatgcgccagggcagttcagtaccgcccgggatatggcgctgctcggcaaagcgctgatccacgatgtgccggaagagtacgccatccataaagagaaagagtttaccttcaataatattcgccagccgaaccgtaaccgtctgctgtggagcaccaacctgaatgtcgacggcatgaaaaccggcaccacggaaggggcgggctataacctggtggcctccgcgacccagggcgacatgcgcctgatttcagtggtgctgggcagtaaaacggatcgcatccgctttaatgaatctgaaaagctgctgacctggggcttccgcttctttgagaccgtcacgccaattaagccggatgcgacttttgtcagcacccgcgtgtggtttggcgacagcaaagaggtgaagctgggggcaggcgaagccgggtctattaccattccgaaaggtcagttaaagaacctgaaagcgacctggacgctgaccgagccgcagctgaccgcgccgctgaaaaagggccaggtggtgggcacgatcgatttccagcttaacggcaaagtgattgaaaaacggccattgctggtaatggaagcggtggaagagggcggtttcgtcagccggatgtgggactttgtgctgatgaaattccacgagtggtttggcagctggttctcgtaaccggaccggtttttttgttgccgggtggtggtcacgcttacccggcctacggaacatgtgtaggcccggcaagcctgcgccgccgggcaactcaacccgcactatgcgtctgaatacatcaacgtgatctgtttcgctttcgccagcgcgcataacgcctcgtccgggcggcggtcgctgacgatggcgtcaaaagcgtccagatcgcccatacgcgccgggcgcactttatcaaacttactgtgatccaccaccagcacatgatactgcgcatgggccatcgcccagtgcttcaccggtaactcttccagattgaaacaggtcgctccctggaccgggtgcacgcccgccgctgaataaaatgccagatccgggcacaggttattcagcgtctcgttaaagttcagcggtttaaaaatcgcattgctggcgtggaactcgccgccgcagaggatggcccgacacaagggcttttcctgcaacgccataaaagtattcagcgagtagcaaatggcggtaaagggcagatcctgaggaatggcgtcaatgatccagggcgtggtggtaccgcagtcaaaaaataccagttggtgcgcctgcaccagcttagcggcatattgcgcggccagacgcttttcatccaccaggcgggttttctgatcgcttaacagatagtggctggcggtacgcggctccagcacgatataaccgccaagcaggaccacaggcgcattgcgggcgccgagatcgcgacgaatggtcatttctgaaacgcctaataacgccgccgcctctttcaggtgcagcttgtcggtacgcttcagcgcctgtaacaacaggcctaaacgctcgtcacgtttcgtttccataaatcccctggcatgatgaaaaccccgctcgctgcggggtgctcaatcttacctgtgccggcaggcttagtcacgcacccagcctttgcggatcggcagagcaaaacagacgcggtaagcccgttgcagggcggcgtataacgactcgccgaacgcctgccacagcatctgcgccgtcagacagccgctgatgcccaccagcaaaccgcccagcatatccagcggccagtgcacgccgagatagacgcgcgaccaggcgatcagcagcgccacgcccatcatcgccacgccggaccagatgcggtgccagaacaaaaacgccagcgcaaaggtaaaggcgacggtgccgtgatcgctcggataggaatcatccggcgcgtgatgcaggaagttatagcccacgccctcgacaaacggacgatcgtgggggaaaacgtgccccattacccaggacaccacaaggctgacgacgatcgccagcgccattttaaccactaactgccgctgggcaggcccccacagccaaagcaccacggccagcagcggcacgatgtggatcagatcgcgggcaatgagaatggctgcctggatcagccaggcgggggagtccggcgtcgcattcatccaggcgaacagggtataattcagatcttccagcatcgtattgtcactcttttgccgcaggctacctgtagtggcgcgttgaaaaagggatcaccttaggatcaccgccttcgccggtaaaccagttttgtcttagttgtccggcgcttgtgagcaaccggaatgaacactctgcgataagagcatgccggagcccgcttaaaccgtggcaaaatagcccacgggaaaacggcggttaatgccgtaaaatgtgcgaaactttgtgcaggtcgcaaaattcgctgttacagggacggcgcattcattacactttgcgcgatttttcaggataaaaaatttcatgccaaaccatgctttacctggccgccgtttaggacgccaggcgttgttgtttccgctctgtctggtcctgtacgaattctcaacttatatcgcgaacgacatgatccagccgggcatgctggcggtggttgagcagtacaacgccggcattgagtgggtgccgacctccatgaccgcttatctggcggggggaatgtttttacagtggctgctggggccgctgtcggatcgtattggccgccgcccggtgatgttaaccggcgtggtgtggtttatcgtcacctgtctggcaaccctgctggcgcaggacattgaacagttcactatcctgcgctttttacagggtgtgagcctgtgctttatcggtgccgtgggctatgccgccattcaggaatcctttgacgaggcgacctgtatcaagatcaccgcgctgatggcgaacgtggcgctgattgcgccgctgcttggcccgctggtgggcgccgcctgggtgcatgctgcgccctgggaggggatgtttgtgctgttcgcggtgctggcggctattgcctttttcggtctgcatcgcgcgatgccggagaccgccacgcggctgggggagccgttatcccttaacgcgctggggcgggattataaagcggtaatgaaaaatggccgcttcgtggcgggtgcgctggcgacgggtttcgtcagcctgccgctgctggcgtggatcgcccagtcgccgatcatcatcatcagcgccgaaggcatgtcgagctacgagtacggcctgttgcaggtgccgatttttggcgcgctgattattggtaacctggtgctggcgcgcctcacctcgcgccgtaccgtgcgctcgctgattatcatgggcggcgggccgattgtgggtggtctgctgctggcggcggtggcaaccgtggcgtcatcccatgcttatttgtggatgaccgccgggctgagtatttatgcctttgggattggccttgccaatgccggactggtgcgcctgacgctgttcgccagcgacatgagtaaaggcacggtgtctgctgccatgggcatgctacaaatggcgattttcaccgtcggcattgaggtcagcaaacacgcatttctggcagggggtaacggtctgttcagcctgtttaatctggcgaacggcttgatctggctggtgctgatggtggtgttcctgaaggataaatccgtcggtaacgcgttgtcataggctgttaaaactgtaagcccggcaagcttgcgccgccgggcaaatcaggactaattctcacacggctgattttgtggctcaggtttcgccaccgcgcgggcaaccagcgcggcaatgatcaccagccccagcaccaccatcatcgcgctgcgcagaccatagtgctcgccgaggaagccaagcagcggcggtcccaccagaaacgccagatagccggtggtggcgaccacgctgacgcgcgtcggcgcatccgggccggtatcgctggcggcggaaatggtcagcgggaagccgagtgatgcccccagtccccacaaaatcaccgacacgcccgccacccaggcgctgtccacaaagatgatcaacgcgatgcccagtgcgcccatcaacgcactggcgcgcaccaccgcgacgcggctgtagcggtcgataaaccagccgccggtaaagcgtcccacggtcatacccagcgtaaagcctgtatagatgagcgagccggaggtcgggctgaacccgtgcccgtccaccatcagcagcggcagccagtcattggcggaaccctccgcaaaggccatcgccagcaccaccacgccgatcagcatcagctggacatcgcgataaaaaggcacgcctttcccgccctgaccgttctcctcagcggagcccttgccggtgccgtccggtatggcagtgatggcgataataatcggcataatggtggccagcgccgccagcagaatatgcagattagcgctcacgccgagcgccgtcagccccatgccgacgcctgcgcccgccagggtaccgaggctgtagaagccgtgcatcatcggcagcacggttttatccagcgcctgctccactgccgcgccttcgacgttgatcgccacttcggcagagccgaggctcgcgccaaatactgccagcccgcaggcgaacagcagcggcgacgcgaaccacagcgccacgcttaagataatcataccgaccacgctgaaggacatggcggtgcggataacgctgcgggtgccgaagcgcttaaccagccagccggaggagaggacgccgctcatcgagccgacggacaaaccgaacagcaccacgcccatcccggctgtagaaacagacagggtgtcgcgtatcgcgggggtacgcgtggcccaggaagccattaacaggccgggtataaagaaaaacataaataacgcccaggtgcggcgttgcagtgccttgcggggcgagtgcgtcagtgcgttcatgcaaaatctccgttgtgaagcaaaagtgtacggcattctgcaaaagagggtaaacccgcaatgttaattattattgaaccgttgccgggcgtttttccgcaggcgcaaagcgggttttaccgtgcgcatgctcgccgccgccctgtccacgcttaagctgtatcacttcgccacgctgccaggcatcggcaccgggggcgaccgggtgcgcatccagatcgcggcgcgattcgcggatttctttcgtattcacgtcaaaaaggcgatcgcgttcggcaagcagggcgggatcaagctggccgtcagcggtaaagcccatcatcagcgccggaatgcccagcggcagggttttgtcgcgatcagtgtgccaggtgtgccaggttttaccgtaggtattaacgattttgcccatcagcgctttttccgcaggcgcaggcaggccaggaccaatcaggctgccggacatcacttcatgccggtggctgtgccagagctttttctcttcaggcggaagggtattgaacagccgctcgctgataatgtattccacgcccatgagtttggcatcgcgggtattaccgtcgtaaatcactgcctgcatcacgtcttcgtttaacacggtgacataatggtgcgcttccatctgtccgttctgatcgccattataaaaatgaaatccgtcgagataagtattgatggcgtcgatcggcggcctggactgcatcacgctggcaccggattccagcagctgcaatttaccggaggtttcagcgccaggcgcggtgacttttgatggtgaactgctgccgccgcagccggaaagaaccagggcggtaaggatgtacagggggaatttcatgtcagctccgtaagactgttcagggtctaataaccttagacggtaatgggatttacggcaggagagtgatgaagaacatggcatcattagcgtttctttataattatgtgagatagctttcagcttttttgtgttgctcaataatatgtttccgaactactttccgataatacagcgtcagtatcgcgctgattgccagccaaaataaacctgtttcaaacgtactcagtgcggcgtagagcacggttttgctcttctcaaaatttgtaatctctttcgaaatgtaccgggtatgttcctttttcctgaacatgtcgcaaatgaaacccgtcagatccgcagacagtctgcttcgctgcgacagggtgttaaccggtgtctggtcacattgctcagtcgttacggctaaggaatgaccggaaaatagtgatgccgattttgcactgtcatgggttaaataaaagaattcattggtgggcttatacaccagcaaagtccagttctgcggtgtaagcagggttttaatgtgcatagcggagagatatgacgccgaacccgcgccaaagatgataagcagaaaaccaaagaatagatcggttcgggtatttttcgggatcgtctttaagggaaggctgacataaaagagccgtagcggccatgccggaatacctgcctgcaaaagaaattccgatttgcctttaatgggagccgtaagaaactttcttatcagaaggaatgcagcgtaaataccaccaattaagctgaagatgccggtaagtgtacccaccggagaggtaataaattcgttggtgataatatctgcgacagaatcaaaactcttcatagtgcctccttgcctggtaatgaaggtgtccggaagaggggggacgcgcctgaggttcaggttatcttgtcacaaatttcaggcaataaaaaacccatcaaccttgaaccaaagatggcggggttgatgggctccacaaaatggggacatcaaagaaaagcagtggcaatagttatgactggcgctttgcggaaaagttctcgcgaaagcataaataatttgccactccggtcaggttgagacttatcctagccccggccagataatgatgatcagcgtaccggcaagggtcagcagcacgttggcgatggcgtaggtcccggcgtagcccagcgcggggatgttactgcgcgcggtgtcgctgatgatttccatcgccggggcgcaggtgcgtgcgcccataatggcgccgaacagcagggcgcggttcatgcgcagcacataagcgccaaacagaaaacagatcaccaccggcaccaggctgaccagcaaacctgccgccagcatctggccgccgacagcgccaagcccgtgaccgatgccgctccccgcgctcagcccgacgcctgccataaataccatcaggccgaactctttcaccatattcagcgcgccctgggggatgtaaccaaaagtcggatggttagcacgcaggaagccgagcatgatcccggcgaacagcagaccggcggcgttcccgatgccgaagctgaaattgctgaactggaaggtgatcatgccgatcatcagcccgacgataaagaaggcgcagaaggccagcagatccgtgacctggctgtgaatggagataaagccgatgcggtcggcgatagttttcacccgtcgcgcgtcgccgctcacctgcaacacgtcgcccttgttgagcagaatgttgtcgtcaatgggcatctcaatctggctgcggatcacgcggttaaggaaacagccgtgatcggtcagctttaactgcgccaggcggcgacccacaacgttgtggtttttcaccacgatctcttcggtgacgatgcgcatgtccagcaggtcgcggtcaaacacctctttaccattacggaagctcggatcgagacgcgcatgggcatccgggtagccgaccagcgcgatctcatcgcccatctgcaataccgcatcgccatccggcgcggccaggatgccattgcggcggatgcgctcgatgtagcagcccgtctggcgataaatgcccagctcgcgcaggtttttaccatcggcccaggccaccagctccggccccacgcgataggcgcggatcaccggcagatagactttgcggctggcgtcggtatccaggccgcgctcgcgggcgatttgctgggcgctggtctgtaaatcctgatgttgcagtttaggcagataacgcgcgccgacaatcaggctgaccagtccaatcaggtaagttaatgcgtagccgaggcttaaatgatcgagcgcggaggaaagttgcccgctgtccatacccgagtggcgcagcgtgtcgccggcacccaccagcaccggcgtggaggtcatggatccggcgagcatgccggccgtcaggccaatatcccagccgaataatttacccagaccaagagcgataagcagcgcgctgccgaccatcaccagcgccagcatcagatagtttttgccgtcgcgaaagaaaattgaaaaaaagttgggtcctgcttccacaccgacacaaaaaataaacagcataaagcctaaattgagcgcgtcggtgttaatcgcaaaatgctgctggcccagtaataaagaaacgactaaaacgccaatggaattacccagttgaatggagccgaggcgcaattttccgaggcaaagcccgagagccagtaccacgaataataacagtatgtaattcccatttaacaaatctgcgacgtttatattcacggagtctaacttcttgtttacttgtaagctgttgaaagaaataataaattgcgctaatgttttgcttaaggccagacgttaattaaaacaaattcactgaccaaaaatagcctgcaaacataatcaggccgtagtttagtcttattaagaaaccacggctagtcagaatcgtgcatgtaagtgggtgggtaatttggcaaggattgctgcatagctttatctgaccgggcgttccgaaggaacgcacgaggcgcttgatagaggcagtgtcaggaggattgtttgaaatctaaacgtggttgggcaagcgcgttttgctgctttctgctgtttattgtggtgtgtctgtcactggcgctgaagatgaaaggggcgtttcgcgcgtctggtcatccggagctgggcctgttgttttttgttatacccggtgccgtcgcaagctttgtatcccgtaagcgtcaggtactgttgccgctgatgggagcgatgctggccgcgccgctgtgctttgtgctgatgcgcatggttatcgcgcaggagcgtgaattctggcaggagctggcgtggttattcagtgcggttttctggtgcgcgctgggggcgctgtgctatctgtttgtcagtagcatgatgagtaaaaaggggcggagttaacgccccttttttattactgttaagcgaacaggccaagattggctctggcgtacgcttcaaaatcagtgcagccgccaatgtgtttctgatcgaggaaaatctgcggcacggtttctaccggcttaccgacggttttttccagatcggctttagtaataccttccgcgtgaatatccacgtagcgatagttaaaatcatcgcgctcagcagttaatttttctgccagttctttagcgcgtacacaatacgggcatcccgggcgaccaaaaattacagcgaacatacactctccttaatgcttgaggcctgacggcgaatgaaaccatcatgacgactatggtcaggcagggaaagcaggttttacctgttggtctgataccgtaaggctatgtttcgccaaaagctgtcagataatttcatctataatctcatccttttttacccggagagatgtaatgaccccgactattgacctgctgcttgctcatcgttccattcgccattttaccggtgagcccattacccgggtgcagcgcgatgccattattgccagcgcacaggcggcgtccagctccagctttttacagtgttcttccattgttcgcttaaccgatccggcgctgcgtgaaaagtttgtcaccctgaccggcggacagcagcatgtggcgcaggcggcggagttctgggtgttctgcgctgatttcaatcgccacctgcagatctgcccggacgcgcagttaggcctggcggaacagctgctgcttggcgtggtggataccgcgctgatgggacaaaacgccatgacggcggcggaatccctgggtcttggcggcgtttacatcggcggtatccgtaacagcattgtggaggtcacggaattactggcgctgccgaaacatgtgctgccgctgttcggcctgtgtcttggctggcccgcggataacccggacgtgaagccgcgcctgcctgcggccatggtggtgcatgagaatcgctaccagccggtggatgatgctttacttgcggcctatgacgatgaactggcggagtattatctgacccgcggcagcaataatcgccgcgatacctggagcgatcatattcgccgcaccatcattaaagaaaaccgcccctttattctcgattatttgcatcagcagggctgggcaacgcgataaatcacgttcatcctgcgcgcgcctgcgtgtattatacgcaggcttttccaggtcttgtcagagaggtgcagggtgaaaattgccatattgtcccgggatggaacgctctggtcgtgcaaacgcctgcgcgaagccgcgatacgtcgcggtcatctcgtcgagatcctcgatccgctgtcctgttatatgaatatcagtccggcggcgtcgtccattcattataaaggccgtcagctgcccttttttgacgccgtgatcccgcgcattggctcggccatcaccttttacggcaccgccgcgctgcgccagtttgaaatccttggcagctttccgctgaatgaatccgttgccatcacccgcgcccgggacaagctgcgctcgctgcaactgctggcgcgccagggcattgacctgccggtgaccggtatcgcccactcgccggatgacaccagcgatctgatcgacatggtgggcggcgcgccgctggtggtgaagctggtggaagggacgcaggggatcggcgtggtgctggcggaaacgcggcaggcggcggaaagcgtcatcgacgcctttcgcgggctgaacgcgcatatcctggtgcaggagtatattgaggaagcgaagggaacggatattcgctgcctggtggtgggcgatgaagtggtcgcggctattgaaaggcgggccaagccgggggatttccgctctaacctgcatcgcggcggggcggctacggtggcgaacattacgctgcgcgagcgggaaattgccattctggcggcgaaaaccctcggcctcgacgtggcgggcgtggatattctgcgggcgaaccgtgggccgctggtgatggaggttaacgcctcgccggggctggaaggcattgaaaaaaccaccggcgtggatatcgccgaccgcatgatcgcctggatcgagcgccaggccacgccggatttctgtctgaaaaccggcggctgagcggtttatcgacttcggcaatggtatggatcggcatttttgcgtaagctaatggccgcataattttttaagaggtagcacattctatggattcactcgtcgttcccggtctggacacgttacgtcagtggcttgacgagctgggcatcagtttttatgagtgtgatacctgccaggcattgcatctgccgcatatgcagaatttcgacggtatttacgatgccaaagtcgatctggttgacgacattattctcttctcggcgatggcggaagtgaagccctcggcgctgctgccgctggcgtcagatctgtcggccattaacgccagttcactgacggtgaaagccttcctggatatacaggatgataatctgccaaagctggtggtttgccagtctttattcgccgcgcctggcattacttttaaacagttctcctggtttatgcgccagagcgaagaacagatttccatggtgatccttgaggccagcgcgcatcagatgctgtttaccagcgaagaagaggatccgaacgccgacgccgcgccgcacaattttcttcactaagcgcccctgatttaaacgcagtcgctgccatggcggctgcataattcctcgttttattctgcttttaactattctttaaagaatatttcaccccacttcaggccgtttcggcttatcacatagactgatcgtgcataaaaaattagtaaaaggcgttttttaatctgacctatagcctcgaaccctggctacagttattcttgcggggcttcaatagcatgcagcgtctgccggataattcaaattatccgttgcagcggtgagtgacaaactatgcacgattcttgcatagcgtaaaggcgacgatttagttcgaatgttaacgaactttccagaaggaatgagatatgaccaccctgaataaaaaatggctgtctggtctggttgcgggtgcactgatggcggtcactgccggcaccttcgccgctgaacaaaaaacgctgcatgtctataactggtctgactatattgcgccggacacggtagcgaatttcgaaaaagagacgggcattaaagtcgtctacgacgtgttcgattccaacgaagtgctggaaggcaaattaatggccggcagcaccggttttgacctggtggtgccgtccgccagcttccttgagcgtcagctgaccgctggcgtgttccagcccctcgacaagagcaaactgccgaactggaagaacatggatcctgaagtgctgaagctggtggcgaagcacgatccggaaaacaaatatgcgatgccgtacctgtgggcgaccaccggcatcggttttaacgtcgataaagtgaaagcggcgctgggcaaagacgtgccgatcgacagctgggatctggtgatgaagccggagaacctggaaaaactcaaaagctgcggcgtggctttcctggatgccccggaagagatttttgccaccgtgctgaactatctcggcaaagatccgaacagctcgactgcctctgactacagcggggcggccaccgatctgctgctgaaactgcgtccgaatatccgttacttccactcgtcccagtatattaatgatctggcgaacggcgacatctgcgtggccatcggctgggcaggggatgtctggcaggccgctaaccgcgctaaagaagcgaaaaacggcgtgaacgtctcttacatcattccgaaagagggcgcgctggcgttcttcgacgtctttgcgatgccaacggatgcgaaaaataaagacgaagcgtatcagttcctcaactatctgatgcgtccggatgtgattgcccacgtcagcgatcacgtgttctatgccaacggcaacaaagcctccacgccgctggtgagcgcggaagtgcgtgacaatccggcaatctatccgccagcggacgtgttcgccaagctttacaccctgaaagtgcaggatccgaaaatcgaccgcgtcagaacccgtgcgtggaccaaagtgaaaagcggtaaataacgtcatttgaaacagttgcccggtggcgcttcgcttaccgggcctacaagatcgcaggaccgtaggccgggcaagcaaagcgccgcccggcgatacgcaccatgccggtgcgtttgcactcatatttgttctatgccggagagcaccccgtgaatgaggctaccccccgcccacaggcgaagtcccgcaaggcgttgacgccgctgctggagatccgaaatctgaccaaatcctttgatggtcagcacgctgtcgatgatgtcagcctcactatttataaaggcgagatctttgccctgctgggggcgtccggctgcggtaaatccacgctgctgcgtatgctggccggttttgagcagcccaccaccgggcagattatgctcgacggcgtcgatctcgcccatgtgccgccgtacctgcgcccgatcaatatgatgttccagtcctatgcgctctttccgcatatgacggtggagcagaatatcgcctttggcctgaagcaggacaagctgccgaaagcggaaatcgccagccgcgtcgccgaaatgctcagcctggtacacatgtcggaatttgcgaagcgtaaaccgcatcaactttccggcggccagcgtcagcgtgtggcgctggcgcgcagcctggcgaaacgcccgaagctgctgctgctggatgagccgatgggcgcgctggataaaaaactgcgcgaccgtatgcagctggaagtggtggatattctggagcgcgtcggcgtcacctgcgtgatggtgacccacgaccaggaagaagccatgaccatggccggacgtatcgccatcatgaaccgcggtaagttcgtgcaaatcggcgagccggaagagatttacgagcatccgaccacccgctacagcgccgaatttatcggttccgtgaatgtctttgaagggctgctgaaagagcgtcaggaagacggcctggtgatcgactcgccggggctggtgcatccgctgaaggtcgatcccgacgcctcagtggtggacaacgtgccggtctacgtggcgctgcgcccggaaaaaatcatgctctgcgaagatccccctgccgatggctacaacttcgctttaggggaagtggtgcacattgcctatcttggcgatctgtcgatttatcacgtgcgcctgcacagcgggcagatgatcagcgcgcagttacagaacgcgcaccgctaccgcaaaggcttaccgacatggggcgatgaagtacgcctgtgctgggatgccgacagttgtgtggtactgacggtttaaggagcggcgatgagtatacctgaagcaccggctcgtgctggcaagccgggcggttttacgctgtggctggcgcggatgcagatgaggcacgggcgcaagctggtgattgccctgccatacatctggctgtgcctgctgtttctgctgccgtttttgatcgtattcaaaatcagccttgcggaaatggcgcgcgcgatcccgccttataccgatctgatggcatgggaagacgggcagctcagcctgacgctgaacattaataacttcctgcagctgaccgacgatccgctctattttgaagcctatctgcagtcgttacaggtggcggcggtttccacgctctgctgtctggcgattggttatccgctggcgtgggcggtggcgcacagcaaaccctcgacgcgtaacatcctgctgctgctggtgattttgccgtcctggacctcgttcctgatccgcgtttacgcctggatggggatcctgaaaaacaacggcgtgctgaataacttcctgctgtggctcggggttatcgatcagccgctgaccattctgcacactaatctcgcggtctatatcggtatcgtgtatgcctatctgccgtttatggtgctgccgatctacaccgccttaacgcgcattgattattcgttggtggaagcctcgctcgatctcggcgcgcgtccgctgaaaacctttttcagcgtcattgtgccgctgaccaaaggcgggattattgccggatccatgctggtgtttattccggcggtgggtgagtttgtcatcccggaactgctgggcggcccggacagcattatgattggccgcgtactgtggcaggagttcttcaataaccgcgactggccggtggcctcggcggtggcgatcatcatgctgttgctgctgattgtgccgatcatgtggttccacaagtatcagagtaaaggcacgggagaccacgcatgaacaacttaccggtagtgcgctcgccgtggcgtattttgatcctcgtgctaagcttcaccttcctgtacgcgcctatgctgatgctggtggtttactcgttcaacagctcaaaactggtgacggtatgggcagggtggtcgacccgctggtacggcgagctgttccgtgatgacgccatgatgagcgccgtgggattaagcctgacgattgccgcctgcgcggcgaccatggcggtgttcctcggcactatcgcggcggtggtgatggtgcgtttcgggcgttttcgcggctcgaacggctttgcctttatgatcaccgcgccgctggtgatgcccgatgtcatcaccggtctgtcactgctgctgctgtttgtagcgctggcccatgccatcggctggcctgcggatcgcgggatgctgaccatctggctggcgcacgtcaccttctgtacggcttatgtggcggtggtgatctcggcgcgattacgggagctggacaagtccatcgaagaagcggcgatggatctgggcgcaacgccgctgaaagtgttctttatcattacgctgccgatgatcatgccggcgattatttctggctggctgctggcctttacgctctccctggacgatctggtgatcgccagctttgtctccgggccgggcgcgaccaccttaccgatgctggtgttctccagcgtgcgtatgggggtcaatccggaaatcaacgccctggcgtcgatcatccttggcgtggtgggaattgttggttttatcgcctggtatattatggcgcgggcagaaaagcagcgagtgcgtgacatccagcgtgcaagacgcggctgatggcactaaaatctcgttaagaacgcaatgccgcgcctgtcgcggcatttttttcgcagggaagataacgcattggatttaatgagcaaaagaccagggatgcatgcccggctcaacgtcccggcgctggtacaggtggcggctatcgccatcatcaccacgcgctgcgttgacctgatcatgctcttcgacctgctgggcgtgcgcggcgtggtggactttgtccgtcgcagcgcgcagacctgggatctgacgctgatttttctcggcagtctggtgctgctgtttgtcgaattttactgtgcgttttccatgggcaaagggcgtaactgggcgcgctggctctatctctgctcgcagattgtggcgaccggttatctgtgggcggcatccctcggctatggctatccggaactgttcagcatcgccggcgaatcgaagcgcgagatcctgcactcgctgtttatgcaaaaactgcccgatctgctgatcctttttctgctgtttgtgccctcgccaagccgacgctttttccatctgcgttaacggtggtacaatcccggccccgcaaattttaaggttttcatcatgcagtgcgcactctatgacgccgggcgttgccgatcctgtcagtggatcgaacagcccgtcgcccgacaactcgatgccaaaatggacgacctccgcacattgctggaaggtatgcccgtagccgggtggtgcgcaccggtaagcggcccggagcagggctttcgtaataaagcgaaaatggtggtcagcggcagcgtggaaaaaccgctgctcggtatgctgcaccgtgacggcacgccggaagatcttaccggctgcccgctctatccggcctcgttttacccggtctttgcggcgttaaagccttttatcgcccgcgcgggcctcacgccctacaacgtggcgcgtaaacgcggcgaactcaaatatctgttactcaccgaaagccagcaggacggcggcatgatgctgcgttttgtgctgcgctccgacgccaaactggcccagttgcgcgcagcgctgccggaattgcaggcgcagctgccgcagctgaaagtcatcaccgcgaatattcagccggtgcatatggcgatcatggaaggggagcaggagatttttctcaccgggcaacaggcgctggccgagaactttaacggcgtgccgctgtggatccgcccgcagagtttcttccagaccaacccgcaggtggcggcaagcctttacgctacggcgcgggactgggtgcgggcgctgccggtgacgcatatgtgggatctgttttgcggcgttggcggtttcggtctgcactgcgccacgccggaaatgaagctgaccggtattgagatcgccccggaagccatcgcctgcgccagagagtcagcccgggcgctggggctgcaaaacatacagtttcaggcgctggattcgacgcgtttcgccaccgcgcagggggaagtgccggaactggtgctggtcaacccgccgcgtcgtggtatcggcaaagcgctgtgtgattacctgagccgtatggccccgcaatttattatctattccagctgtaatgcgcagacaatggcgaaggatttgcgcgaactaccgggttaccgcatcgagcgtgtgcagctgtttgatatgttcccgcataccgcgcattacgaagtgttgacgttattggtacgggagtaatgccgggtggcgctggcgcttacccggcctacttaatgatgttttccctggcccggcaagcggagcgccgccggggggaaagggcatcttactgcgggaaccactggtcgctgattttctgataagtgccatcggttttaatggctttcagggcggcgttcagtttttccagcagggctttattatccgggcgcacggcaataccgaggccggtgccgaaatactgcggatcggtcactttcggcgtggcggtgcccagctgcgggttggttttcagccattcgttcaccaccgcggtatcaccaaacacgccgtcgatacgaccatttttcagatcgataatcgcgttctggtagctgtcataggccacggttttcacttccggatgctgatcctggaggtatttctgatgcgtggtgccgttttccatgccgatgcgtttacctttcagctcttcaaaagatttaaacgcgccttttttggcaatcaccaccgctgagttggcgtagtacggctcggtaaaggccacctgcttgctgcgatccggggtaatgtccatgccggagatcaccgcgtcatattttttaaacttcagcgccgggatcaggctgtcaaaggcgtggttagtgaaggtgcactctgcctgcatctgtttgcacagcgctttcgccagatcgatatcaaaaccgacaatctgattgctggcatccagggattcaaacggcggataagtggcggaaacgccgaagctgattttgtcggcggcgctggcaccggctgcgaaggtggcaagaatagcggccagaactaactttttcatggtggaactcctgtctgtcagtcttattgtttttaccgtatctgcggcatgggttaaccatgccacttaatgaatttatatgcaatataattgattaattatatttctgcgggcgtaaaaaaggcgggttgccccgcctgtttttaagcattagtttcgccgttcaaaagccagcgcccgacgctcgataagacgcatcattaacgtcagtaaaccatttacaatcagatagataagtccggctgcgccaaacaccatcacatcatacgtccggccatacagcagctgtccgtggcccatgacttccatcagtgtgatggtatatgccagcgacgtgcttttgaatactaataccacttcgttggagtaggacgagagggcgcgtttaaaagcgtacggcagcagaatcgccagcgtatcttttttactcatccccagggctgagcaggactgccactggccctccggaatggcgcgaatggccccgtaaaacagctgcgtggtataggcggcgctgttcagcgacagggccagcagcgcgcacagccagggttcggagagcagatgccacagtaccggatattcctgtagcgtcgggaactgtcccggaccgtagtaaatcaggaagatctgcaccagcaacggcgtaccggtgaacagcgtaatgtaaccgcgcacaatccacaccagcaccggcgttttcagcgtcagcacaatggtaaatagtagtgccagcaccagcgccaccagaatggacgccacggtgagcgtcaggctggtgtgcagccctttcatcagttcaggtaaatactcaagcatcagtcggctctccgctcaaaacgtgtcgcgcgcaggtcaatgcgtttgaggatgtactgactgagcagggtaatgaccaggtaaatggccgccgccacgatataccaggtaaaaggctcctgagtacgggtggcgatactgcgggtctgcaacatcaaatcgttcacgctgatcaaggataccagcgccgtgtctttcagcagcaccagccactgattgcccagccccggcagcgcatgacgccacatctgcggcatcaccagacggaaaaaaatcgcgcttttcgacaggcccagcgcctggccggattcccattgccccagcggaacggctttcagtgccccgcgcagcgtctgggaggcgtaggccgcgtagagcagcgacagcgcaatgacgccgcacaggaacgggctgacatcaaagttttcaatctgcatttgcagcggaatttgcaccacgcccagattgagcgtgaagccgtcagataacattaacagcagctgtgaggagccaaaatagacaaacagcaccaccagaatttccggcaggccgcgcaaaatagtgaccagcgccgatcccgcccatgcgacgggacgccatttgacggattcccataccgcaaacagcatcgccagcgcgaggccaatgatcagcgcacaaacggcaaggccgacggtcatcccggcggcgcttgctaaagggaacatgtcattcatcaaggattacttctggaaccatttgttatagatgttctcgtaggtgccatctttcttcactttatccagcgcagcgttgaatttctgctgaagttcagtgttgccctgacgaacagcaatgccgaggccggtaccgaagtaatctttatcggtcactttgtcgcccacggcggccagcttgtcactggctttcagccactcggtcaccaccgcggtgtcaccgaataccgcatcaatacgaccattctgcagatccagcttcgcgttctgatagctgtcgtaaggcacggtggtgatttccgggtgcttatcggtgatgaatttctggtgcgtggtaccgttctgcacgccgacttttttgcctttcagcgcgtcaatgctggcgaatttacctttctgaccaatgaacagcgcggagttgtcgtagtaaggcttagtgaacagcacctgcttttcacgctccggcgtgatgtccataccggccatcaccgcgtcgaaacgacggaatttcaggctcgggatcaggctgtcaaaagcctggttggtgaaggtacaggtcgcatcgatctctttgcacagcgcgttggccagatcgacgtcaaagccgacaatcttgttactggcatccgtggattcaaacggagggtagcttgcttcggtggcgaaacgaatagtctgggcagcaccggcggagaggctgacgctggcgagcagggcggcaatcagtacttttttcattgtcatagtcccgaaaagatcagtgagataagtagtgtttaaaagcatcggtctgcggcgcggcaaagcggctggcatccccctgctcgataatatgaccattttccatgtacaccacgcggctggcggtcttgcgcgccacttccacttcgtgggtcacgatcacctgggtgatattggtttccgccagttcgcggatgatgctcacgatctgcgcggtgatttccgggtcgagcgcggcggtaggctcatcaaacaacagcacctgcggctccatcatcagcgcacgggcaatagccacgcgctgctgctgaccgccggagaggtgcagcgggaaacgatcgctgtagggtttgagacgcaaacgctcaagcagcttttcagcgcgcgccagcgcctgatctttgctcagacccagcacgcggcagggggcttcgatcaggttttgcagcacggtcaggtgcggccataaattgtattgctggaacaccatgccgacgttctgccgcaggctgcggatcgctttgtcagacggggcctttgagaaatcgaactgattgccggcaatagtgagcgtgccggagcgcggcatctccagcagattgagtacgcgcagcagggagcttttgcctgcaccgcttgggccaagcagcaccagcgtttcgccctcagggcaatccaggttgatatcgaacagcgcctgatgtgcgccgtagaaacagttaatgccgtttaattgaatactcatcgaggcaatctaatagctattgaggccgcaaatagtaacgttgacagaatagttatgcaatatttctgcgtgaaaaggtaaatataaagcgcatccagtaataaagttagcacaaaaccctggacgtggtgtgatgcaggtagaaatgtcggcattcaccgcggaatgccagacattttacgggggttaacagatttaacccgttaatgatgcataatttatcagcgatgctcgacagactgacgcagcgatccggcaggcgcgtgagcgttgccgcccagataacgcacatcatcaaccgcccagcactgaccttcacggatcatcagcacttcgtcctgccacgtctggctgccctgggtgagggtgacgcgcagcggaatattgcgggcatcggtgttagggatggttgaggcgctgctgacgctggcggtttccggctgggtggtgcggctggagaacggatcgctgcgcaggaaggcggtgtttttggtatcacggctggcgtcggccagcagcttcgccagatcgtcgctcaggtacggacgcagcgcggtagcatcagtgctgcggttctgaatacgaaaatcgtagaacttttgtgccacactgtcaggaccgccttcgacacaggggccgctgcgtgtgccaatatccttgaacgcgggggttaccgttgtacaggcgctcaacgccagcgcgcagggtacaatgacggataaaaatgagtagcgcataatgatttccttattaacctactgtctgttcaatgatagcgtatcggtttgattatgcgcgcgttaggcactgaacgttaaaaggagaagcaccatgcaattttcaaccaccccaacgcttgaaggccagccgattgtaaaatattgcggcgtggtcaccggggaggcgattctgggcgcgaatatcttccgcgatttttttgccgggatccgcgacattgtcggcggtcgctcaggcgcttatgaaaaagagctgcgtaaagcgcgggaaatcgcctttcgcgagctggaagaacaggcgaaagcgcttggcgcagacgcggtagtcggtattgatatcgactacgaaaccgtcggtaaggacagcagtatgctgatggtgagcatcagcggtacggcagtgaaaacccgctgatgaaaagctggtttgggctgattgcgctggcgctgctgctcaccggttgcgccagcgaaaaaggcgtggtggataaagctggctatcagctggatacgcgccatcaggcgcaggcggcctatccgcgtattaaggtgctggtgatccactacaccgccgacgattttgacgcctccctggcgacgctgaccgacaaacatgtcagttcgcactacctgatcccggcacggccaccgctgcatcagggcaagccgcggatctggcaactggtgcccgagcaggatctggcctggcatgcgggcgtcagcttctggcgcggcgcaacgcgcattaacgatacttccatcggcattgaactggaaaaccgcggctggcaaaaggttgccggcagcaagcgctttacgccctttgagccgcagcaaattgccgcgctggtgccgctggcgaaaaacatcatcgatagttacaacatacttccgcagaacattgtggcccactcggacattgcgccacaacgcaaggacgaccccggtccgttattcccctggcaggcgctggcgcagcaggggataggcgcatggccggacgatgaccgcgtagcgttttacctgaacggccgcgatcccgcgacaccggtcgatcaggcgcagctgctggatttgctgtcgcgttatggctatgaggtgaaaccggagatgacacccgcgcagaaaaagcgggtgatcgtggcattccagatgcatttccgtccggcgcgctgggacggtgtggcagatgcgcagagcctggcgattgccgaagcgctgctggaaaagtacgggcagggctgaacaggcctcagcggtgtaacttaccgtgatctttcagccacagcgccgtgcggcgaatgccttcatcaagcgtaacctgcggctgatagcccagctccgtctgcgcgcgtgacgtatccagcgtgaaatcaaagttcagcttcgccacgccgtagtgggtcagggcgggctctttcgcttttttatcgccaaaacgctccagactgcgggcgatcatatccagcatcggccacggcacggagcggatacggcaatcgatacccagttcgtcaattaatcgctgcacgatagtccgcagcttcaccggttcgccgttggtgatgttgtacgcccggcccgacggcagcgcatcgcacacctcctgacttgccagccacatcgcgtgcacggcattctcgaaataggtcatatccactaacgcatcaccgccgcgcggcaacagcacgctgcggtagtggtgcatcatctgggcaagacgcgggataaacactttatcgtgcggtccgaacaggctctgcggacgcagcacggtgaagcgggtgttggggttcgcctgcgccagcatatgcaccacgtcctccgccgccgctttactgcgggcgaattcgttggcgtagcgcaacggacggaaatcttcctgaatgttccggtgatggtgataatcaaaatagacggacggcgaggagacgtgaataaagttacgcacgccccaggccaccgcccactcacccagacgacgggtagcgcgcacgttagccagatcgaaggcttcctgggtgccccagggcgaggtaaagctggagcagtgccacagcgtatccacgcctgccagcatcacttttgcctgggaagagaccagctccgtcagatcggcctgtacaaattcagcgcccattttttgcagcagcttgcccatcgcttcattgcgacctgtcgccctgacgctgacgcctttctgccgcagaaactcgaccgcgtttcggcctaaaccgctggttgcgcccgtgaccagaaccttcatagcaatccactgtgttgaaaagaatttcgtgcgcattcttccgtgaaaaacggctggttgcaatgggaaaggtgaaagattaccgcttccattcagactttctctctattttgttctgtcgggcgcgtgatgtggccttccgcgccttagcgttgtaaaaaggcctgccagtgcgccaccagttccgtcagctgttcgcggctgacgtcaagatgcgttaccagacgcgtcaccggcgaggcgttcagcagcacgccgcgcgcctgcataaattcgcccagcgccgcggcatcttcttcgcccacgcgcacaaacagcatattggtttcctgacggctgacgtccgccccgatatcacgcagctgcgctgccagccaggcggcgttgtcgtgatcctctttcagacgctggacgttatttttcagggcgtacagaccggctgccgccagaaatcccgcctggcgcattccgccgccggtcattttccgccagcgcagcgcgcgtttgatgtagtcatggttgcccaccagcagcgagccaaccggcgcgcccaggcctttcgacaggcaaatggtgaaggagtcgcaatactgcgtgatctctttaagctcgcagccgtattccaccacggcgttaaagatacgcgcgccgtccacgtgcagcgccaggcctttctcacgggtaaagtcccacgcctgctgtaaatagtcgcgcggcagcactttgccgttatgggtgttctccaggctcagtaagcgggtgcgggcgaagtgaatatcgtcggctttgattttggccgccactttgtccagcggcagggtgccgtccgggctggcgtcgatgggctgcggctgaatactgcccagcaccgcggcaccaccggcttcatacagatagttatgcgcgccctggccgacgatgtactcctcgccgcgctcgcagtggcttaacagcgccaccagattcgcctgggtgccggtgggtaaaaacagcgcggcttccttgccgctgagttccgccgcgtaacgctgaagttcgttcacggtcggatcatctccgtacacgtcatccccgaccggggcggccatcatatagcgacgcatattgcgcccggggcgggtgacggtatcactgcgtaagtcgatcacggcatttccttattttgactcagaattgtccttctgttttacctgagccagttggttttcgccagttccatgacctcatcaccgcgcccgttgatgattgcgcgcagcatatacaggctgaagcctttggcctgctccagtttgatctgcggcggcatcgccagttcttctttggcgaccaccacatcgatcagcaccgggccgtcgatggcgaaagcgcgctgcagggcgtcgtccacttcggaggatttctcgacgcgaataccggtgataccgcaggcttcggcgatacgcgcgaagttggtatcctgtaaatcggtgccgtcagtcagatagcccccggctttcatctccatcgccacaaagcccagcacgctgttgttaaagacgatgattttcaccggcagcttcatctgtaccacggaaaggaaatcccccatcagcatactgaagccgccgtcgccacacattgccaccacctggcggtccggcgcggtggcttttgcgcccagcgcctgcggcatggcgttcgccattgagccgtggttaaaagagccgagcagacggcgtttgccgttcatcttcagataacgcgccgcccagacggtgggcgtgccgacgtcgcaggtgaaaatcgcatcgtcatcggcgtaatggctgatctgctgcgccaggtattgcggatgcacggctttttcgcttggcttcgccagatcgtcgaggcctttacgcgcatcacggtaatcttccagcgctttatcaaggaagcggcggtcggttttctcctccagcaacggcagcagggcggtgagggtggcgttgatgtcgccgatcagcgccatatccactttgctgtgcgcgccaatgctcgcggggttgatatcgatctggatgattttggcgtcggtcgggtaaaacgcgcggtacgggaactgggtgccgagcaggatcagcgtatcggcattcatcatcgcgtgatagccggaggagaaaccgatcagccctgtcatgccaacgtcatacgggttgtcgtactccacgtgctctttgccgcgcagggcgtggataatcggcgctttcagtttagcggcaaactcgatcagcggctggtgcgccccggcacaaccgctgccgcacatcagcgcgatattgctggagtagcgcaacagctgcgccagttttttcagctcctcatgcgtcggcgtgatcaccggctgcggcgcgtgataccagtgggcgctggcggtttcaggcgcggcctgaagcgcgacgtcgcctggcagtaccaccaccgacacgccgcggttgagaatggctttgcgcatggcgatggccagtacctgcgggatctgctcggggctggaaaccagctcgcaatagtggctgcactcacggaacaactcttgcgggtgggtctcctggaaatagccgctgccgatttcgctggacgggatatgcgcggcaatcgccagcaccggcacgcggttgcggtgacagtcaaacaggccgttgatcagatgcaggttacccggtccgcatgaaccggcacagaccgccagttcgccggtcaactgcgcttctgcaccggcggcaaaggcggcgacctcttcatggcgggtcggcatccattcaatggtgcccatacggttgaggctatcgcttaggccattcagagaatcgccggtgacgccccagatgcgttttacgccagcctgttcgagtgttttggcgacaaatgcggctacggtctgtttcataatgtctggtgtccttgttaaaagtctcgttaacaagcgtagatgaaaatggccgtcacacttttatcagccctacagctaacaggggtttatttccgccagcattcggaataatctgcaagccacataatgaaaacaggaatcatttcaaatggttaaatcaatgttaaatgcagttaacagaatgtttgcgcatgaagatgcgggcaagtttttactgcgtctgacggtgggcgggctgatgttatttcatggactgcataagctctttgacgggattgacggcatcagcggcatgctggtggcaaaagggttgccgggttttatcgcctacggcgtgctgctgggggaagtgttgtgtccgctgctggtgatcctgggcgtgctgacgcgtccggcggcgctgggcattgcgttcacgatggtggtggcgtggctgatggtcggcattaataaaaccggcgcgctggatgtgaccggcgcctgggcgattgaaagcctggtctatttctttgtggcgtcgatcgcggtggcgttgctaggcgcgggacggtattcctttgcgccctcggcagaatggcgttaatagccttgcccggcggcgcaagcttgccgggcctacaggtgtgcagttgtgtaggccgggtaaggcgtaagccgccacccggcatttttcagttgtccaggccgggtaaggcgtaagccgccacccggcgctatttattacgccaacactaaatcactctgcggatggcaggagcaggccagcacatagccctctgccacctccgcatcgctcagcgtcatgctgctggttacgctgtaatccccggaaagcacccgcgttttacagctgccgcacacgcccgcacgacaggcggcattaaccggcaccttattgctttccatcgcttccagtaacgtgctgccaaccggcgcataaaaatcccgcgccggttgtagcttgctgattttcagcccgcctgttgccgcggcagcggcgggtacaaagaactgctctttaaagaagcgggtcacgcccagcgctttcacctctttttccaccagatccatgtacggtgccgggccgcaagtcatgacggtacgcgaggccagatccggcacggatttcagcaactccgtggtcaggcgtccggagacaaaaccgtgagtggcattgttttccgccaccagcgtcaccggataacgacgccactcatcggcaaaaatgacatcttccggcgagcggacgttgaaaatcacctgcacatcggcgtcagggcgatacttcgccagccagcggcgcattgacataatcggcgtcacgccacagcccgccgccagcaacagcagccgatcgttaggttcgttatcacaggtgaattccccctgcgcatcggaaagccacagatagtcgccgcgcttcacgtcgcgggtcagccattccgagcctgcgccgccgtccagacgacggatggtcagcgtgatgtattcgctgaccccaggcgttgaggagagcgtataggcgcgcagcgtatcggcggaattacgaatgctgaccagcgcatactggcccgcacggtacgggtagtagtcatggcataacagcgacagcgtccacacatcaggcgtttcctgtgtgatgtggtgaacctgcatacgccatggacattgggctacgggcatcgtcataacgtcctccttacgcgctcagcagttgctgaatgtcctgttccacggtggtcacggaacgcagaccaaacttctcattcagtaccgccagcagatccggcgtcaggaagcctggcgcggtcgggccggtaacaatattggtgacgccgagcgacagcagcgtcagcagaataacaatcgctttttgttcaaaccaggagagcaccagcgacagcggcagatcgttcacgccgcagcccagtttttccgccagggtgaccgccagaataatcgccgaataagcatcattacactgaccggcatccaccagacgcggcagtccttcgatgttgccgaagtccagcttgttaaagcggtatttcccgcaggcgagggtgaggatcaggcagtcatccggcacgctggtggcaaaatcggtaaagtagttacgctcgccgcgtgccccgtcgcagccgccgacgaggaagatgtgacgcagtttttcacggcttaccagatcgatcagcgtatctgccgcgccgagcagcgtctgacggccaaagcccacggtgatcagatgttcaatttcgctgaacgggaagcccgccatctgctgtgcctgggcgatcaccggcgcgaaattgtcaccttccaggtggcttacgcccggccagccgacgatgctgcgcgtccagatacgatcgtcatacgcgccgaccgtcgggtcgataatgcagttcgaggtcatcacaatggggccagggaagcgggcgaattccacctgctgattctgccagccgctgccgtagttacccaccagatgtttaaacttacgcagttcggggtagccgtgcgccggcagcatttcgccgtgggtataaacgttcacgccggtgccttcggtctgttgcagcaggttgtagagatctttcagatcatgaccggagatcaaaatacatttaccggcagtggctttgacgttcacctgggtcggggtcggatggccgtaggtttcggtttcaccggcgtcgaggatgctcatcactttgaagttcatctggccgatttccatcgaacattccagcagcgcattcatatccgcaggccaggtgccaagccacgccataattttgtgatactgggcgtagatggcgttatcgtactggcccagcacgtgagcgtgttccatataggccgccgcccctttcaggccgtacaggcacagcaggcgcaggccgagaatattgtcgccgatgtcggctttgtctttgttcggcgtgaaggcttctgcctgacgctgcaactcgcccagatcgtcgctcaccagttgcagatccgccagcggatgatccacgctggccgccggatcgatgctctggcacagcgctttcagggcttcacgtttcgcaatggcgtcacgggcataacccacgatacgcggcgaatcgaagtttacgttagttaaggtggagaagaaggcgcgcggcgcaaagttgtcgatctcatggtcgatgagatcatagtcgcgggcttttaccgcccaggcggataacccctgcagcgccgcaatcagcagatcctgcaaatcagaagtttctgcggttttaccgcacatcccctgcgcgtaagaacagccgttgccagccggagtacggatagtttgctcacattgcacacaaaacatgatcacacctgtataagttatatttaaaatgcatgtttaagcttatgccgctgacgcaggggtttaaagtgatttgtatgactacttgcagggagattgatttaacgcaatttcaggcggtagtgacctaccgccggaggggtatcaggcggagaaaaaggccattaacagcggtaccagcagacttaacacaaaaccgtgcacaatggcggcgggaaccatctccagccccccgctgcgttgcagtaccggcagcgtgaagtccatggaggtggcgccgcataatcccagcgcggtagaacggctacggcgcaccagcgccgggatcagcataatggcgatcagttcacggcccagatcgttaaagaaggcggcgctgccaatgaccgggccaaaggattcggtcagcaggataccggagagggaataccagccaaaaccggacgccatagctaaaccggttttcagcggcagatcaaggatcagcgcgttaattatgccgcccgccagcgagcttaacagtaccaccacggcgacaatcatcccgcggcggttcagcacgatctgctttaaggtcatgccgttattacgcagctgaatgccaatcaggaacaggaggaaaatcagcgtatattcgctggcttcggtggcgtgctgcaggaatgtcagcccgctgaggccaattataaaaccgagcaccaccacgccgcacagcttaagggattccagcgccatggccacccgcgacggtaatttttcctgctggtgctgatgatgccagggcagggcgcgttcaagccataacagggcggcaatattacacagcataataatgacgatgctgaccgcggaataatgcagtatggccagcagattggtcgccagattatcgagaaaggccaggcttatccccataaaaaaaagaatgacgtacacgatccagcttaataagcggttaatcagcttaagggcggcggtatggtgcaggggaatgagataacccacgataagcgggataagtatgatgagtagtcctgataacatgaacagcctggatcctttgcttaaaaatgaaatagcgccgtaacacactactcaatccgcttaagtgagtaaagaagcagaaataaagaaaaattatgcagatgtgatgtccgtatattctctcaggtcttgatatattttacttttttccggcccgctatactgttgtactcaatggagcgccattattgccggaggagttatgctgctggaacgcgtggacattgccggatttcgcggtattaaccgattatctctgctgctggaagaaaataatgttctgatcggcgaaaacgcgtggggtaaatccagcctgctggatgcgctgacgctgttattatcacctgaatccacgctttatcatttcacgcgcgatgatttctggtttcccccgggcgatgttatggggcgcgaacaccatctgcatatcattctgacctttcgtgaaaccgagccggggcaccgccatgcccgacgttaccggccgctgaccgattgctgggtggccggagacgatggctatcaccggatattttaccggctggagggcgagctgggagaagacggcagcgtgatgaccctgcgcggttttctggatgccggagggcaactgctgccgctgacaaacatcgatgaacaggcgcggcatctggtgcgtctgatgccgatattgcgcctgcgggatgcccgttttatgcgccgcattcgcaacggtacggtgccggaagcgccggatgtggacgtcaccgcccggcagcttgattttctcgcccgcgaactggtatcgcgtccgcaaaaccttagcgacgggcagatacgtcacgggctgacggcgatggtacagctgctggagcactattttgccgaacagggcaccacccaggcgcggcatcgtctgctgcgtcgccacgcccacgatgagcagcgcagctggcgctatctcgatattatcaaccggatgatcgacaaacccggcggccgcagccacagggtcattttgctggggctgttttccaccctgttacaggcgaaaggcacaatacggctcgataaagacgcgaggccgctgttgctgattgaagatccggaaacccgcctgcacccaatcatgctgtcggtggcctggcagttgctgaacctgctgccgttgcagcgcatcaccaccactaactccggcgagctgctgtcgctgacgccggtggagcatgtctgtcggctggtacgcggctcctcccgcatcgccgcctggcgactgggaccgggcggcatgaacgccgaagacagccgccgcatcgcgtttcatatccgcgctaaccgcccttcgtcgctgtttgcccgctgctggctgctggtggaaggggaaacggaaacctgggtgatcagcgaactggcgcgccagtgcggtcatcattttgacgccgaagggatcaaagtgatcgagttcgcccagtccggcctgaaaccgctggtgaaattcgcccgtcgcatggggattgaatggcatgtgctggtggatggcgacgaggccgggaaaaaatacgccgccaccgcccgcagtatgctggacggcaatcgcgatcatgaacgcgatcacctgacggccttaccggcgatggacatggaacattttatgtatcgcgaaggcttcgccgacgtttatcaccgggtggcgcaactgccggaaaatgtgccaatgaatatgcggcgggtgatcatcaaagccattcaccgctcatcgaaaccggatctggcgatagaagtggcgatggaagcggggcgacgcggcgtggatgccgtgccgctgctgctgcgcaagatgttttcccgcgtgctgtggctggcacgcgggcgggcagattagcccatcgcgcgctgcacctgcgtcagcaggctgtcgagcagttcataacggcggcgatactccgcgcgttttttgctggcgatctcctccatgggcttgcgcggcatcgccagcggcatctgataatcgcccctggccgtcggctcgccgcccagcgacagccagaagccatcgtaatcggcgtgcagtttgtcctgctttttctggcggtagcgccagttgcgataaatatgcgtatggttactgaccgcgaggatctgcgccaccccaagcttttcacccattgccatggccgcttccaccagcaggcgtttagggaacaggccgtggcaggctttggtggcgctctggatcagttgatgatcgacatgggctttcgcgccctgtaaaccgccgacataaagcgtgtttttgccctccaccgggcagagggtaaaagtcagctccgccagcaccgtctgctcagcatcgcaaaacaccagcgtcgcttccccttctttgtccagcatcgcatccgcgcgcagacgcaggctgtagggccgatcgtttttgccgttaagggtcgccagttccacgccgtgacgggaaaggtagccattgagtacgccggcaggcagttgctgcatcaggctctggtaatgccagcgcagggcgtcaatcgccgtctgccgcgagatgttcaccgacagccagggacgatgcagacggcacggcaggcccggctgcgcattgagaagttgcagcaggcacggctgtctgaccagaatggacatccactttgcggtagcgaagggcgtcgccagcgagcgaagcacaaatttccggcggtaggccgggttttgccaggccagcccggggatcagcattccgctggctaaatggcggaaaagctgccagcctgtttcaggttgcggcaatgcggagtgtggagtggcaacgaatgtagacatgataaacctgcgcgtaataaccaggcattcatttcagcaaggacactctcaacgccacctcaatgggtttgcgggataaaataaaggtggggtttcgttgaccctccgtttaggtagaattcatcattactgaagtcagctcaattactggaatttatatgaagctaaagggaaaacgcaggaaggtcgtattgttgctgaccgtgctggcgctgattgccggattctggctgtggcggcagctcaatgcgccgctgccgcagtaccagacgctgatcgtccggccgggtgatttgcagcaaagcgtgctggccaccggcaaactggatgcgctgcgcaaagttgacgtgggtgcgcaggtgagcggtcagttgaaaacgctgtcggtgaatattggcgataaagtgaagaaagatcagctgctgggcgttatcgatccggagcaggcgcagaaccagatcaaagaggtggaagccacattaatggagctgcgcgcgcagcgccgccaggcggatgcggaaagacgtctggcgcaggtgacgctgggccgtcagcagcaactggcgaaaacccaggcggtgtcgcgccaggatctggatactgccatcactgagctggcggtaaaagaggcgcaaatcggtaccatcgacgcgcaaattaaacgtaatcaggcaacgctggatacggctaaaacgaacctcgaatacacgcgcatcgtcgcgcctatggccggggaagtgacgcaaatcaccaccctgcagggccagacggtgatcgccgcgcaacaggcgccgaacattctgacgctggcggatatgagcaccatgctggtgaaagcccaggtctctgaggcggacgtcattcatctcaaacccggccagaaagcctggtttaccgtgctgggcgatcccctcacccgctatgaaggcgtgctgaaagatattctgcccacgccggaaaaagtgaacgacgcgattttttatcatgcccgttttgaagtgccgaacccgaaaggcgtgctgcgtctggagatgaccgcgcaggtgcatattcagctttcaggagtgaaaaatgtgcttaccgtgccgctgtcggcgttgggcgatcccattggcgataaccgttacaaggtcacgctgctgcgcaatggcgaaacccgcgagcgcgaagtgactatcggcgcgcgtaatgacaccgatgtggaagtgaccaaaggtctggaagcgggcgatgaagtggtgacgggcaccacaacgcccggagtgacgccatgacggcgctgctcgaactgcatgacattcgccgcagctatccctccggcgaaggccaggtggaagtgctgaaggggatcacccttagtattgaagcgggtgaaatggtggcgattgtcggcgcgtccggctccggcaaatcaacgctgatgaatattctgggctgcctggataagccctccagcggcacctatcgcgtggcgggcagcgatgtcgccctgctggataaagacgcgctggcccgcctgcgccgcgagcattttggctttatctttcagcgctaccatctgctgtcgcacctgacggcggcgcagaacgtcgaagtgcccgcggtctacgccggtaccgagcgtaaagctcgtttacagcgggcgcatgaattactgcaacggctggggctgggggagcgggaaggttatcagccgtcgcagctgtccggcggccagcaacagcgcgtcagtattgcccgcgcgctgatgaacggcggccaggtgatcctcgccgatgagcctaccggggcgctggactcgcgttcgggcgaagaagtgatggcgatcctgcatcagctgcgcgacaacggtcacacagtgatcatcgtcacccacgatccgctggtggcggcgcaggccgaacgcatcattgagatccgcgacggggaaatcatcagtaatccgccgccgcgatcccgcgctgccgccagcgcggatcgccatgtgaatacccggccggaaagcggctggcgacagttcagcagcggatttcgcgaagcgctgaccatggcctggcgggcgatggccgccaacaaaatgcgtactttgctgaccatgctggggatcattatcggcatcgcctcggtggtctcgattgttgtggtgggggatgcggcgaaacagctggtgctggcggatatacgcgccatcggcaccaataccattgatgtctatcccggcaaagattttggcgatgacgatccgcagtatcagcagtcgctgaaatatgacgatctggtggccattcagaagcagccgtgggtcagctccgccacgcctgcggtatcgcaaagcctgcgtttacgttacggcggcattgacgtcgcctccagcgccaacggcgtcagcgggcagtattttaacgtttacggcatgaccttcagcgaaggggcgacctttaacgacgaacagctgaaagggcgcgcgcaggtggtggtgctggacgccaatacccggcggcagcttttccctaataaagcgaaagtggtgggcgaggtgatcctcgttggcaatatgcccgcgacggtaataggcgtggcggaagagaagcagtcgatgttcggcagcagcaaaattttgcgcgtctggttgccgtataccaccatgtccgggcgcatcatggggcagtcctggcttaactcgatcaccgtgcgggtgaaagagggctacagcagcgaacaggcggatcagcagctgacgcggctgctctccctgcgccacggtaaaaaagatttcttcacctggaatatggacggcatcttgaaaacggcggaaaagaccacacgtacattacagctgtttctgacgctggtggcggtgatctcgctgttggtcggtggtattggcgtgatgaatatcatgctggtgtcggtgacggagcgtacgcgtgagatcggcatcaggatggcggtcggcgcgcgggccagcgacgtgctgtcacagtttcttattgaagcggtgctggtgtgtctggtgggcggggcgctaggcgtgagtttatccatgctgattgcctttacgctgcaaattttcctgcccggctgggaaattggtttttcaccggtggcgctgttgacggcgtttatttgttcaaccttcaccggcgtgctctttggctggctacccgcccgcaatgcggcgcggctggatccggtggatgcgctggcgcgtgagtaaataaaaatgccagcccgcgggctggcattttactggcaggctgtacacaatgaaacgaagcaggactacgcgacggcctcggcaatcgcaacggcttccgtttcaaggggaacaatgaggctggcatgattgcctttcggtccctgatgtacatcaaaccggaccatctgcccggctttgagcgttctgtaaccatccatctggatggtggaataatgagcgaaaatgtcttcgccgccgccttcagggcagataaagccgaaccctttggcgttgttgaaccacttaacagtacccgtttccatgcttcgacatccttcgtaaatcttatttaagtaagatggaatgaaccggtggcagagagggcagttgttcaaaacgtcgccaactcccgacctgtacaatttagatatttcgggctttgggtcaagcgttagggtgtgcagcgaagcatgattgagtcaaaattttgaagcagttaacgcaattgcggtagtttgtgacagccatcgcggatggcaatgatagatgatagttatctcacttatgatgtagattcaaaatgcatctagactcaagttactgacagtgtgcacgctgttggcaacttcaaccgaagatgaatacgagcgatgggcaagaccaatacctggctggatttcgaccagctggcggcagataaacagcgcgaagcgctaaaaccgccatccatgtataaagtaatgttaatgaacgatgattacacgccgatggaatttgttattgacgtgctacaaaagttcttttcttatgatgtagaacgcgcaacgcaattgatgctcaccgttcactatcacgggaaagctatctgtggtgtgtttaccgccgaagttgcggagaccaaggtggcgatggtgaatgagtatgcccgggagaacgaacatccattgttgtgtacgttagaaaaagcctgatcaaggcaaactattgaggggggtgcccaatgctcaaccaggaactggaactcagtttaaacatggctttcgccagagcgcgcgagcaccgacatgagtttatgaccgtagagcacttgttactggcgttgctcagtaacccatcagctcgcgaagcactcgaagcgtgctccgtggacctggtcgcgctgcgtcaggaacttgaagccttcatcgaacaaaccacacccgtgctgccgctcagcgaagaggagcgggatacccaacctacgctcagcttccagcgtgtgttgcagcgcgcggtcttccacgttcagtcatccggccgcaatgaagtgaccggtgcgaacgtgcttgtcgccattttcagcgaacaagagtcgcaggcagcctatctgctgcgcaaacatgaagttagccgtcttgatatcgtgaatttcatttcacatggtacgcgtaaagatgagccaggccagtcgtccgaacccggcaaccaacctaatactgaagagcaggcaggcggggaggaacgtatggaaaacttcaccaccaatcttaatcagcttgctcgtgtcggcggaattgacccgctgatcggccgcgataaggagctggagcgcaccattcaggttctgtgccgtcgtcgcaaaaacaacccgctgctggtgggtgagtccggcgtgggtaaaaccgccattgctgaaggcctcgcctggcgtattgtgcagggcgacgtgccggaaatcatggccgattgtacggtttattcgctggatattggttcgctgctggcgggcactaaataccgtggcgatttcgaaaaacgctttaaggcgctgttaaagcagctggagcaggataccaacagtattctgttcatcgacgaaatccacaccattatcggtgcgggcgctgcgtcgggtggccaggtggatgccgctaaccttatcaaaccgctgctctccagcggtaagatccgcgtgatgggttccaccacgtatcaggagttcagcaacatcttcgagaaagatcgtgcgctggcgcgtcgtttccagaaaatcgacgtcaccgagccgtctgtagaagaaaccgtgcagatcctgaacgggctgaagccgaagtacgaagcgcaccacgacgtgcgttacaccgcgaaagcggtacgtgcggcggtggagctggcggtgaaatatatcaatgaccgtcacctgccggataaggcgattgacgtgatcgacgaagcgggcgcgcgtgcgcgtctgatgccggtcagcaaacgtaagaaaaccgtcaacgtggcggacatcgaatccgtggtggcccgcatcgcacgtattcctgagaaaagcgtctcgcagagcgatcgcgatacgctgaaaaacctcggcgaccgcctgaaaatgctggtcttcgggcaggataatgcgattgaggcgttaaccgaagcgattaagatgagccgtgccggtcttggccaggatcataaacctgttggctctttcctgttcgccgggccgaccggggtcgggaaaaccgaggtgaccgtgcagctgtcgaaagcgctgggcattgagctgctgcgttttgatatgtccgagtatatggaacgccatacggtcagtcgtctgatcggcgcgcctccgggatacgtcggcttcgatcagggcggactgttaacggatgcggtgatcaagcatccgcatgcggtactgctgctggatgagatcgagaaagcgcacccggatgtctttaacctgctgttgcaggtgatggacaacggcacgctgaccgataacaacgggcgtaaagcagacttccgtaacgtggtgctggtgatgactaccaacgccggggtacgtgaaaccgagcgtaaatccatcggcctgatccaccaggataacagcaccgatgcgatgggcgagattaagaagatctttacgccggaattccgtaaccgtctcgacaatattatctggttcgatcacctctctaccgaggttatccatcaggtggtcgacaaatttattgtcgaactccaggtgcagctggatcagaaaggcgtgtcgctggaagtcagccaggaagcgcgcgactggctggcagagaaaggctatgaccgtgccatgggtgcgcgtccgatgggacgtatcattcaggataacctgaaaaaaccgctcgccaacgaactgctgtttggttcgctggtggacggcggccaggtgacagtggcgctggataaagagaaaaatgaactgacctacggttttcagagtgcccagaagcacaaagccgaagccgcgcattaatctcttttaaataaaacaaaaccgggtgaaaacccggtttttttatggctgtactttttcgcggcaaataaaaaaggccgggattgcccgacctttagtctttctatacgccagtgaaggcgtagcagcgattgctattagcgactacggaagacaatgcggcctttgctcaggtcgtacggggtcagctcaacagtcactttgtcgcccgtcagaatgcggatatagtttttacgcattttaccggagatatgcgcagttaccacgtgaccgttttccagctcaacgcggaacatggtattaggtaacgtatccagtacggtaccctgcatttcaatattgtcttctttggccatctagtcctcgggggtatcactaccaaaatttttttgaaccggcaagataatgccgaaattcatcagttaagtaaagatttgcgcggataattacgcagcaaagtaaccttggcgtattgcccacattataaaccgacgcgtaaaagcgcgaacgtaaaggggagcgacaagataaacgaagggcgttacctgattcgagctagtcccaaacggtggcggggcaacaggcagaagctactctgcgcgtccattataacactctgacaagaaatgtgccgaaaacattcaccgcgtgggcgtaaataacgtccgcggcacccaaaaatgtggcggcatcttttgcagacgcatcgcattcaggtgttgcagatattcccgccgcggaatatctgtcgcgccgagagaggcggtatgttcatttaatacctggcagtcgatcaactggccgccctgacgcaggaaatcctcgcacaataccagcagcgccgttttcgaggcgttcacccggcggctgaacattgactcgccgcaaaacaacgcgccctgcgacacgccgtacatgccgccaaccagctcatccccttcccagacttcgatggaatgggcgtagcccagctcatgcagacgatgatacgccagcaccacatccggcgtgatccaggtaccttcatcacgatcatgggcgcagcctgcgatcacccgtccaaaatcatgattgagggtgacgcggtaaggggaacgcttgtgaaagcgggccatgctgcggctgaggtgaaactgttccggccacaggacggcgcgtggatccggcgaccaccacaggatagggtcgcccggagaaaaccagggaaagatgccgcgctgataagccatcagcaggcgggcagggctgagatcgccgcccagcgccagcagcccgttaggttcacgcaacgccccttcgggcgagggaaaagcaacagaatgacgagataactgaaccaggcgcatgaccacaacgctccacaacgcaacaaggaatgattcaaatttacagccgttgcttaaaccggtagtagcgaccctgttttgccattaacgctgcgtgattaccttgctcaattatttcaccgttgtccatcactattatttgatcgcattgcgacaaaccacgcaaacggtgggtaaccatcagcaccgttttgcctttcgtcacttcagcaagcaaatcaaggatttgactttcagtggtggcgtccagcccttcggtcggttcgtccagtaaaaacagcggcgcatcatgcagcaaagcacgggcgatcgccagacggcgcagttcgccgccggagagctgcctgccgccttcgcccagccagctgttcagcccgccgtcatcaagcaacttttccagcccgacctgagtcagcactgtcgccagcgcctcatcggaagcggcaggggaggctaacagcaggttatcacgcagggtggcgctgaacagatgcacccgttgcggcaccacgctgatggtggcgcgcagggcggcttcgctgagacttgtcagcggctgaccgttcagcaggatctcgccctgctgcggatcccatgcccgcgtcagcagttgcagcagcgttgatttaccgcagccggtgcgtcccagaatggccacacgctgcccggcggtcacttccagcgatacgcctttcagcgctggctgtacctgttgcggataggtgaaggacacggcgtcaagccgcagatcgacctgcgcaggcatggccgtttccccggcagagaaagtcacttccggcgggcaatcggtgatctcggtgatacgacgcgcagaggcgatcacctggcctaaatgctggaacgcgcctgtcactggtgccagcgcttcgaaggcggccagcgcgcagaaaacaaagagcgcaatcagcggaccgggctgggtattgccgcccacgccgcccgccgccagccacagcatggcaatcaccgcaaagccgctaatcagcagcatcagcgcctgggcaagcgccgtcagttcagactgacgacgctgggcgtcatgccagcttaattcggtattctccatctgctcacggtagcgttggctggcgccaaaaatggtcagctcagcctggccctgcaaccagctggtcaggtgctggcgatactgaccgcgcagcgcggtcagtttttcaccggtggatttacccaagcggtaaaacagcggcggcagcaggagtaaggtcagcagcataatgccgccgagcgtcagcgccagcgtgacatccagcacgccaagacccagcgtcaccacaaggatgacgaccagcgcgccgaccagcggcgaaatcacccgcagatagagatgatccagcgtatccacatccgccaccacgcggtttagcagatcgccctgacggaaacgcgccagcccggcaggagaaagcggcagcagcttgctgaaggtggaaacgcgcagatgagaaagaacgcggaaggtggcatcgtggctgaccagccgctcaaaatagcggccagcggtgcgcgtaatggccgcgccacgcaccccggcggcgggaagcatatagttaaaactgtaaatacccgccacgccaaccaccgccgaggcggagaggaaccagccggagagggtcagcagaccgatactggccagcagcgtcacaatggcgagcaccacgcccagcgtcagcagccatttatggcgtttatataatgcgagatagggaaggagcgcgcgcatttaaatttcctcctggcgatgggcgagcagggcggcgaaaggcccgcctgcggcggcgagagcggtataatcgccttgttcaaccagcctgccgttttgcatcacccagatactgtcccagttcgtcagtccttccagttggtgggtcaccatcagggtggtctgacgcagcgaggcggtattcagcgcctgcatgacacgctgttcgctgtgcgcatccagactggcggacggctcatccagcagcatcagctggctggcattcagcagcgcacgcgcaacggccacgcgctgggcctgcccgacggacagacgcgccgcctgatcgcccactggcgtatcgatcccctgtggcaactgcggcaaaaattcgctcacccaggcggcgtccagcacggctttaagctctgcttcgctggcgtccggccgggccagcagcacgttatcgcgcagcgtggtcgccggaagctgtggattctgcccgacccagcttagctgcctgcgccacgccagcggatcgagatcgcgcagctcgacgccgttgatttgcagcgatccttcatagctgagaaaaccggagagggcgttaatcaacgagcttttcccggaaccgctttgcccgaccagcaccacgcgctgcccggcaggaagggtaaaatcgagcggcccagcaaggatcgcgccttccggtgatttaatcaccgcgccgcgggccatcacgctgaccggctcatcggtattcagcgtgcgttcgccgcgttccggccatgccagcggcgtttcgaggaaggttttcaggctgtcagccgcgccaacggcctgcgcttttgcatgatagaaggtgcccagatcgcgcagtggctggaagaactccggcgcgaggatcagcgtcaggaagcccgcaaacagcgtgacgcctgcgccatagtgaccaaaattcaactcgcccagataagagaagccgaaatacaccgcgaccagcgcaatagaaagggaggtaaagaattccagcacgccggaagataaaaacgccatgcgcagcacttccatcgtgcggctgcggaaatcctgggatgcctggcgaatattctcggtttccgcttcaccccgaccaaaaatgcgcagcgtttccataccgcgcaggcggtccagaaaatgcccgcttaatctggccagcgctttaaaattgcggcggttcgcatctgcggcgcccatgccgaccatcgccataaacatcgggatcaagggcgcggtgccgagcaaaatcagcgcggcggcccagttggtcgggaaaatcgtcagcacaatcaacagcggtacgctggcagccagcgccatctgcggcaaatagcgcgcatagtaatcgtgcatgtcgtcgatctgctcaaggatgagcgtcgcccagctgcccgccggttttccctggatccacgccgggcctgcctgttgcagacggtccagcaccagacggcggatctcatagcggatgtgcagaccggcatggaagccgacgcgttcgcgcagccacactacccaggcgcggagaataaacaccagcaccagcagcacaaagggcagcaacagcgcctcgcggggaatattttccataatcatatgattaaggatggtggccagcagccaggcctgagccacgatcaatatgctgctgacaagccccagaatgcgggaggtcatcagccagcgacgggaaattacgctttgctgtttgagccagcgggttagttcttgttgacgggttttattcattgcgcgcttagcaggtaaagtgaccataaatttatgcacggcaatgttacaacggcgaaaaaataaaggcgactgatagtcgccttctttactttgtctttaagtgccttactcgctgaaattatttactgttttcagccagaccgtcgagataacgttcagcatccagcgcggccatacaaccggttccggcagaggtgatcgcctgacggtagatatgatccattacatcgcccgccgcaaacacgcccggaatgctggtctgggtcgcgttgccgtggatccccgactgcactttgatgtagccgttttccagctccagctgaccgtcaaaaatagcggtgttcgggctgtggccaatggcgacgaacagaccggcaacttctaaagattccacgttatcgctgttctgcgtatcgcgtaggcgcaggccgctcacgcccatctggtcgccggtcacttcttccagcgtacggtgagtgtgcagcacgatattgccgctcgccactttatccatcagacgtttgatcagaattttttccgcgcggaaggtgtcgcggcggtggatcaggtgcacttccgaggcgatgttcgccagataaagcgcttcttcaaccgctgtattgccgccgccaatcaccgctactttctggttgcggtagaaaaagccgtcgcaggtagcgcaggcggatacgccgcgtcctttgtaagcttcttctgacggcaggccgagatagcgggcggaggcgccggtggcgatgatcagcgcatcacaagtgtactcgccgctgtcgccggtcagacggaacgggcggttttgcagatccactttactgatgtgatcgaaaagaatttccgtttcgaatttcgcagcgtgttcatgcatacgctccatcaacagcggtccggtcaaatcatgcggatcgccaggccagttttccacttcagtggtggtcgtgagctggccgcctttttccataccggtgatcagtaccgggtgcaggttagcgcgtgcagcatagaccgcagcggtgtaaccagcggggcctgaaccaaggataagcagcttactgtgtttagccgtgcccatgagatcctcattatagttagcggacaatgcgcaggattgtagggaatttacgggcgtaaaaaaagggtgcagcgactatgttaatgatttgtgtagccgatgaatctaccccggcggggagatccataataaattctactgaaatttggcctgttataaggcgataaaatgaggtttgccaggaggtgttgatgaatatctggcatgttgtactaaaaaaagatgttttgctttgacaatcccctgcgcatttgcgaaaacattcgaggaagaaaaaaagcagtgtttcgcgcatgacgcaaattcatgcatgcaaatgccattttaccgggttattgaaatcgacgcacggcgtggacagacgccatgcgcgatattaatagctgccgctggcaacggtcttctcaatacagacccctggaatatgtagcgcaactaacaataaccagcgatgcataaaccgacgggcaaagactctcaacagtgaagtgcacagggtcaaggcaggagtagggaaggaatacagagagacaataataatggtagatagcaagaagcgccctgggaaagatctcgaccgtatcgatcgtaacattcttaacgagctgcaaaaggatgggcgtatttccaacgtcgagctttcaaagcgagtaggactttctccaacgccgtgccttgagcgcgtgcgccggcttgaaagacagggttttattcagggctacacagcactgttaaacccgcactatctggatgcatcacttctggtttttgttgagattactctgaatcgtggcgcgccggatgtgtttgagcagttcaatgccgcagtacaaaaacttgaagaaattcaagagtgtcatttagtatccggtgatttcgactacctgttgaaaacacgcgtgccggatatgtcggcctatcgcaaactgttaggggaaaccctgctgcgtctgccgggcgtgaacgacacccgtacctatgttgttatggaagaagttaaacaaagcaatcgtctggttattaagacgcgctaacacggaacaggtgcaaaatcggtgtagtttgattacactcctgttaatccatacagcaacagtgccggggcaacctggcgctgttctccgttttagcatcaaggacctggagagccttacttgagccaggaatatactgaagacaaagaagtcacactgaccagattaagtagcgggcgtcgtctactcgaagcactgctgattctggttgccctgtttgctgtctggttgatggcggcgctactcagctttaacccttccgatcccagctggtcacagaccgcatggcatgaacctatccataatctgggtggcgtgccgggcgcatggctggctgataccctgttctttatctttggggtgatggcttacaccattccggtaatcatcatcggcgcctgctggtttacgtatcgtcatcgcgcaacggaagattacattgactatttcgcggtctcgctgcgtctgatcggcgtgctggcgctggtgctcacctcctgcggccttgcggccatcaatgccgacgatatctggtactttgcctccggcggcgtgatcggcagcctgttaagtacagccatgatgccgctgctgcacagcagtggcggaaccctcgcgctgctctttatctggggagcggggcttacgctctttaccggctggtcctgggtcagcatcgcggaaaagattggcagcgttatccttaatatcctgaccttcgccagtaaccgcacccgtcgcgacgacacctgggtcgatgaagacgactacgaagacgacgagtacgaagaagacgcccccgtacagcgcgaatcacgccgggcgcggatcatgcgcggcgccctggcgcgccgtaaacgcgtcgccgaaaaatttgctaatccattgggtcgtaaaaccgacgaggcgctgttctccggtcgcaggatggacgatgaagaagagattcaatacagcgcccgcggcgtggccgcggatgccgatgacgtgctgttctccagcactaaagcgacaggcgcgccgcagtgggatgaatacgatccgctgctgagcgggcatagcgtcagcgaaccccttgcggcagcagccgtggcgaccacggcggcgcaggcatggagcgctccggtagaacctgtcatgcaggcaccggctcagccagtggccgagccgccttatgtggcgccacctgtccagcagcctcctgtggcgcagtatgccgcgccggaagagccttcatactatcagccgcctcagccgccagtgcatgaacatgaaaattacgcggcacaggcgccggtctactccgagccagaaacctatgccgcggtcacgccggaaccggagccgcacgttcagcagcaatggcagcagccggaaccgccggcagtagagccagaacctgcgcctgaaccggaagaaattaaacatacccgtccgccgctttactatttcgaagaagtagaagagaagcgcgcccgtgagcgggagcagctagccgcctggtatcagcctatacctgaaccagtccagccggaacctgcgccaaaacctgccccggcaccgtctgcgccagccgtcgagcctgcgcccgttgttccagccgccgcgcttaaagaagcctcaaccgccgctgctgcaggtgctgccgccgccgggccggtattcagtcttgccggtagcggcgcgccacgtccgcaggtgaaagagggcattggtccgcagttgccgcgcccgaatcgggtacgggtgccgacgcgtcgtgaactggcgtcctatggtattaaactgccgtcccagcggatggcggaagagcgcgcccgtgaaatggattacgcttctgaggatgaagcggacgccatgcagcaggacgaactggcccgtcagtttgcttccacgcagcaaagtcgttatggcgatgagtaccagcacgatcagaccggcactgaaataaatgaagatgaggttgcggaagcggaactggcgcgccagtttgctgccgctcagcaacagcgttattcgggtgagcagcccgccggggcaacgcctttctctccggctgattttgacttctctccgatgaaggcgctggtggatgacggcccgactgaaccgctgttcacacctggcgtaatgccagaatcgcagcctgccacgcctgcgccgcaaccctatcagcaacctgctgcgccgcagtaccagcagcctcagcagcagcccgtcgcgccgccgcagtaccagcagcctcagcaacagcctgttgcgacgccgcagtatcagcagccccggcagcctgctccgcaggacagcctgatccacccgttactgatgcgtaacggggacagccgtccggtaccgaaaccgaccaccagcctgccgtcgctggatctgctgacgccgccgccgagcgagacggagccggttgatacctttgcgctggagcagatggcccgcctcgttgaagcgcgcctgaatgatttccgcatcaaagccgatgtggtgaactactcgccaggtcctgtaatcacccgctttgagctcaatcttgcgcctggggtgaaagccgcgcgtatctccaatctctcccgcgatctggcgcgttccctctccaccgtggccgtgcgcgtggtggaagtgatccccggcaagccttatgtgggtctggagttaccgaataaaaaacgtcagaccgtttacctgcgagaagtgctggactgcgataaattccgcgacaacgcctcgccgctgacggtggtgctgggtaaagacatttccggcgagccggtgattgccgacctggcgaaaatgccgcacctgctggtggccggtaccaccggttccggtaagtcggtgggggtcaacgccatgatcctcagcatgctctataaagcgcagccggaagacgtcaaattcatcatgatcgatccgaagatgctggagctgtcggtatatgaaggcattccgcatctgctgaccgaagtggtcacggacatgaaggacgctgccaacgcgctgcgctggagcgtcaatgagatggaaaaacgctacaagctgatgtcggcgctgggcgtgcgtaaccttgccggttataacgagaagatcgccgaggccgcgcgtatgggtcgtccgatcccggatccgtactggaaaccgggcgacagcatggacgccactcatccggtgctggaaaaactgccgtatatcgttgtgctggtggatgaattcgccgacctgatgatgaccgtgggtaaaaaagtggaagagctgatcgcccgtctggcgcaaaaagcgcgtgcggcaggtattcaccttgtgctggccacccagcgtccttccgtggatgtgatcaccggcctgattaaggccaacattccgacgcgtatcgcctttaccgtttccagtaaaatcgactcccgtactattctggatcaggcgggtgcggaatctctgttaggcatgggtgacatgctctactccgggccgaattcctcctcagcgcccgtgcgtgtgcatggtgcctttgtgcgcgatgaggaagtgcacgccgtcgtgcaggactggaaagcgcgcggacgaccaaaatacattgaaggcatcacctccgatgcggaaagcgaaggcggcggcggtggtttcgatggcggtgaagagctggatccgctgttcgatcaggcggtgaactttgtcaccgaaaaacgcaaagcgtcgatctccggggtacagcgtcagttccgtatcggttacaaccgcgcggcacgtattattgagcaaatggaagcgcagggcatcgtcagcgagcagggccataacggtaaccgcgaagtgctggcgccgccgccgtttgattaaccttctgattgcaaagttgggtaaacgaacgaaaaatcagtcttttcctctgtcgccgccgtctcgtcaggcctacagtgagtgacagaagagtctcccggatggggagtgacgtacttaaggaataacaatgaaaaaaattgccattacctgtgcattactgacttcattcgcggccagcagcgtctgggctgacgccgcgggcgatctgaaaagccgtctggacaaagtcagcagcttccacgccagtttcacccagaaagtgaccgatggcagtggggcggcggtgcaggaaggacagggggatttatgggtaaaacgcccgaacctgtttaactggcacatgacgcagccggatgaaagcatcctggtatcagacggtaaaacattgtggttctacaacccgtttgttgagcaggcaacggccactaatctcagctcagccaccggcaatacgccctttatgctgattgcccgtaaccaggcaagcgactggcagcagtacaacattaaacagaatggtgacgacttcgtgctggtgccgaaaggcaataacggcaacctgaaacagttcaccattaacgtcagccagaacggcaccattaatcagttcagcgcagtggagcaggacgatcagcgcagcagctatcaactgaaatcccagcagaacggggccgtcgatccgtcgaaattcacctttaccccgccgcagggcgtgacggtggatgaccaacgtaagtagaggcatgagtgggaaatctgacgctcgatttttccgataatacgtttcaacctctggccgcccgtatgcggccagaaaatttagcgcagtatatcggtcagcagcatctgctggcggccggtaaacccttaccgcgcgcgattgaagccgggcatctgcactccatgatcctgtggggcccgccgggtaccggtaagacgacgctggcggaagtgataggccgctatgcggacgccgacgttgagcgtatatctgccgtcacctccggcgtaaaagaaattcgtgaagcgatcgagcgggcgcggcagagccgtaatgccgggcgtcgcactatcctgtttgttgacgaagtgcaccgtttcaataaaagccagcaggacgcctttctgccgcatattgaagacggcaccatcacctttatcggcgccaccactgaaaatccctccttcgaacttaactcagcactgctttcccgtgcgcgcgtttatctgctcaaatccctgaccgttgaagacatcgaagaagtcctaaaccaggcgatgacggataaagagcggggttatggcgggcaaaatatcgtgttgccggacgaaacccgtaaagcgattgctgaactggttaacggcgatgcccgccgggcgctcaacacgctggaaatgatggcggacatggccgaagcggatgacagcggcaagcgtgtcttaaaagaggcgctgctgacggaaatcgccggtgagcgcagcgcgcgctttgataacaagggcgaccgtttttacgatctgatttccgcgctgcacaagtcggtgcgcggcagcgcgccggatgcggcgctgtactggtatgcccgtatcatcaccgccggtggcgatcccctttatgttgcgcgccgctgcctggcgattgcgtctgaagatgtgggcaacgccgatccgcgtgccatgcaggtggcgctctctgcctgggactgcttcacccgcgtcgggcctgccgaaggcgaacgcgcaatcgcccaggccattgtttatctggcctgcgcgccaaaaagtaatgccgtctataccgcctttaaagcggcaatggcggatgcgcgcgagcgccctgattacgacgtgcccgaccatctgcgcaatgcgccgaccaaactgatgaaagagttaggctacggtcagcagtatcgttatgcccatgatgaagccaatgcctacgcggcaggcgaggtctatttcccgccggaaatagcacaaacgcgctattatcacccgacaaacagaggtcttgaaggcaagattggcgaaaagctcgcctggctggctgaacaggatcataaaagccccacaaaacgctatcgctaactgtggcgttgcggtaaggttatcgatgattctggtggttgcaggctgtgaccactttctctcattttcaattcgataagcacaggataagcatgctcgatcccaatctgctgcgtaccgagccagacgcagtcgctgaaaaactggcacgccggggctttaagctggatgttgataaactgcgcgctcttgaagagcgtcgtaaagttctgcaggtcaatacggaaaatctgcaggcggagcgtaactcgcgatcgaaatccattggccaggcgaaagcgcgcggggaagatatcgagccattacgcctggaagtgaacaagctgggtgaagaactggatgcggcgaaagccgaactggaaaccctgctggcagaaatccgtgatattgcgctggcgatcccgaacatccctcacgatgacgcgcctgttggccgcgacgagaatgataacgtcgaagtcagccgctggggcaccccgcgtactttcgatttcgaagtacgggatcacgtgacgctgggcgaaatgcacagcgggctggattttgccgcggcggttaaactgaccggttcacgctttgtggttatgaaaggccagatcgcgcgtatgcaccgtgcgctcgcccagttcatgctggatctgcataccgaacagcacggttacagcgaaaactatgtgccttacctggtgaaccatgacaccctgtacggtaccgggcagctgccgaaatttgccggcgatctgttccatacccgtccgctggacgaggaagccgacagcagcaactatgcgctgatcccgactgccgaagtgccgctgactaacctggtacgtgatgagatcatcgatgaagacgcgctgccgatcaaaatgaccgcgcatacgccgtgcttccgctctgaagccggatcttacggtcgcgatacccgcggtctgatccgcatgcaccagttcgataaagtcgagatggtgcagatcgttcgtccggaagactccatggacgcgctggaagagatgactggccacgcggaaaaagtgttgcagctgttaggtctgccatatcggaagatcatcctctgtaccggcgatatgggctttggcgcctgcaaaacctacgatcttgaagtctgggttccggcgcagaacacctatcgtgagatctcctcctgctccaacattggcgatttccaggcacgtcgtatgcaggcacgctgccgcagcaaaaccgacaagaaaacccgtctggtgcacaccctgaacggttcgggtctggcggttggtcgtacgctggtggcggtgctggaaaactaccagcaggctgatggtcgcatcgaagtgcctgaagtgttgcgtccgtatatgaacggcctcgagtacatcggctgatcaccgcgtcacccatcacatttaaagcgcctgcgggcgcttttttattgcctcattgacaccgaacaataaccccttttattaaaagggtaatactcactttgtattagcgcagcataaaaaacttaaaaaatgttatttcgctatagggaaaactatatagcgagtgttttttcgtgagcaagcaaagtgagtttttatgaaaatatctgttccggaggtgttactcaccgccggggtgagtcgtcgcagcctgatgaaaacctcagccataggcggcctcgctgccgccagcagcgccctgactttacccttttcccgcatcgcccgcgccgccgaggccattgcgccgggctcatccactgaaaaagtcgtctggagcgcctgcaccgtgaactgcggcagccgctgcccgttacgcatgcatgtggtggacggcaaaattaagtatgtcgaaaccgataacacaggcgatgacaactatgacggacagcatcaggtgcgcgcctgtcttcgcgggcgctccatgcgtcgtcgcgtctacaatcccgatcgcctgaaacaaccaatgaaacgcgtgggcaaacgcggggaagggaagtttgttcccatcagctgggatgaagcctttgacactatcgcgggcactatgcagcggctgatcaaagagtacggcaatgaatctatctacctgaattacggcacaggcacgctcggcggcaccatgacccgctcctggccgccgggtaaaacgctgattgcccgcctgatgaactgctgcggcggctatctgaatcactatggcgactattccacggcgcaaatcgctgccggactgaattacacctatggcggatgggccgacggcaacagcccgtccgacatcgaaaacagccagctagtggtgttgttcggcaataacccaggcgaaacgcgcatgagcggcggcggggtgacctactacgttgagcaggcgcgggaaaaatcgaaggcgcgcatgattattatcgatccgcgctataccgataccggcgcagggcgcgaagatgaatggatccctattcgccccggtaccgatgcggcgctggtgtcggcgctggcatgggtgatgatcgacgaaaatctcgtggataagcctttcctcgataaatactgcgtgggttacgacgaaaccacattgccggaaggcgcgcccgccaacgggcattacaaggcgtatattctgggcgacggcgatgacggcatcgccaaaacgcctgaatgggcggcggctattaccggtatcccggcggcccgtatcgtgaagctggcgcgggaaatctccatggcaaaaccggcgtttatctcccagggctggggcccgcagcgtcattcgaacggcgaactggtctcccgcgccattgccatgctgccattgctgaccggcaatgtgggcatcaacggcggcaacagcggcgcgcgcgaaggcgcttatgcgatgccgtttgagcgcatgccgacgctggaaaacccggtgcagaccagcatttccatgtttatgtggacagacgccattgagcgcggcccggaaatgaccgccacccgcgacggcgtgcgcggcaaagataagctggatgtgccgatcaagatgatctggaactatgcaggtaactgcctgatcaaccagcattcagaaatcaatcgcacccatgacatcttacaggatgataaaaaatgcgagctgattgtggtggtggactgccacatgaccgcatcggcgaagtatgccgatattatcctgccggactgcaccgcgtcagaacagatggatttcgcgctggacgcctcctgcggcaacatggattacgtgatcttcgccgaccaggccatcgctccgctgtttgagtgcaaaaccatttatgagatgacgacggaactggcgaaacgcatgggcgtggaagcgcagtttaccgaaggccgtactcaggaaggctggctgcgccatctttatgagcagtcccgcgcagcgatcccggcgttgccctcctttgaggagttccgggcacagggcatttttaaacagcgcgatcccgacgggcaccatgtggcctatcaggcgttccgtcaggatccgcaggcgaacccgctgaccacgccgtcgggcaaaatcgagatttactccacgcaactggcagagatcgccgccacctgggagcttgtggatggcgatgtgatccacccgttgccgatctacagcccgggcttcgagcatcacgaggatccacagcgcgaaaaatggccgttgcagctcaccggcttccattataaagcccgcacccattccacttatggcaacgtcaatgtgctgaaggccgcgtgtcgccaggagatgtggattaaccccctcgacgcgaaacaacgtggcatcgccagcggcgacaaagtgcgtattttcaatggtcgcggcgaagtacatgtcggggcgaaggtcacgccgcgtattttgcccggcgtggtggcattaggggagggcgcctggtacgacccggacgcgaaaggcatcgatcagggcggctgtataaacgtgctgaccacgcagcgcccgtcaccgctggcgaaaggtaacccgtcgcacagcaaccttgtccaggtcgaaaaggtttaaggagtaacccatgacaactcagtacggcttttatattgattccagccgctgcaccgggtgcaaaacctgcgagctggcctgcaaagattacaaagacctgactccggaagtcagtttccgtcgcatctatgaatacgcgggcggagactggcaggaagacaacggcgtctggcagcagaacgtgtttgcctattatctgtcgattgcctgcaaccactgcgccgatccggcctgcaccaaagtctgccccagcggcgcgatgcacaagcgcgacgacggttttgtggtggtgaatgaagaggtgtgcatcggctgtcgttactgccatatggcctgcccgtacggcgcgccgcagtacaacgccgctaaaggtcatatgaccaagtgcgacggctgccattcgcgggtgacggagggcaaaaagccgatctgcgtcgagtcctgcccgctgcgcgcgctggactttgcgcccgttgacgagctgcgtgaaaaatacggcagccttgatgccgtcgccccgctgccgtccgggcattttacaaagccgaatatcgtgatcaaacccaacgccaacagccgccccaccggggataaaaccggctttctggctaacccgcaggaggtgtgagatgggcaacggatggcatgaatggccgctgatgatttttaccgtgtttggtcagtgcgtggtcggtggatttatcgtcctcgccgtcgcgctgctgcgttttgagacgacatcgttgcaacggcaacgcatcttcaccgccatgaccggcctgtgggtgttaatggggctggcctttgtggcctcgaccctgcatctgggatcgcccctgcgcgcctttaatgcgctcaatcgcattgggcattcagcgctgagtaacgaaattgccagcggtgcgctgttctttgccgtgggcggatgcggctggctgctggcaatgatgaaaaagatgccgcccgcgctgttacgcgtctggctggtgatcaccgcgctgctggggctggtatttgtctggatgatggccagggtgtatgacagcatcgacaccatccctacctggtacagtctctggacctcgctggggtttttcctcactgtgcttactggcggcccgctgctgggctatctgctgctgcgggttgccgggtttcgggcatgcggcatgcgcgcgctgccagcggtgacgctgctggcggtcatgatcagccttgtggctggcctgatgcagggccatgaactggcagcgatttccagctctgtgcagcaggctgcggcgctggtgccggaatacggcaccctgatggcctggcgcgtcgtgctgctgctggtggcgctggcagtgtggatcgtcccacagcttaaaaaccgccagcctgccgtgccgctgctgtcgctggcattcgtgctggtgctggcaggcgagatgatcgcgcgcggcattttttatggtttacacatgacggtcggcatggcggtggctggctgacgtcatcagggtaaaaccggggggccaaccgccggttttaccgttttttcaccatgaaatatttcaactgaatgtaacggtatatcccggaaataacccatataaaacatcacgctattcactttgctctggccttacccgctccgttagatgagtaaattcaatcgacgtcctctaaaacgcccgcagcgccattttccgtagattgacaaagtttttgccggtggcatgatgcgctcgaattctgatcatcctcacggtttttcatccatgtttacttatacccggccggtgctgttactgctctgcggcctgttactgctgacgctggcgatcgcaacgctgaacacgctcgtcccgctctggctcgcccatgaaaaccttccggtgtggcaggttggtatggtcggctctgccttttttaccggcaaccttgtcggtaccctgctgaccgggcgtctgattaaacgcatggggtttaaccgcagctattacatcgcgtcgctggtgttcgccaccggctgcgtcggcctcggtctgatggtcggcttctggaactggatgctgtggcgcttcatcgccggtattggctgcgccatgatctgggtggtggtggaaagcgcgctgatgtgcagcggcacgtcgcgaaatcgtggtcgcctgctggccgcctatatgatggtctattacatcggtacggtgctgggacaactgatggtcagcaaactgtccaccgagctgatgcatgtcctgccgtgggtgaccggtatcgtgctggcggctattctgccgctgctgtttacccgcattgtcgatcagaacagcgaacatcaggaagccaccagcgtctggccgatgctgcgtctgcgtcaggcgcggcttggggttaacggctgcattatttccggcattgtgctgggttcgttgtatggcctgatgccgctctggctgaaccaccgtggcgtgagcgatgccggtattggcttctggatggccgtgatggtcagcgccggtattctcggacagtggccgattggccgactggcggatcgctttggacgtctgctggtgttacgggtgcaggtttttgtggtgatcatgggatgtctggccatgctcagcaatgcggcgatggcgccggcgctgtttgtcctcggcgcggcggggttcacgctctatccggtggcgatggcctgggcctgcgaaaaggtcgaacatcatcagttggtggcgatgaatcaggcgcttctgctcagttacaccgtcggcagtcttttcggcccgaccttcaccgccatgctgatgcaaagttattccgataatttgttgtttatcatgatcgccagcgtctcctttatctatctgctgatgctgctgcgtaaagcaggtcagcatccaacgccagtggctcacgcctgataaataaaaaagcctgtccatgacaggcttttttacggctgctttccaggatttctttcctgtttttgtaaagcggaacggacgataattgccatgagtacactctgactaaggcggcaattatgcacactcgtcgttttaataccctcgcgctggcagtcgttttatccctgtcctttgtttccgcaccgggcatggctaaccctggtaacgggaatggtaacggaaatcacggtaacgcggatcatgggaataaacagaaaaatgaccatggcaaccggggcggggcggaaaagaaaaacgtcagcgatgatgtctctgtccggctgagctacgatcgcgcccgttcgctggcggtgaatcatggcctgacgggttaccgttcgctgccgcccggcatcgccaaaaacctggcgcgcggtaagcctctgcccccgggcattgccaaaaaaatggtgccgtcttctatgctggggcaactgccttcttaccccggttatgaatggcgtatcgccggtgacgatctggtattgattgcgctgagcacggccattgtgacggcagtcatcaacggcgtgtttgaataaataaaaaagcccggtcgctatgcggcgccgggctttttgtttttcttaagcttagtacatgaccttgtgaccatactgttcaaggatgcctttcacgcgctccatggtctcttttttcggcggatgcacgccatcgagcttgtactcttcgcccatcgccacccacttatgtttacccagctcatgataggggagcagttcgattttttctacgttacccatgtcgcgcgtgaattcacctaagcggtgggcagaatcatcatcgtccgaccagccgggcaccaccacatagcggatccagaccttaatgtttttcttcgacagatactgagcaaattccagcgtacggtgattggagacgcccaccagattctggtggatctcatcgttcatctgtttcagatcgagcatcaccaggtcggtgacttccagcagttcatcaatgaccggatcgtaacgacgcacaaagccattggtatcgaggcaggtatgaataccttccttgtgacaggcgcggaaccagtcacgtacaaattcagcctggagaatggcctcgccgccggatgcggtcacgccgccgcctgacgcgttcataaagtggcggtaggtcaccacttctttcatcagctcctcgacggtaatttctttaccgccgtgcgtgtcccaggtgtcacggttatggcagtacaggcagcgcatcaggcagccctgaaagaaggtgataaagcgaatgcccgggccatctacggtgccacaggattcaaaggagtgaatgcgaccgatcactgacattgcgatgtatctccaggtgtagcccgtcccgggcttgtattgcacagctcaaaccggctgtgttaagtctgttttggcaatggcctgaaaagacacttggcaaagcaggcttgatgaagagggggaactgttaaaaaggccccacataagtggagcctttattgtacgctttttcagccggacatgaaattacatggtctgggtgaaggtacgggtaataacgtcctgctgctgttctttcgtcagggagttaaaacgtaccgcgtagccggatacacggatggtcagctgcggatatttttccgggttttccatcgcgtcgagcagcatttcacggttcatgacgttgacgttcaggtgctgaccgccttcgatggtagactcatgatggaagtaaccatccatcaggcctgccaggttggttttacgcacttcgtcatctttacccagcgcattcggtacgatagagaaggtgtaagagataccatctttagcgtaagcgaacggcagttttgcaacggaagtcagagaggcaacggcgcctttctggtcacggccgtgcatcgggttagcacctggtccaaacggcgcgccagcacgacgaccatccggggtgttacccgttttcttaccatacacaacgttagaggtgatggtcagaacagactgcgtcgggatagcgttacggtaggtagtcagtttctgaattttcttcatgaaacgttcaaccaggtcaaccgccaggtcatctacgcgagcatcgttgttaccaaactgcgggtattcaccttcgattttgaagtcgatagccagaccgtcttcgtcacgcaccggggtgactttcgcatatttgattgcagacagggagtcagccgcaacggacagacctgcgataccacacgccatggtgcggataacgtcacggtcgtgcagcgccatcagagaggcttcgtagctgtacttgtcgtgcatgtaatggatgatgttcagtgcggtaacgtactgtttagccagccagtccatgaagtgatccatgcgatccagcacttcatcgaagttcaggacatcgcctttgataggttcagacttcggacccacctggattttcattttttcatcaacgccgccgttgatagcgtacagcatggttttcgcgaggttagcgcgagcgccgaagaactgcatttgcttaccaacaaccatcgggcttacgcagcaagcgatcgcgtagtcgtcgttgttgaagtcaggacgcatcaggtcatcattttcatactgcagggaggaagtatcgatagacactttcgctgcgtattttttgaaggccatcggcagtttttctgaccacagcacggtgatgtttggttccggagacggacccatggtgtacagggtgttcaggaaacggaagctgtttttggtaaccagagtacggccatcaacgcccataccaccgatagattcagttgcccaaatcgggtcgccggagaacagttcatcatactcaggggtacgcaggaagcgaaccatacgcagtttcatgaccaggtggtcaatcagttcctgagcttcttgttcggtgattttgcccgctttcaggtcgcgctcaaagtacacgtcgaggaaggtggaaacacgaccgaaggacattgctgcgccgttctgggatttcacagcggccaggtagccgaagtaagtccactgtaccgcttcttgcgcattttttgccggagcagaaatatcgcagccgtatttagcagccatctctttgatctggcccagagcacggtgctgttcggcgatttcttcgcgcagacggatagtcgcttccagatcaacgccgttttccagtttgtcctgcagggacaggaactgggcgtatttgtctttcatcaggaagtcgatgccgtacagcgcaacgcgacgatagtcaccgatgatacggccacggccataggcgtccggcagaccggtcagcacaccggatttacggcagttcaggatgtctttggtgtaaacatcgaacacgccctggttatgggttttacggtattcggtgaagatttttttcagcatcgggtccagctcgcggttatacgctttgcaggaaccttcaaccattttaatgccgccgaacgggatgatcgcacgtttcagaggcgcttcagtttgcagaccaacgattttctcaaggtttttgttgatgtagccagcatcatgagaagtaatggtggaggcaattgaggtgtcgaaatcaacaggtgcgtgagtgcggttttccagcttcacgccttccatcactttgtcccaaagcgaggtggtagcttcagtggcgccggccaggaaggattcgtcaccctcgtaaggcgtgtagtttttctggataaagtcgcgtacgttgacttcgttctgccagtcacctttcgcaaaaccttcccaggctgtggctaacttttcattaagctcggacatatgatacctaccttcttaagtggattttttatttactgcctgaggcaaccattaatgatggtcgtcgccacgcaggtaaatgacccagtatgtcaacccaacaagtaaacccccgccgataatgttcccgatggttaccgggatcaggttatctgttatgaagttcatcactgtcagatgagaaaaactttctggagtcgaaccgatcgcggtccagaactccggcgctgcaaaatgacgaattacgatacccagtgggatcaagaacatgtttgcaatactgtgttcgaagccgctggcgacaaacataccgacgggcagaaccatgatgagggctttatccatcaggctgcggccggagtaactcatccataccgccagacagaccatcaggtttgccaggatcccgagagccacggcttcgacaaaagtgtgatgcattttatgatcggcggtttgcaggaggttgagtccccagccaccgttagcgaccatatattcaccagataaccacatcaacagtacgaataatagcgcaccaatcaggttgccgacataaacgttaacccagttccgggcgagctggccccaagtgatgcgtccgctggctttcgcgacgacaatcagtaccgttgaagtaaacaggtcggcgccgcagataacgcacaggatcagccccagagaaaaacatatgccgccaatcagtttggcgataccgaacggcatagtcgcggtgccggtcgtggcagtgatgtagaacacgaaagcgatggagatgaatacgcccgcggtgatcgccagataaaaggtggtcagcggatgtttcgttgctttatagacaccggcttcctcggcaactttcgccatagcagctggtagcaatagatcaaaagggttgtcagctttcacactaactctctctttattaagtcggcgacgagatactaacaaagcattatagaagagaaattgatgtggatcatatctcgcctggcttataggcccgtaaagcgcatggttttccggcaaatacggagtaacgtgttgattatccaaataaaaataaattttaaagtttattaaaagtgttgaaaaaaattatatgctctcccggctgacagttaattaatatggagtaatgacttaaaaaagtaacaattctgcctgggtgtcgataataatattcacccataattaacttaattattacatttgcggttcattacaaaataataaaaaaaggggcgatttaatcgccccgtaatatagcctgaacctgcgcttacgcctacaggttgtaatgttatttctgcttattttgtccagtaggccgctttcgcgcgctgcaacttctcatatgcctgtaacagagactgatgcgccgggaaggcggtcaatgtgccgtcggcggcctgcaggccatagaagggcgcttcaccgctcagcgccgcgctggccgcttccacggcctctgcgccgtacatacgcacaaaagcgtgcagatattgcagcggctcgcgatcctcttcctgcgtcagcagcaacagcgtttgcaggcagcggtaatagttggcgcgttccggcgtaaagatcgaggcgttgaattccatcgtccattccgtccagatgagcgcctgctcggtgtcgccacccgccagcgccagcatcgctttcagttcgccgatgcgcagcgtgtaccagccattatctttacccgtggcgatacccagcagttcacgcacgcgggtgaaatcgtcatggccttcttcatccagctgcgcgatcagattgagataatcttctttttcccacgcgctgcccggcagcgccagcagagtctcacgcaggtgcgcgcccatgctgttattcgccagccacagatcttccgccggataaatatcagacattcccggcacgatgatgcggcaggcgtacacgctcaggtgctcgtagtcggcgatatagacttctttatcttccgccttaaagatggccatcagggtggcaaactcttcttcggtggtgccggcaaagctccagtccacgaacggataatccgcatcctgtttgaacatgtcccaggagatcagaccgctggaatcgataaagtgcgtttcgagattcgcatgttcagccacttcttcatcatcaaaggttggcggcgtaaagacgtcgagatctttcagtccgcgtccctgcaacagctcggtcacagtacgctcaagggccacgccaaagtccgggtgcgcgccgaaagaggcgaagcaggtgccgttagccgggttaaacagcacgacgcagatcaccggatatttaccgcccagcgaggcgtcatacgcgaaaatcgggaaaccttcggcttccagcgtttcaatagatgccaccacgcccggatagcgcgccagaacgtcagccgggattaccggcaggctgatgctttcggcgatgatgcggtttttgatatggcgctcaaacacctcagacagaccctgaacgcgggcttcgttggcggtattaccggcagacataccgttagaaacgtacaggttgccaacgatgttcatgggaatataaaccgtctgctgatcggactgacgggtgaaaggcaggccgcagatcccacgctcttcattgccggactgcaaatcaatcagcatgctggcggtcagttcgttttccggatcgtagaacgcgcgcagacgctcatcaagaatgcctttcggcagttcgtcgtcttccggcagcgggaaccatttttcgttagggtaatgaacgaacgggccattggcgatggcatcgcccagccagaaatcggcaaagaaatagttggtggagaggcgttcgaaatattcgcccagcgcggaagccagcgccgcctttttggtcgcgcctttgccgttggtaaagcacagtgagcaggctttatcccggatgtgcacagaccagacgttcggaaccggattcagccaggaggcttcttctatatcgaagccgagatcgagcagtttttgctggaagcgggcgatggaatcttccagagcggcatctttgccggggataaatgtttgcgtcattgtcttcactttattcgtacggaaagcgcgcaatgatacgggttttgcgtgacaggcgctatcgaagtaagccgggcggcaaaaataaaacttcccactatgcttatactcactaacatactgttcaggatgaataaaatgaaagcgtttgatctgcaacgtatgatgctggataaagtgccgctggagtttttgggcgaagtcgcgctgcgtagtctttatacttttgtgctggtttttatatttcttaagctggcaggtcgccgtggcgtacggcagatgtcgctgtttgaagtgctgataattctgacattgggatcggctgcgggggatgtggcgttttacgacgatgtccctatgctgcccgtattcatcgtatttcttaccctggcggtgctttaccggctggtgatgtggttgatggctcacagtgaaaaactggaagatctttttgaaggtaaggcggtgatcgtcatcgaagaaggcgagctggcgtgggaaaaactgcaaaaagaaaacctcaccgaatttgaattttttatggagctgcgggttaacggcgtcgaacagctggggcaggtcaaactggcgatcatggaaaccaatggccagatcagcctctattattatcctgataatgaagtccgtccgggtctgagtatattgccgccggaatggagcccgcgtttcacgactattcctgaagaagatgattacgcctgcataaggtgcagtgaggtcataagaatgaaggcgggtcagcggatgctctgcccgcgctgcgcccatcccgaatggtcaaaagcgagccgcgcgctacgcattacctgacagcgtttttctccataagaaatcagcaagtccggacattgtgctatgtgataacgcccacaattccgggctgtgcgccattacccgttgcgacacccgtcactgaatggtaaaaccgatgtcacaggaataacttattgctatcagcatggtgaggggaaatggctcaggtgtttaatttcagttcaggtccggcggttttaccggcagaggtgcttaaacaggcgcaacaggagttgtgcgactggaacggtcttggcacatcggtaatggaaatcagccaccgtggaaaagaatttattcaggtggcagaagaagcagaacaggattttcgcgatctgctggacatcccctcaaactataaagttttattctgtcacggcggcggtcgcggtcagttcgccggtatcccgctgaatatcctcggcgataaaaccactgccgattatgttgatgccggttactgggcggcaagcgcggtaaaagaggcgaaaaaatactgcaccccaaacgtcattgacgctaaaactaccgttgacggtctgcgtgctgtgaagccgatgcgtgaatggcagctcagtgataacgccgcctatatgcattattgcccgaacgaaaccatcgacggtatcgccattcatgagactccggatttcgggcgcgacgtcgtggtaacggcggatttatcctcgaccattctgtcctcgccgctggatgtcagccgcttcggcgtaatttacgccggcgcgcagaaaaatatcggcccggccggactgacgctggtgatcgtacgtgaagatctgctcggcaaagcgcatcccgcctgtccctcgatcctcgattacaccgtgttaaacgataacgactccatgtttaacactccgccgacctttgcctggtatctgtcagggctggtgttcaaatggttgaaaaagaatggcggcgtcacggccatggaccacatcaatcagcaaaaagccagcctgctgtacggcgtcatcgataacagcgacttctaccgcaacgatgtggccgtcgctaaccgctcgcgcatgaacgtgcctttccagctggccgacagccagcttgataagctgttccttgaagagtccttcgccgccggtttacatgcgctgaaaggccaccgcgtcgtgggcggtatgcgcgcctcaatttataacgccatgccgctggaaggtgttcaggcgctgaccgacttcatgacggatttcgaacgccgccacggttaatcccgcatcccatcgctacccccgcagcctgactgcggggtttttattccgtttttttgagagttaagcttcatggaatccctgacgttacaacccatcgcgcgtgttaatggcaccatcaatctgccaggttcaaaaagcgtttccaaccgcgcgttgctgctggccgcgctggcgcacggcaccactgttctgaccaacctgctggacagtgatgacgttcgccatatgctcaatgccctgagcgcgttgggggtgcagtacaggctgtccgacgatcgtacccgctgtgaagtgacaggcgcgggcggcccgttagtttccgctgaaaagctggagttatttttaggtaacgccggtacggcgatgcgtccgctggcggcggcgctttgtctgggaaacaacgatctggtgctgaccggcgagccgcgtatgaaagagcgtcctatcgggcatctggtggacgccctgcgtcagggcggcgcgcagatcgactatctggagcaggaaaattacccgccgctgcgtttacgcggtggtttcgctggcggcgagattgaggttgacggcagcgtctccagtcagtttttaaccgcactgctgatgaccgcgccgctggcggcgcaggatacctttattaccattaaaggcgatctggtatctaagccgtacatcgacatcaccctgcatctgatgaaaaccttcggtgtgacggtggataaccagaattatcagcgctttgtggtacgcggcgcgcagcactaccagtcgccaggacattatctggtagaaggcgatgcctcttctgcctcttatttccttgcggcgggtgccatcaaaggcgggacggtaaaagtcaccggcattggccgcaacagcgtgcagggcgatatccgttttgcggacgtgctggaaaaaatgggcgcgaccgtggaatggggcgatgattacattgcctgcacccgtggtgagctgaatgcagtggatatggatatgaatcatatcccggatgcggcaatgaccatcgccacggcagcgctgtttgcccgcggcaccacgacgctgcgcaacatctacaactggcgcgtaaaagagaccgaccgtctgtttgcgatggcgaccgaactgcgcaaggtaggcgcagaggtggaggagggcgaagattatatccgcatcacccctccggcctcgttaaccctggccgagatcggcacctataacgatcaccgcatggcgatgtgcttctcgctggtggcgctgtccgatacgccggttaccattctcgatccgaaatgtacggcgaaaaccttcccggattatttcgaacagttagcgcgcatcagcacgctggcgtaaagggcgacaatccagacgcgctggataaaaagtaacaaattgtctctttccgggctgacttcctgtcagccctctatacttgcgccattcttctccccaccgttattacgcttttggttattttcacgcgacagtaacggtcattcgcgttgcagcgtataatgcgcggcgttcacgttaacggtatgcctttattaaggagaaaaagatgacggcaattgccccggtaatcaccattgatgggccaagcggcgcaggtaaaggtacgctgtgcaaagcgatggcggaaacattgcaatggcatctgctggattcaggcgcaatttatcgcgtgctggcattggcggcattacatcaccacgttgatgtgacctcggaagatgtcctggttccgctggcagcccacctggatgtccgctttgtctctaccaatggcaatctggaagtgatcctcgaaggggaagacgtgagcggcgagatccgcacccaggaagtggccagcgccgcctcgcaaatcgcggcgttcccacgtgtacgtgaagccttgcttcgtcgtcagcgcgccttccgcgatgccccggggcttatcgccgatggccgcgacatgggcacggtggttttccccgacgcgccggtgaagattttcctcgacgcctcctcggaagaacgtgcgcatcgccgcatgctacagttgcaggagaatggctttagtgttaactttgaacgccttttggccgagataaaggaacgcgacgatcgcgaccgtaaccggccagtggcgccgctagtgccggctgctgatgcattagttctggattctaccagtttaagcattgagcaagtgattgaaaaagcgctacaatacgcccgcgaaaagctggcgctcgcttaattagcgaccaaattccgaagtacctgctgcaatggagtgtgagcaggcatgtgaaacaaccccatccggcatgaagccagatggacgttaaattgaagaatcctgaagattatcaatatgacagaatcttttgctcaactatttgaagaatccttaaaaacaatcgaaacccgtccgggttccatcgttcgtggtgttgttgttgctatcgataaagatatcgtactggttgatgccggtctgaaatctgagtccgccatcccggctgagcagttcaagaacgcccagggcgaactggaaattcaggttggtgacgaagttgacgttgcgctggacgcagtcgaagacggcttcggtgaaactctgctgtcccgtgagaaagctaaacgtcatgaagcttggatcacgctggaaaaagcatacgaagacgctgaaactgttgttggtgttatcaacggcaaagttaaaggtggcttcactgttgagctgaacggtattcgtgcgttcctgccgggttccctggtagacgtgcgtccggttcgcgatactctgcacctcgaaggcaaagagctcgagttcaaagttatcaagcttgatcagaaacgcaacaacgtggttgtttcccgtcgtgcggttatcgagtctgagaacagcgctgagcgcgatcagctgcttgaaaacctgcaagaaggcatggaagttaaaggtatcgttaagaacctcactgactacggtgcattcgttgatctgggtggcgttgacggcctgctgcacatcacagacatggcatggaaacgcgttaagcatccgagcgaaatcgtaaacgttggcgacgaaatcactgttaaagtgctgaagttcgaccgcgagcgtactcgtgtatctctgggcctgaaacagctgggcgaagatccgtgggtagctatcgctaagcgttatccggaaggtaccaaactgactggtcgcgtgaccaacctgaccgactacggctgcttcgttgaaatcgaagaaggcgttgaaggcctggttcacgtttccgaaatggattggaccaacaaaaacatccacccgtccaaagttgttaacgttggcgatgtagtggaagttatggttctggatatcgacgaagaacgtcgtcgtatctccctgggtctgaagcagtgcaaatctaacccatggcagctgtttgctgagacgcacaacaaaggcgaccgtgttgaaggtaaaatcaagtctatcactgacttcggtatcttcatcggcctggacggcggcatcgacggcctggttcacctgtctgacatctcctggaacgttacaggcgaagaagcagttcgtgaatacaaaaaaggcgacgaaatcgcagccgttgttctgcaggttgacgcagagcgtgagcgtatctccctgggcgttaaacagctcgcagaagatccgttcaacaactacgttgctctgaacaagaaaggcgcaatcgtaaacggtaaagtgactgcagttgacgctaaaggcgcaaccgtagaactggctgacggcgttgaaggttacctgcgcgcttctgaagcgtcccgtgaccgcgttgaagatgcaactctggttctgaacgtaggcgacgacgttgaagctaaattcaccggtgttgaccgtaaaaaccgcgtagttagcctgtctgttcgtgcgaaagacgaagctgacgagaaagatgcaatcgctactgttaacaacaaacaggaagaaagcaacttctccaacgcgatggctgaagcgttcaaagcagctaaaggcgagtaatcagatactctctatcttttgtgctaacgcatgaaggatgacgagtagcttgacagattgcaggattcgtcctgtaatcaataacaaagggcggctacggccgcccttgtttaataagctgttagctaattttccttactaaggaaaccggaggaatcatgaccaagtcagaattgatcgaaagacttgccacccagcaatcgcatatcccggcaaaggctgttgaagatgcggtgaaagagatgctggagcatatggcctcgactcttgcacagggcgagcgcattgagatccgcggtttcggcagtttctctctgcactatcgtgcaccccgcaccggacgtaaccccaagacaggcgacaaagtggatctggaaggcaaatatgtcccacactttaagccgggtaaagaattacgtgaccgcgccaacatttatgaaaattaagttttactgctgataagcgaaaacttaatgacctgaaaaaagcacccaatgaggtgcttttttcatggctggtacatctctccgcaacccgcgccgcatttttaaagcgccgttgctgcaaaccgataaaatcttcccggccttcgccgtaaatccgcaaacgcctgcccgacatctcacgctggtttatgcacactacctgcaacaaggaggtggggatgcatttgccaggaattgccctgtgtctgctgaccgcgataacgccactgctgtggttgccaaaactgccggatcttaacagcatcttcattatgatctttatcggttgtttggcaggcgtttgccgcgatcgccgctcaggttatatcgggctatggctgctgtttatggcgtgggggatgcttgccgctaaagaagccctctggccgacagagcacctgcccggacgcgtccggcaggcggaagtgcgtcttaccggtaccgataacgtcactacgcaccgcggcgtgatagaaaggctgaacgggaaagctctgtatcctgcgccggggatcatgctttatggcgaatacctgccgcagcctgcctgtgccggacaattatggaagatgaccctcagggtgcgcccggttcacggtcagcttaacgacgggggatttgatactcagcgctacgccctggccacacacaagcccgtgaccggccgcttcacccgggcgaacgtgcttgatgcccgctgtagcctgcgggcgcagtatctggcttcccttgacgcaacgcttgaaaaagcacgctggcgagcggtgctgctggcattaggaatgggggagcgaagagcactggatgccccggtgaaagcgattatgcgtcagaccggcactgcacatctgatggccatatccggactgcatattgctcttgcggccacgctcggctggctgttagctcgcggaatacagttcttactgccgggccgctggatcgactggcgcgcgcccttattaacaggactgctatgcgcgacaggttatgcctggctgaccgggctgcaaccgcccgccctgcgcacagtcgtgtcgcttgcggtgctggcggcgctgcggctttcaggacggcaatggtcggcgtggcacgtctggctctgctgtctcgcggcgatcctgtttatcgatccgcttgcggtattgtcagaaagcctgtggctgtcggcgttcgcggtagcggcgttaatcttctggtatcagtggctaccgctgcccgcgtttcgcggcggacgattactgcgcagcatgataagcctgatccacctgcaaactggcatgatgctattactgctgccgttacaggtggcgctgtttcacggcatcagcctgacatccctggtggctaatttgctggcggtgccgcttgtcaccttcgtatgtgtgccgctgatcctggcagggatgttgctgcatctgacggcatttaacggactggaagcctggatctggacgcgagccgatgacacgctgacggcgctgttcggctttctgaatgctttacccgatggctggtacagcatcgacaggcgctggcaatggctggcatttgcgccctggctgatgatagttatctggcgtctgcgtatctggaaaacgtcgccctttgtctgtgccgcagcggtgctgctgatggcgcagccgttatggaaaagcacgcccaaagaccgctggtctgtctatatgctggatgtcgggcaggggctggcgatggtggttgcccggcagggcaaggccattctctatgataccgggctggcatggccgggcggcgacagtgcacagcaattgattgtaccctggctgcgctggcatcacctgcagccggaaggcatcatcctcagtcatgaccatctcgatcaccggggcgggctggaaaccctgcgtcagacgtggccagcggcctggatccgcagtccgctggacgaggccgggcatttgccgtgctttcgcggccagcgctggcagtggcaggggctgacgttcagcgttcactggccgttgccgggtactgcccttcagggaaacaaccgctcctgcgtggtaaaagtggacgacggtaaaaacagcattttgcttaccggcgacattgaagcttccgcagagcaatctatgcttagccattactggcagcatttacgggcaactgtcgttcaggtgccgcatcatggcagcagcacatcgtcgtcgctgcccttgctgcaacgggcaggaggccaggcggcactggcctcagcgtcacgctttaacgcctggcgattgccatcagaaaagattgttcgccgttatcagcagcagggatataagtggttcgataccccgcaccaggggcaaatcagcctccatttttccgcagaaggatgggaaatcttaggcttacgggatcaacttttcccgcgttggtatcatcagtggtttggcgtcccaggatataacaggtagaatatgcggctatttcaacaagtgctggttttttgaatgcataacgacaaagatctctccacgtggcaaacattccgccgtctctggccaatgattgcacctttcaaaacgggtctgctcgtggcgggtgtagcgttaatcctcaacgcagccagcgataccttcatgctatcgctcctcaaacctttactggacgaaggctttggtaaaacagaccgatcggtgctgctgtggatgccgctggtggtcattggactgatgatcctgcgcggactcaccagttatgtgtcgagttactgtatctcctgggtgtcgggcaaagtggtgatgaccatgcgtcgtcgcctgtttggtcatatgatggggatgccggttgctttcttcgacaagcaatctaccgggacgctgctgtcccgtatcacttacgactccgagcaggtggcttcctcctcttccggtgcgctgatcaccgtcgtacgcgaaggggcctcgattatcgggctgtttgtactgatgttttactacagctggcagctctccctcattcttattgtcctggcgcccattgtgtccatcgctattcgcgtagtgtcgaagcgttttcgcagcatcagtaagaatatgcagaacaccatggggcaggtgaccaccagcgccgagcagatgctgaaaggccacaaagaagtgctgattttcggtggtcagggcgtcgaagccaaacgcttcgataaggtcagcaataagatgcgtttgcagggcatgaaaatggtctccgcatcgtcgatttccgatcctattattcagctgatcgcctcgctggcgctggcatttgtactctatgccgccagcttcccgagcgtaatggaaaccctcacggccggtaccatcaccgtggtgttctcctccatgatcgccctgatgcgtccgctgaaatcgctcaccaacgtcaacgcccagttccagcgcggtatggcggcctgtcagacgctgttctccattctcgacagcgagcaggaaaaagacgaaggcacccgccagcttgagcgcgcgaaaggcgacatcgaattccgtaacgtcacctttacctatccgggccgtgatacgcctgcgctgcgtaatatcaacctgaccattccggcgggtaaaaccgtggcgctggtcgggcgctccgggtcgggtaaatcgaccatggcaagcctgctgacccgtttttacgacatcgacgaaggggaaattctgctcgacggacacgatctgcgcgaatacaccctggcgtcgctgcgtaatcaggtggcgctggtttcgcagaatgtccatctcttcaatgataccgtggctaacaacattgcctatgcccgcactgaagagtacagccgcgagcaggtagagaatgccgcccgcatggcctatgcgctggactttatcaataagatggataacggtctcgataccatcattggtgaaaacggcgtcctgctttccggcggtcagcgtcagcgtatcgccattgcccgcgcgctgctgcgtgacagcccgatcctcatccttgatgaagccacctcggcgctggacaccgaatcagaacgcgccattcaggcggcgctggatgaactgcaaaagaatcggacttccatggtcatcgcccatcgcctgtcgaccatcgaacaggccgatgaaattgtggtggtggaagacggacgtatcgtcgaacgcggtagccacgccgatttgattgcccgtcagggcgtgtacgctcagctgcataagatgcagttcggcgaatgatagcccgcatctggtcaggggagtcgccgctgtggcgactgctgctgccgctctcctggctgtatggtctggtgagcggcgcgatccgcctgagctaccgtatcggactgaataaatcctggcgcgcgcccgtgccggtggtggtggtggggaatctcaccgcgggcggcaacggcaaaacgccggtggtgatctggctggtggagcaactgcaacagcgtggcgtgcgcgtgggcatcgtctcgcgcggttacggcggcaaggctgcccgttacccgctgctgctcaatccgcaaacgtctaccgatgaagccggtgatgagccggtgttgattttccagcgcaccggcgcgcctgtggcggtgtcgcccgtgcgatccgacgcggtgcaggcgatccttgcccgctacccggtgcaaatcatcgtcactgacgacggtttgcagcactaccgtctcgccagagataaagaaattgtggtgatcgacggcgtacgtcgcttcggcaatggctggtggctgcccgcaggcccgatgcgcgagcgggcttccagactgcaaagcgtggatgcggtgatcgtcaacggcggcgaagcgcggcagggtgagatcccgatgcgtctgcaccctggtctggcgattaatctgaaaagcggcgagcgtcgggacgtgcgcgaactggcgcatgtcgttgcgatggcgggcattggtcatccgccgcgcttctttgccaccctggccgactgcggcgtgcagcctgaaaaagctattgcgcttgccgatcaccaggcgctggatcatgctcaggtcagcgcctttaccggatccggtcagacgctggtcatgaccgaaaaagacgcggtgaagtgccgtgcgtttgctgaagatcactggtggtatctgccggtggatgcacagcttacgggagacaaacccgaacaacttctccgggaactgcttacgctggcgcagcagggtaaccatccggcctgaggcgctgcttatcacagggatccctatgtcagttgcgcatctttctctatccgccgcccgctgtctgcatctcgccgcacaggggctactaaaaaaaccgcgtcgccgtgcccgtcccgccgatattctcgccgcgatccgccgcatgtccctgctgcaaatcgacaccattaatatcgtggcgcgcagcccttatctggtgctgttcagccgtctcggcgcttatccgcagcactggcttgatgacgccttacgcgccggtgacctcatggaatactgggcccatgaagcctgtttcctgccgcgcagcgattttgcgctggtgcgccatcgcatgctgaacccgcaaaatatgggctggaaataccgtgccgcctggatggaggagcatgcgccagagatcgaacagcttttgctgcaaatccatgaaaacggcccggtacgctcggcggactttgcccatccgcgcaccggtaccagcggctggtgggactggaaaccgcataaaaagcatctggaggggctgtacactgccggcaaggtgatggtggttgaacggcgaaacttccagcgcgtttacgatctcaccagccgcgtgatgccggagtgggacgacgaacgcgatctgctcagccagacgcaggccgaagccattatgctggaaaacagcgcccgcagccttgggctgtttcgtcctcaatggctggcggattactaccgtctgcgtcagcctgcgctgccagccttactcgcgcgctggcaggaagaacaaaaaattattccggtcaccgttgaggagcttggcccggcatgggtgcacgcctcgctgacggaagagctggcgctggccgcagcgggcaaactgaccgccacccacagcgccgtgctgtcgccctttgatcctttggtctgggatcgcaagcgtgccgaacagctgtttaacttcagctaccgtctggaatgctacacccctgcgcccaaacggcagtacggctattttgttctgccgctgctgcacgccggtcagctggtcgggcgtatggatgccaaaatgcaccgcaaaacgggcgtgctggaaatcattgcgctctacccggaggcgggcatcacgcctggccgcacgctggaaaagggacttcttcaggccattaccgaatttgccgcctggcagggagcgacccgcgtgagcataacgcgctgtccgccggaattattccctgcctgtcccacaggctgggaaattgacccggcctgaaaaatgtatatggtaaacttttgcgaaaccttatccgttccatctggaggaaccatggatcaccgtctgcttgaaatcatcgcctgcccggtttgcaccggcaaactctattacagccaggagaaacaggagctggtctgcaaaatcgacaatctggcgttcccggtgcgtgaaggcattccggtgctgctggaaaacgaagcccgcgccctcactgctgaagagaaccgtccatgagtttcgtcgtcataattccggcgcgctatgcctcaacccgtctgccgggcaaaccgctggtggacatcaacggcaagccgatggtggtgcacgtgctggagcgtgcccgcgaatctggcgcggaacgcattattgtcgccacggatcatgaagaggtggcccgtgcggtggaagcggtgggtggcgaagtgtgcatgacccgcgtcgatcatcagtccggcaccgaacgtctggcggaagtggtggaaaaatgcggtcttagcgacgacaccatcatcgtcaatattcagggcgatgagccgatgatccccccggcgattgtgcgtcaggtggcggaaaatctggcgcagcgcgacgtgggtatggcgaccctggcggtgccgatccacagcgcagaagaagccttcaatccgaacgcggtaaaagtggtgaccgatgcgcagggctatgcgctctatttctcccgcgccaccattccctgggatcgcgatcgttttgcgcaaagccgtgacgccatcggccatactttcctgcgccatatcgggatttatggctatcgcgctggctttatccgccgctatgtcacctggcagccaagccagcttgagcagatcgaaatgctggagcaactgcgtgtgctctggtacggcgagaaaattcacgtggccgtcgcgcagacggtgccgggtaccggtgtggacacgccggaagatctggagcgtgttcgcgtcgaaatggcccgcagctaatccctccgtactttgtccagagataagctaaaacgcggtacagccttatctttggactatctcctgctcttttgatctcatgcgggtgacaagatcgtgacagacgctcattatgaaaacagtagttttcataggggtaaacggatatggaacgattgcgcgctgaattgagtcatctactgggcgaaaggctaagccgcctggaatgcgtaagcgaaaaagcggataccgcactgtggtcactgtacgacagcaacggtaatccgctgccattactggcaagaagctttaccacgcccggggttgcccgccagttggcgtggaaaatgtcgatgctggcgcgcagcggcacggtacgtttaccggtggtgtacggtgtcatgacccatgaagagcaccccggccccgacgtcttactgattgagcggctgcgcggggtatcggtggaagccccggcccgttcgccggagcgctggcaacagctcaaagatcagattgtcgaaggcctgctgagctggcacagacacgacagccacggctgcgtgggcgtggtggacagcacccaggaaaacatctggccgtcctggtatcgccagcgcgtcgaagtgctgtggaccaccctcggtcagttcaaaaataccggcctttccatgcagaacaaacgcattttgtttcgcacccgtgaatgtctgcccgcgctctttgacggctttaatgacaactgtgttctggtgcacggcaatttcacgctgcgcagtatgctgaaagatgcgcgcagcgatcagttgctcgcggcggttacgcccggcccgatgctctgggcgcccagggagtatgaactcttccggctgtgcgaaagcgactacgccgaaagcctgctgtggcattacctccagcgcgcgcccgttgcggagtcctttatctggcggcgctggttgtatacgctgtgggatgaagtggcccggctggtcaataccgggcagtttaaccgcagccgctttgagctggcctccaaatcactccttccctggctcgccggaagtgccttttaaccactgccagatgcgtcccagggtttcatagcccacccggtcgctgtgcatcagccagaccggggagggaataatacgttcccaggtgttaagcggcgaggcgatcgccaactgattcgccggtgcaggcagcggatgtaacccggcctgctggaaaaatatcatcgcccgcggcagatgggacgccgacgtcaccagcaggaaaggcgcatcgccaatcgccgcttttaccgccgccgcttcttcttccgtatctttcggcgtccccagcgtaataatgtcgctgcgcggaatgccgagggtttccgccacccgcgcgcccgcttcagcggtggtcaccggattgcctggcgccgccgcgccggtgaagatcatcttcgcgcccgggttcatgcgccacaaacgcaccgcctcattaagacgcggcagactgttattgattaaattcgagctgggcgcccactcagggttccaggtataaccgccccccagcaccacgatataactcacctgctgcgtaccgcgccaggtagggtatttatcttcgatcggttttaacaggccatcggcgacgggttgcaggctcagcagtaacagcaccagccagctgacgctgacgagggttttgcccgtgcgctggtaacgggaaaaccacagcagagcgatcccgagcgccatcagcaaaagcagcagcggcagggggagaataaaaccgcctatatattttttgagcgtaaaaaacaccgcatccgtctcctttttaaccatacagcaggtgaattccggcgatattacaccagataggttccttctgggcgcggctgtgacaaaatagcggttttgccaggatcgcacagccatgaaggatcgcaatttcgacgacatcgcggaaaagttctcccgcaacatctatggcacgaccaagggccagttgcgtcaggcgatcttatggcaggatcttgacggtctgctggcgacctttggcacgcagccgctgcgcattctcgatgctggcggcggtgaaggacaaacggcaattaaaatggcgcagcgcggtcatcacgtgacgctgtgcgatgtgtcggctgagatgatcgtccgcgcaaaagcggccgccgacgcgcagggtgtgagcggcaacatgcattttgtacaatgcgcggtgcaggacatcagccagcatttggaaagcccgcttgatctgatattgtttcacgctgtgctggaatgggtggcggaaccggtcgccgcgctccagaccttatggtcggtattgcgcgaaggcggggcgttgtccctgatgttctttaacgtccatggcctgctgatgcacaacatggtggtcgggaattttgattacgtacagctcgggatgccgaagaagaaaaagcgcacgttgtcgcccgattatccgcgcgatcccgccgaggtgtatcgctggctggaacagattggctggcagatcaccggcaaaacgggcgtgcgggtgttccatgattatctgcgtgtaaaacagatgcaacgcgactgttttccagcgctagtcgaattagaaacacgctattgccgtcaggagccttatatcaatcttggccgctatatacacgtgaccgcgctaaagccgcaggtgcaaggataaacgatgagtgaattttctcagacagtccccgaactggtcgcctgggcgaggaaaaatgatttttccatttcgctgccggtggacaggctttcatttctgctggccgtcgccacgctgaatggcgaacgcctcgacggagagatgagcgaaggggaactggtagacgcgttccgccacgtcagtgatgcgtttgagcaaaccagcgaaaccatcaatgtgcgcgcgaacaacgccatcaacgacatggtgcgtcaacgtctgctgaaccgctttaccagcgaacaggccgaaggcaatgccatttaccgcctgacgccgctgggcatgggcattaccgattactatattcgccagcgcgaattctcgacgctgcgcctttccatgcagctgtccatcgtggcggcagagctgaaacgggccgccgatgccgccgatgcaggcggggacgagttccactggcaccgtaacgttttcgcgccgctgaaatactcggtggcggagattttcgacagcatcgatctgacccagcgcgtgatggacgagcagcagcagctggtgaaagacgacatcgcccagctgctgaacaaagactggcgcgcggccatttccagctgtgaacttctgttgtcagaaacctcaggtacactgcgcgaactgcaggatacgctggaggcggcgggggataagctgcaggccaatctattgcagatccaggatgccaccgtcggacgcaacgatctggagtttgttgaccgtctggtcttcgatctgcaaagcaagcttgaccgcatcataagctggggccagcaggctattgacctgtggatcggctatgaccgccacgtgcacaaatttatccgtaccgctatcgacatggataaaaaccgcgtcttcgcccagcgtctgcgccagtcggtacaaacctatttcgatgccccctgggcactgacctacgccagcgcagaccgactgctggatatgcgcgacgaagagatgacgctgcgcgatgaagaggtcaccggcgaactgccgccggatctggagtttgaagaatttaatgaaatccgcgagcagctcgccgcgatgatcgaagcacagctggcggtgtacaaaaccagacaagtgccgctcgatctgggcctcgtggtgcgcgagtatctgtcgcaatacccgcgcgcgcgtcacttcgacgtggcgcggattgtggttgatcaggcggtgcgcctcggcgtagcgcagggcgatttcaccggactgccacccgaatggcagccgattaacgattacggagccagggtacaggcgcatgtcattgacaaatattgaacaagtgatgccagtgaaactggcgcaggcgttggcgaatccgttgtttccggcgctggacagcgcactgcgcgccggtcgtcacatcggcctggatgagctggataatcacgcctttttgatggatttccaggagtatctggaagagttttacgctcgttataacgtggagctgatccgcgcgccggaaggtttcttctatctgcgcccgcgctccaccacgcttattccccgctcggtgctgtcagagctggacatgatggttggcaaaattctctgctacctctacctcagcccggagcgtctggcgaacgaaggcattttcagccagcaggagctttatgatgagctgctgtcgctggcggatgaaatgaagctcttaaaactggtgaacaaccgttctaccggctctgaccttgaccgccagaaactgcaggaaaaagtgcgctcctcgttaaatcgtctgcgccgtctcggcatgatctggtttatgggcaacgacaacagcaaattccgcattaacgaatcggtattccgcttcggcgcggacgtgcgcagcggcgacgatccgcgtgaagcgcagcgtcgcttaattcgtgatggcgaagccatgcagattgaaaataacctgcagctcaatgacgagcaggaagaaactctgccggacggtggggaggaagaataatgatcgaccgcggaaaatttcgctcactcacgctgattaactggaacggcttttttgcccgcacctttgatctggatgaactggtcaccacgctgtcaggcggtaacggtgccggtaagtccaccaccatggcggcgttcgtcacggcgctgatcccggatctgacgctactgcacttccgtaacaccaccgaagcgggggccaccagcggctcgcgcgataaaggtctgcacggcaaactgaaagcgggcgtctgttattcggtactcgacgtcatcaactcgcgtcaccagcgcgtggtggtgggcgtgcgcctgcaacaggtcgccggacgcgatcgcaaagtggacatcaaaccctttgctattcaggggctgcctgccgatattctgccgacgcagctgctgaccgaaacgctgaacgagcgccaggcgcgcgtgctgtcgctggccgagctgaaagacaagctcgacaccctggaaggggtgcagttcaagcagtttaactccatcaccgactatcattcgctgatgttcgatctgggcattgtcgcccgtcgtctgcgctcagcctccgaccgtagcaaattctaccgtctgatcgaggcctcgctgtatggcgggatctccagcgccattacccgttcactgcgcgactacctgctgccggaaaacggcggcgtgcgtaaagcgttccaggatatggaagccgcgctgcgtgaaaaccgcatgacgctggaagcgatccgcgtcacccagtcggacagggatctgtttaaacacctgatctcggaagccaccaactatgtggcgtcggactatatgcgccacgccaacgagcgccgcgtgcatctcgaccaggcgctggcctatcgtcgcgaactctttacctcccgccagcagctgtcggcggagcagtacaagcacgtggatatggcgcgcgaactgcaggagcacaccggtgccgagggcgatctggaagccgaatatcaggccgccagcgatcacctgaacctggtgcaaaccgcgctgcgtcagcaggaaaagatcgaacgctacgaagcggatcttgaagaactgcaaatccgcctcgaagaacagaacgaagtggtggcggaagccgccgatcagcaggaagaaaacgaagcccgcgctgaagccgccgagctggaagtggatgagctgaaaagccagctggcgaactatcagcaggcgctggacgtgcagcaaacgcgcgccattcagtacaaccaggcgttgcaggccctgcaacgcgcccgcgagctttgccatctgccggatctgaccgccgaaagcgccgacgaatggctggaaactttccaggccaaagagcaggaagccaccgaaaaactgttgtccctcgatcagaaaatgagcgtcgcgcaaaccgcgcacagccagtttgaacaggcttaccagctggtggcggcgatcaacggcccgctgtcccgtaacgaggcctggagcgtggcgcgcgaattactgcgcgacggcgtgaaccagcgccatctggcggagcaggtgcagccgctgcgcatgcgtctgaacgagctggagcagcgtctgcgcgaacagcaggacgccgagcgtttgctggcggaattctgcaaacgccacggcaaaaatatcgatgccgacggcctcgaagccctgcatcagcagctggaagcgcaaatcgcctcgctgtctgaaacggtggcgaatgccggtgaacagcgtatggcgctgcgtcaggagctggaacagcttcagtcgcgtattcaggtgctgatgaagcgcgccccaatctggctggcggcgcagaacagcctggcgcaactgtgtgagcagacgggcgaggagttcgaaagcagccaggaagtcacggaatacctgcaacagctgctggagcgcgagcgcgaagccatcgtcgagcgcgatgaagtgggcgcgcgcaaacaggcggttgacgacgaaatcgagcgcttaagtcagccgggcggctccgaagatccgcgtcttaatgcgctggcggagcgttttggcggcgttctgctgtcggaaatctatgacgatgtcagccttgaagacgctccctattattcggcgctttacggcccgtcgcgccacgcgatcgtggtgccggatctgtcactgatcaccgaacagttagaggggctggacgattgtccggaagatctctatctgatcgaaggggatccgcagtcctttgacgacagcgtgttcggcgtcgatgagctggaaaaagcggtgattgtgaaagtcgccgaccgccagtggcgttactcccggttcccgtcgctgccgctgtttggccgcgcggcgcgtgaaaaccgtatcgaaagcctgcatgccgagcgcgaaaccctctctgaacgtttcgcgaccctgtcctttgacgtgcagaaaacccagcgtctgcatcaggcgttcagccgctttatcggcggtcatatcggcgtggcgttcgaaaacgatcccgaagccgagatccgccagctgaccagtcgccgtggcgaactggaacgcgccatcagcgcgcatgaaaatgacaaccagcaaagccgcatgcagtttgagcaggcgaaagagggcgtcgccgcccttaaccgcttgctgccgcgcatcagtctgctggaagatgacacccttgccgaccgcgtggacgagatccgcgaacgtctcgacgaggccgaagaagcggcgcgctttattcagcagttcggcaatcagctggcgaagctggagccaatggtatcggtgctgcaaagcgatccggaacagtacgaacagctgaaagaagattacgcgtactcccagcaggtacagcgcgatgcgcgtcagcaggcgtttgcgctgatcgaagtggtacagcgccgcgcgcacttcagctacagcgattcagcgcagatgctcgacggcaacagcgatctcaatgagaagctgcgtaaacgtctggaacaggccgaagccgaacgtactcgcgcccgtgaagcgatgcgcagccacgccgcgcagctgagccagtacagtcaggtgcaggcatcgctgaaaagctcttacgacaccaaaaaagagctgctcaacgatctgcttaaagagttgcaggatatcggcgtgcgcgccgacagcggtgccgaggagcgcgcgcgtattcgtcgcgatgaactgcatgcccgtctgtccggcaaccgctcacgccgcaaccagctggaaaaagccctgaccctgtgtcaggcagaaatggataccctgacgcgcagcctcaaacgccttgagcgcgattatcatgagatgcgcgagcaggtcgtgatgtcgaaagcgggctggtgcgcggtaatgcgcatggtgaaagacaatggcgttgaacgccgtctgcaccgccgcgagctggcatatctcagcgccgatgagctgcgttccatgtcggataaagcgctgggcgcgctgcgtctggcggtggccgacaacgaacacctgcgtgacgtgctgcgcctgtcggaagatcccaaacgtccggagcgtaaaattcagttcttcgtggcggtgtatcagcatctgcgcgagcgtatccgtcaggatattatccgcaccgacgatccggtcgaggccatcgaacagatggaaatcgaactgagccgtctgacggaagagctgacctcccgcgagcagaagctggctatcagctcccgcagcgcggcgaatatcatccgtaaaaccattcagcgcgagcagaaccgtattcgtcagctgaaccagggcctgcaaagcgtctccttcggccaggtaaacagcgtgcggcttaatgtcaacgtgcgggaaacccacgccacgctgctggacgtcctctcggagcagcacgagcagcatcaggatctgttcaacagcaatcgcctgaccttctcggaagcgctggcgaagctgtatcagcgcctgaatccgcagatcgacatgggccagcgcacgccgcagaccatcggtgaagagctgctggactaccgcaactatctggagatggaagtggaagtgaaccgtggctccgacggctggctgcgtgcggaatccggcgcgctctccaccggggaggcgatcggtaccggtatgtccatcctggtgatggtggtacaaagctgggaagacgaagcccgccgcctgcgcggaaaagatatctcgccatgccgtctgctgttccttgatgaagcggcccgtctggatgcccgttccattgccacgctgtttgaactttgtgaacgcctggagatgcagctgatcatcgcggcgccggaaaatatcagtccggaaaaaggcaccacctacaaactggtgcgtaaggtcttcaacaaccaggagcacgtacacgtggtggggctgcgcggctttgcgccgcagttgccggagcccttacccggaacggcggatgccaacgcatcctgatttttcaaaacagagggtggcttttgccacccttttcttttctgaacgccaggttttctttaaacttctttacattaggccgggcaaatgtatttttagctttatatactcaatataagcgtgacgcgttaacctcgtcgcaacaatttataaaaacagggggcaagggatgttgctgaataaaatgaagggtcgtcggatgtccgcactgggtttgtgcctggcattcgcatttgctccgctgtttaacgccatggccgatgagccggaggcgatccccaccgacagctcggcaactaccggccaacagccaacggcgctgttacagccgctggaacagtcacgcgccacggcggtgatggcaggccttgtgacgctgccggacgacgcggtcgccagtacgcgcagcgcgcttgaggcggcattaccggcgggctataaaccggtctatatgaatcagctggcggcgctgtacgcggcgcgcgagcagaagccgatgtgggagaatcgcgaggcggtgaaagccttccagcagcagctggcggaagtggcgatcgccggtttccagccgcagtttaccgcctgggtggaattactcaccgatccgggcgtgagcggaatggcccgcgacctggtgctgtctgacgcgatgatgggctatctgcagtttattgccgccatcccggttaagggcaacagctggttgtacagcgctaaaccctatgcgctggcgaccccgccgctgtccgtcataaaccagtggcagctggcgctggataaaggcgagctgccctcattcattgcgcagcttgcgccgcaacacgaacagtatgccgccatgcacaccgcgttgctggcgctggtggcggattcccagccctggccgcaactgacctccgcgggcaagctcaacccgggtcagtggagtaatgacgtgccggcgctgcgggaaattctcagccgctccggtatgcttgatgacggtcctaagattgcgctgccgggcgacagcagcgacagcggggcggtggtcagtccgtcggcggcaaacgtggacgaaaacgcagcccagccgacgccggtaccggataagaaaaataagcgggtggctgcggtacgcagtgcctacagtaaagatctggtggaaggggtgaagcgctttcaggcttctcaggggcttggggcggacggcgtgatagggccatcaacccgcgacgcgctgaacatctcccctgcgcagcgggcgggtgtgctggcgcttaatatccagcgactgcggctgctgccggagaagctctccaccggcattatggtgaatattccggcctattcgctggtgtactatcagcagggcaaccaggtgctgtcgtcgcgggtcattgtgggccgtccggatcgtaaaacgccgatgatgagcagcgcactgaataacgtggtggttaacccgccgtggaacgtgccgccgacgctggcgcgtaatgatattctgccgaaggtgtggaacgatccggggtatctggagcgccacaattatgtcgtgctgcgcggctggaacagtaaagagaccatcgatccatggcaggtagactggggcacgatcacgccgtccaatctgccattccgtttccagcaggcgccgggcgcgcacaactcgctgggccgctataaattcaatatgcccagctcagacgccatctatctgcacgacacgccgaaccataacctgttccagaaaaacgcccgtgcgctgagctccgggtgcgtcagggtcaataaggcctcagagctggctaacatgctgttgcaggatgcgggctggaacgatacgcgcatctccgatgccctgcgccagggcgacacgcgctatgtgaatattcgtcagagcattccggtgaacctttactacctcaccgcctttgtcgacgctgatggccgtacgcagtatcgtacagatatttacaattatgatctcaccgcgcgatcaagcgcacaaatcctgccaaaagcggaacaattaatcaggtaaatgaagcagttcagaaaaatctggagtcgtaatttccggcacttacgcgcaaacgggcagaaatgcccgtttattcgggccattgacctggcttgacgcagactttgttgcccggtaaggtgcctctcgtgcgccagaagtgcataaattacgcaactcttgacctgtagacctgattatcatggataaatttgacgctaatcgccgcaaattgctggcgttaggtggcgttgcactgagtgctgccatcttaccgacacctgcatttgcaaccctttccaccccacgcccacgtatattgacgctgaataacctgcataccggcgaatcaattaaggcggagttctttgatggccggggctatattcaggatgaattagcaaaacttaaccattttttccgcgattatcgcgcgaataaagtgaaatccatcgatccaaaactgttcgatcagctttatcgtttgcagggcctgctgggcacccgtaaaccggtgcagcttatttctggctatcgctcgctggataccaataatgagctgcgtgcccacagcagcggtgtggcgaagaaaagctatcacaccaaaggacaggcgatggatttccatgttgaaggcattgcattaagcaatattcgcaaagcggcgttatctctgcgcgcaggtggtgtaggatattaccccagcagcaactttgtgcatattgataccgggccggtccggcactggtaatctaagccttcaataaacaggagcagtatgaactatcgtattattccggttaccgcttttgcccagaactgttctttgatctggtgcgaagaaacacggcaggcagccgtggttgatcccggtggcgacgcagataaaatcagacaggttgtggacgccagcggcatgacgctgacgcagattttattgacccacggtcatcttgatcatgtcggtgccgccgcagaactggcgcaacattatgctgtgccggtgatcggcccggaaaaagaagatgagttctggctgacgggcctgcccgcccagagccggatgtttggcctggaagagtgtcagcctctgacgccggatcgctggctgaatgaaggggaaagcgtcagcctgggcaatatcacgcttcaggtactgcactgccctggacatacgccgggacacatcgtgttctttgatgaacgcgcccgtctgttaatttccggcgatgtgatttttaaaggcggcgtggggcgcagtgatttcccgcgcggcgaccatgcgacgcttatcgattcgatcaagcgtaagctgttgccgttaggtgacgacgtgaccttcctgccggggcatggcccgctgtcgacgctcggcgaagagcgcctgcacaatcctttcttacaggatgaaatgccggtctggtaataaaaaaaggtcgccgtggcgaccttttttaatgctcagaaacttacagcacggcgacaatggcttcgcacagcggcgccatattgtccggcgtcatacccgccacgttgacacggcctgatgccaccgcatacacgccgaattcctcacgcagacgcagcacctgctctttggtcaggccgctgaaggagaacatgccgttctgtttgatgatgaagctgaagtctccctgcgcgcctttctcctgtaaggtattcacaaacagcagacgcatacgctggatacgctgacgcatatccgtcagctcctgctcccagatggcgcgcagcgcgtcattgctgagaatagtcgccaccaccgaggcaccgtgcgccggcgggttagagtagttggcgcggatcaccgacttcatctggctgaacgcacgatccaccgtttctgcatccgcacacaccagcgtacaggcacccacgcgctcattgtacaggccgaagtttttggagtaggagctggcaacgatcagttcgtgatgcagcgcagcaaaggcacgcagaccttcagcgtcttcttccagtccacgggcgaagccctgataagcgaagtcgaacagcggcagccagcctttttgcgcggacagctcagccagctgttgccactgatccagcgttggatcgatacccgtcgggttatggcagcagccatggaacagcaccacgtcaccggcctgggcttcgttcaggctggccagcaggccgtcgaagtccagggtgtggctggtagcgtcatagtacgcatattcacgcacttccagacccgcggagttaaagacgcttttatggttcggccagcttgggttgcttacccagacgcgttttacgtccgtatttttcgccagaaaatccgccgccacgcgaagcgcgcctgtaccgccgggggtttgtgccgtgcgggcgcgtttgtcgttgatgagggcattgcctttgccaaacagcagctcctgcgtgcaacggccaaactccggaataccgtcaatgccgaggtaatttttagtcgtttcattttccagcagatactgctcagcttttttcacgctggtcagcaccggggtcttgccggtttcatctttatagacgccgatgcccagattaattttagtggggcgagtatcggcacgaaacagatcggccaggcccaggattgggtcggcaggggcagcagtgattttctcaaacatgacgaggttccattgtggtgtcaaaaagggaaagccgctatcaggttaacggctgatggagcaaatgccaaccgtttgcgacaaaaagaaaaaggaagtgcggggtgaagggaataacaggattttaaacataaaaaaacagggccggagccctgtttaataagcatataacgaggtgtgttacgacttagaactggtaagttacgccaacaacagcctggtcagcagaaccgacgaagccggtatcagcatcttcgtcatccagcaggttgatacggtagtcgccgtatacgttgaagttcttgttgaagtagtaagttgcgccaacggtcacgtattgcgccagatcgcggtcgccgatgcccggcagatctttagctttggactgcacgtaagatacggacggacgcagaccgaaatcgaactggtactgagcaatcatctcaacgttctgagttttgttcgcaacagtgtagaagttaccgtctgagttcggaacggttaaggaatcaccgctgttacccaggttagtggtgttacgggtttcagcatataccgcagcgaggtaaacgttgtttgcgtcgtatttcgcgccaacagcccatgcttcagcacggtcgccgttgccatcttctttctgcgcaacagtacggttagcggtgctgtaagaaccgatcacgccgaagccttcaccgaactcgtagcccagggacgcgcccacgccgtcgccgtttgcttcacgcaggttgtcacggtcgtttttgccctgatattgcaggccaaagctcagaccatcaaccagaccgaagaagttgctgttacggtaggtcagcagaccagtggaacgcatggtcatgaagttgtcagtgtatgcgccaccccaggtttcgccagagaaggacggagccatatcggtgtaggattctacatcgtaaacgatgccgtagttacggccgtagtccagagagccagcgtcagcaattttgataccagcgaaagccagacgggttacgttgtcctggctgccttcagctttgcttgctttagcacgatattcccactggccgtaaccggtaacttgatcgttaacctgagtttcgcctttgaagccgatctggccgtaagagttatctttgttagtggtgttgtcgccagaagtggtgaaggcgtgctcgccaacaactttgccgtacagatccagtttgttgccgtttttgttataaacttctgcagcgttagctgcaccggctaccagcagagcagggataaccactgccagaatattgcgcttcatcattatttattaccctcattaggttttatgaacacctgccactgccgccaatagattccgtcaataaatatttacggaactattgatgagagtttggtgtctctctgtgtctgagaggcatctttccattcatgtaatcgtttcgctagcgccaaagtgctacaaatgtcttaaagcggtaacgaaaagaaataatgtgtaacattgtgtgaatttttcggaactttgtgaaccatctctaatttccggactctccgctgataaattcagcgaatccattcctatatatatgaattgcttatatttaatagtgctaatggcaattcttatttaagaatcattcttatctctctttttcttataattgcatttagccgtccggattgccgggcgatttttatccacatgtgctaatgcttcagaaaaacctaatccgcaagaagtgaagggcttattttttgttcagaaatgtaaagacgacagggatggttacaaaagtgaaaagaagagagaggagtgttgagaatacagactgaatgttaacaaaagttgacaatgagccttaaaaataagggccagattagctggccctgatattcagaaactggcgttacgcggggtacgcgggaacggaatcacgtcacgcacgttctgcacgccggtcacataggcaatcagacgttcaaatcccagaccgaaaccggcatgaggaacggtgccgtagcgacgcagatcgcgataccagccgtagtcttctttattaagacccatttcagccatacgcgcatccaggacatccagacgctcttcacgctgggaaccaccgatgatttcaccaatccccggcgccagcacgtccatcgcggcaacggtcttgccgtcatcgttaagacgcatatagaaggccttgatgtctttcgggtagttcttcaccaccaccggcgctttgaaatgtttctcggcaagataacgctcgtgttcggaggagagatccacgccccagtaaaccgggttttcgaatttctcaccgcaggtttccagaatgcgcaccgcatcggtgtaatccacctgggcgaagtccgcagagatgaaacgctccagacgttcaatggcgtctttatccacgcgctcggcgaagaatttcagatcgtccatacgctcgtccagcacggctttaaagacatacttcagcatggcttctgcaagggcggcgttatcttccagatcgttaaacgccacttccggctccagcatccagaactcagccagatggcggctggtgttggagttttccgcgcggaatgtcgggccgaaggtatagaccttcgacagggcgcaggcgtaagtttccgcgttaagctggccggaaacggtcaggaaggcttctttaccgaagaagtctttatcaaaatcgattttgccctggtcgttgcgcggcaggttttccagatccagcgtcgacacgcggaacatttcaccggcgccttcggtatcggaggcggtgatcagcggcgtcgacacccagaagaagccctgctcatggaagaaacggtgcagcgcctgagccagcgtgtgacgtacgcgggctaccgcgccaatcaggttggtgcgtggacgcatatgcgccacttcacgcagatactcaatgctgtggcgtttggccgccatcggataggtatccggatcctcaacccagccggtgacttcaacgctggtggcctggatttcaaagctctggccctggcccggcgatgccacgacggtaccggtaacgatcaccgagcagccggtggttaaatgcagcacctcgtcattgtaattgggcagagaattattaataacggcctgtacaggatcaaagcaggaaccgtcatagacggccaggaaggagatgccagcttttgaatctcggcgggtacgtacccaaccgcgcacggtgacctgctggtcaacggctacacggccctggagtacgtcggctacaggcgcaacgctcataatattctctctgttaattgtctggaaaaaatagtcatttatccacccaatggggggatacctatgttacctggcatgcgccatcagacaagcagaattcgcagcaaccggcgaagaattaataaataaataagaagaagggagccattcaggctcccttttgcgattaactggcttttttaaccagcggtaaatcgaaggcttcacgcaatgcgcggacaaaagctttatcgtgacagatggtttttcccgggctgtccgagagtttagcgacgggcttgccgttacactccaccagtttgatcacgatattcagcggcttcacctgcggaatattacaggtcaggcgcgtaccgataccaaagcctaaattcacgcgtgaagagaagtgccggtaaagatcgatcgcttttttcagatccagattgtcggagaacaccagcaccttgctgtgcggatcgataccgagcttctgatagtgggcaatggctttttcaccccattccaccggatcgccggagtcgtgacgcaggccctggtagcgggtggcgaattccggaccgaaatcccgcaagaaggcgtccatggtgatgcagtcggtcagcgcaatgcccagctgatccgggtattcggcaagccaggcggcgagagccgcgcgctggctggtcgccaggtccgggctgatctgctgatgcgcctggaaccattcgtgcgcctgggtgcccattggcgtcaacgacagacggcgcgccagatcgtaattgctggtgccggtaaaccacggctcccgggtcagacgctcgacaatggcctgttgcacgctgcgggaaaaacgacggcgggtgccgaaatccatcagacggaaacgcgacagatccagatcggcggtcagatcagcaaactcgaccagcttctcttccagcatcgccagcgcctgcggcacccctgcttccggtgaacggtagctgtgcaccagctcgctaatcaccgccagcagcggcacttcccacaggatcacttcccgccacgggccgctcagacgaatattgagtttgccgttctcgttaatgacttccacctgttgtgggtcataacggaaatcgcgcagccagttgaggtaatccgctttaaagaagggaaggccggaaagccactggaattcatcatcctgcaagcgcaaatgttgcatggcatttatctgctcgcggatggcatccgcgtagatgcccagcagatcgtcaccacggcagcggaattcagccaccacctgcacatcggcgtagcggtggaaaacagcctgttgcatgtgcagcttgtacgcatcggtatcaagcagcgtatgcaggatcggggaagcaaattgtgtcatggcgtgccgtagcatcctctcacaggagcgtttagtacattaaacaacaggggagaatcgctggagtataccctgtttagcaatttattgaaccccgatcacaacataagcgggcttttcagacgagcgcaattcgtgccactgttataaaaatgtagcaaacaggacgtttctgtctgaaaagatgaagattctgcgtggcgagttgttcacaacaggaatagactggagtcgataccatactaaaagatgctaaaggttttttatgacacaacagccacaagccaaataccgccacgactaccgtgcgccggactacctgatcagcgatattgacttgacctttgacctggatgccgccaaaaccgttgtgaccgccgtaagccgcgtgtctcgtcagggcgcgtccgacgcccctttgcgtcttaatggtgaagatttaaccctggtctcattgcacattaatgatgcgccctggaccgactaccagatcgaagagaattatctggtgatttcggcgctgccggaccactttaccctgcgcatcgttaacgagatcagcccggcgaccaatacggcgctggaaggcctgtaccagtccggcgaagcgctctgtacccagtgtgaagcggaaggtttccgccatatcacctggtatctggatcgcccggacgtgctggcgcgttttaccaccaaaatcattgccgataaaaccacctatccgtacctgctctccaacggtaaccgtgtgggcgagggggatctggaaaacgggcgtcactgggtgcagtggcaggatccgttcccgaaaccctgctacctgtttgcgctggtggcgggggatttcgacgtgctgcgcgatacctttaccacccgctcaggccgcgaagtagcgctggagctgttcgtcgaccgcggcaatcttgaccgcgcgccatgggcgatgacctcgctgcaaaactccatgaaatgggatgaaacccgcttcggtctggaatacgacctcgacatctatatgatcgtcgccgtggacttcttcaacatgggcgcgatggagaataaaggcctgaacgtctttaactccaaatatgtgctggcgcgtaccgacaccgccactgataaagactatctcgatattgagcgcgttatcggccacgaatatttccataactggaccggtaaccgcgtcacctgccgcgactggttccagctcagtctgaaagaaggcctgacggtgttccgcgatcaggagttcagctcggatttaggctcccgcgccgtgaaccgtatcagcaatgttcggaccatgcgcggcctgcagtttgcggaagacgcaagtccgatggcgcacccgatccgcccggacaaagtcattgaaatgaacaacttctacaccctgacggtatatgaaaaaggggcggaagtgatccgtatgctgcatacgctgctgggagaagaaaacttccagaaagggatgcagctttactttgagcgtcacgatggcagcgcggccacctgcgatgattttgtgcaggcgatggaagacgcgtccaacgtggacctgtcgcacttccgtcgctggtacagccagtccggtacgccgattgtcagcgtgcgtgacgactacaacccggaaaccgagcagtacaccctgaccatcagccagcgcacgccgccgaccgctgagcaggacgaaaagctgccgctgcatattccgttcgatatcgaactttatgataacgacggccatgtgatcccgctgcaaaaagacggtcatgctgtgcatcacgtgctgaacgtcacccaggccgagcagacctttgtctttgataacgtctatttccagccggtgccgtcgctgctgcgtgaattctccgcgccggtcaaactggaatacaaatggagcgatcaacagctgacgttcctgatgcgccatgcccgtaacgatttctcccgctgggatgctgcgcaaagcctgctggcgacctatatccgcctgaacgtggcgcgccagcagcaggggcagccgctctccttaccgctgcatgtcgccgatgccttccgtgcgatcctgctggatgagcagatcgatccggcgctggccgcagagatcctgacgctgccatccgccagtgaggtggctgaactgttcgatatcatcgatccggtggctatcgctgcggtacgcgaagccctgacccggacgctggcgacagagctggcggacgagtgcctggccgtttataacgccaataaactcgacgcctaccgcgtggaacatgcggacatcggcaagcgctcgctgcgtaacacctgtctgcgctacctggcgtttggcgatgcgcagctgggggaccgtctggtcagtgagcagtaccataacgccgataatatgacggacgtgctggccgcgctctctgccgctgtagcggcgcagctgccatgccgcgatgcgctgatgcaggactatgacgacaagtggcatcacgacggtctggtaatggacaagtggtttattctgcaggccaccagtccggccgccaacgtgctggataccgtgcgcagtctgcttaatcaccgctcgttcaccctgtccaacccgaaccgcgtgcgttcgctgatcggcgctttcgccagcagcaacccggcggcgttccatgcggaagatggcagcggctatcagtttatggtggagatgctcaccgagctgaaccgccgtaacccgcaggtggcttcacgtctgattgagccgctgatccgcctgcgtcgctatgatgaaagccgtcaggcgttaatgcgtatcgcgctggaaaaactgaaagggctggataatctgtcgggcgatctgttcgagaagattgagaaagcgctggcgtaatctgctgttgttaccctctccgggaggagagggtagagagggtaaggatcagggtgagggggtaatccttcaccctgtttttactgctcttaccggcgcatcaatgcgtttcatcacccgatccagcacttctgattccagctctgccagccgcaccgagccgagcctgcgcggacgcgggatatccaccgtcagatccagcccgatttttccgtcttcaatcagcaggacgcgatccgccatcgccaccgcctcgctgacatcgtgagtcaccagcaataccgtaaagccctgggattgccacagcgattcgatcagcgcctgcatttccagccgggtcagcgcatccagcgcgcccagcggttcgtccagtaacagcagacccggtttgtggatcagcgcccgcgccagcgccacgcgctgtttttgaccgcccgagagcgccgctggccactcggtcgcgcgatcttcaaggccaaccgccgccagcgactgacgggccgcgtcgcgccagtcgcccttcaggccaaggccaacgttatcaatgaccgatttccacggcagcagacgcgcatcctggaacatcattcgcgtgtcgtcctgaatttgcgccagcggcgtggatccggcgaggatttcgccgctttgcggtttttccagcccggccagcaggcgtaacagcgtacttttaccgccgccgctgcgtcccaccaccgcaacaaactgcccggcaggaatgtgcagatccaggccattgagaatggtgttctggccgtagcgtttagtgacgccgttgagcaccagcggcgtaccgcgattaaggcgcgcagtattcatagatcactccttcgcagaataggccgggttccagcgtaaccagacgcgttccagcagttgcgcgctcagatctgccagtttgcccagcacggcataaagaatgatggcgaccaccaccacgtcggtctgcaaaaactcacgggcgttcatcgccagataaccgatcccggcgttcgccgaaatggtttccgccacgatcagcgtcagccacatcaggcccagcgcaaaacgcacaccaaccagaatcgacggcagagcgccgggcaggatcacatgggcaaagagcgcgaaaccggacagcccgtaactgcgggccatctccaccagaccccggtcgatattgcggatgccgtgccaggtattgatataaatggggaacagcgtaccgagggcgacgaggaaaattttggcgctctcatcgataccaaaccagaggatcaccagcgggatcagcgccagatgcggcacgttgcgcagcatctgcaccgaggtatccagcagcctttccccccagcgcgacaggccgctgatcaaccccagcgtcaggccgatcgacccgccgatggagaagccaatcagcgcccgccatgaactgatagccagatgctgccacagctcgccgctggcggagagcgaccagaacgcctccaccacgccctccggcgagggaagaatgcgggtggagagccagccggttgacgaggcgatctgccagatcaccaccacggccgccggtaaaaaccagggcgcggcgcgcagcagccactgccgggacgagtcggacatagcgcctccttaactctgtgaaacgttgcgcggaatgtaatcattcgccaccgcttcgccctgcgcctgtaactggcgcggttgcggcacggcgggaatggcgacatccagatgcgggaacagcagctcgcccactttgtaggcttcctccagatgcggatagccggagaggataaagctgtcgatgcccagcgcggcgtattcattaatacgcgccgccaccgtcgggccatcgcccaccagcgccgtacccgcgccgccgcgtaccagacccacgcccgcccacaggttcgggctgatttccagattttcgcgtctgccgttatgcagcgccgccatgcgctgttgaccaaccgagtcctgacgggcaaatgccgcctgggcgatggcaatggtttcatcatccagatgggagatcagccgatctgccgcctgccacgcttcttcgttggtttcacgcacaatcacatgcaggcggataccgaagcgcacgctgcgcccgtgtaccgccgctttggcgcgcacctgctcgattttctctttcaccagttccggcggttcgccccaggtgagataaagatcaacctgctcggcggccagatcctgtgccacatctgacgagccgccaaaatagagcggcggacgcggctgctgtaccggcgggaagaagagctttgcgccacgcacgtggatatgcttgccgtggtagtccacggtgtcgccctccagcagacgccgccagacgtgggtgaattctgccgaggcttcatagcgttcagtgtgatcgaggaacacgccatcggcggccagctcctgcggatcgctgccggtcaccaggttgaacagcgcccggccattggagagacgatccagcgttgccgcctgacgggccgccacggtaggggaggtcacgctcgggcgcagcgccaccagaaacttcagccgttgtgtcaccgggatcagcgatgcggccaccagccacgcatcttcacaggagcgacccgtcgggatcagcacgccgctaaaaccgatgcggtcagccgcctgggcgatctgctgcaaataaccatgatcgaccgggcgggcggcatgttcagtgccaagatagtggccatcgccgtgggtcggtaaaaaccagaacagattcaggctcatgatttagctccttgagtagtggccggatgccagatgcgggtgcggatatccacctgtttcgggacaaggcggttctgataaaacagatcggcggtctgctgttgcagggcggccgtggcgtcgttgaccggcgaaatgcgcgtcggcggacggtggtcaaaataggtggcgatcaccggctcaggcagccccatggttttcgccagtaagctgatgctggcctcgcgctggctgagggttaacgcatctgcttcgctgaaggtatccagaacgccctgaataaaagcgccatttttttcagcatagggacgggaggcgagataaaacgaacctgtctgcttcaaatcggtgccgtctttcagcacccgcacgccaccctgtaacagggctgcggaataatagggatcccagatggcccaggcgtccacattgccctgcgaaaacgcggcgcgcgcatcggcaggcgtcagataggttggctgtatatcggtgaatttcagtcctgcctgttgcagggcgcgcagcagcaggttgtgagaactggaacctttctggaacgccaccttatggcctttcagatcggcgacggttttgatcgggctgttttccggcacgaggatcacttccgctttcggcttcggcggctcaacgccgacatagagcagatccgccccggcggcctgggcaaagataggcggaatatccccggtgctgcccagatcaatactgccgatattcagggcttcgagcatctgcgggccggcagggaactccacccaggagattttggtgtccgggtaacgtttttccagcagctgatgatttttcgccagcaccatgctgacgctgcctttctgatagccaatacgcagcgcgtccggggccgtttccgccgcctgcgaccaggcggagagcgttaacatgccgctgagcgccagccactgggcgcgggatttgaaaaggttaaacatggacgactccttgcgtgtcactgatcaacggggctttcggctcaaggcggtgcagcgcctgggtaaaggtttccagcgcgctatcgaggcggacctgcagatgcgggctgaaggtggctttatgctggtaatcggcgatctggctatcatcagcgaataccccctgcaaaatttcctgcgcgcgcagggcgctcagtaccggtttcagggcgtaatccaccgccagcatgtgggcgatgctgccgccggtcgccagcggcaacacgactttccccgccagcgcgcgctccggcagcagatccagcagcgtttttagcgcgccggaaaacgaggctttatagatgggcgtggcgacaatcagtccatcagcatccgttaactgttcgttcagcgccagcagcgccgggctgtcaaaacgcgcgtagagcagatcttccggctcgaagttatgcagatgccagtggcagacctcgatcccctggtcgcttaagctttcgcgggcgtattccagcagggcgctggagcgcgaggggaaacgcgggcttcccgctaatgtcactacacgcatactgactccttataaccaaatgtttgcttttatctaacattgataacaatttgccagagtgtttttattccactaaatgatttatctgaacaagaattgccaaaaaacggcataagaagagatgggcaggtaaacgtttgcgcttttgcggttttttttgccgcaggtcaattccctttcgccgcgggatgaaacataatacgcccccggtttgcacaccgggaatccaggagagttcatgtactaccccttcgttcgtaaagccctttttcagctcgatcctgagcgcgctcatgaagtgacctttcagcaattacgccgggtgtccggtacgccatttgaagcactggtgcgccagaatgtgccggtaaaacccgtcacctgcatggggctgaccttcaagaatccgcttggcctggcggcgggtcttgataagaatggtgaatgtattgatgccttcggcgcgatgggatttggcgcaattgaaattggcacggtgacaccgcgtccacagccgggtaacgataaaccgcgtattttccgcctcgttgaagccgagggattaatcaaccgcatgggctttaataacctgggcgttgataacctggtggagaacgttaaaaaggcgcattttgacggcgtgctgggtattaatatcggcaaaaataaagacacgccggtggagcagggtaaggatgactacctgatttgcatggagaaagtctatgcttatgccgggtatatcgcgattaatatttcctcgcctaacacacctggtttgcgttcactgcaatatggcgaagcactggatgatttgctgctggctatcaaaaataagcaaagcgaattgcagaatatccatcacaaatatgttccggtggcagtcaagattgctcccgatctgagcgaagaagaattgatccaggtggctgatagtttagttcgccataatattgatggtgttattgccaccaatactacgctggaacgatcgctggtgcagggcatgaagcattgcgatgaaacgggcgggttaagcggccgtccgttgcaattaaaaagcacagaaattatcaggcgtttagcgcttgagctgaatggccgtctgccaattatcggcgtcggcggaatcgattcggtgatcgccgccagggaaaaaatggcagccggcgcaacgctggtacaaatctattcgggctttattttcaaaggcccgccgctgattaaagaaattgtcacccatatctgacgtttatcccgctaaatgacaaccagggctttatttcctgccctggttgttttatattccgtcgttgttgcttatttaaacattgtggtcttttattatttacacaataagcgaagcggcaaaatggataaaaaagcaacaggacgcttgcggacgggagaggaagatgcgaattaaacctgacgataactggcgctggtattttgatgaagagcacgatcgtatgatgctcgatctggccaatggcatgttatttcggtcccgttttccccgtcgcatgttaacccccgatgctttcgcgccgaccggtttttgcgtggaagatgccgcgctctatttctctttcgaagaaaaatgccgctatctggatttaagccgtgaacagcaggcggagctggtgctgaatgcgctggtggccatccgttttctgaaaccgcaaatgccgaaaagctggcacttcttagcgcataacgaccgttggacgccgctgcagggcgaagccgccagcgtctggctgagcgacaccgcagagcaggtgaatctgctggtggtcgaaccgggcgataacgccgcgctctgtctgctggcgcagccgggtgtagtgattgccgggcgtaccatgcagcttggcgatgccatcaaagtgatgaatgaccggctgaagccgcagccgattgccgccagcttcagcctcgaacaggcggtttaaggttccagtttcagcgccgttctggggatgcagctacagctcagaatggtgccatcgtcaccgatcgccgactgtttcagcgcactgacttccccctcgactaagcgtatccggcagcagccgcagatccccgcccggcaggagtagggtacgcggatcccctgactttccagttgttccagtaatacctgttgattattaccggtaaattgctgtccgtgaaaatcaatgctgacgcctgagggatccgctttatcgacgttaagcgtttcagcaacgtttcctgcaccatagatttttcctggcgcgcgggccagcaccgtgacttcatcgccgacgcggatcacgccgctgttgcgggcgatcaggttctggccgaaatccacatcgccattgtcctgggctgtgcggaatccctgtaaagtggtaagcggttctccggacgggtgcttttgcccgcgctccgggctgacggtggtgaatacgcaacggctacagggtttaaccacatcgaaaatcacctcgccgatgcgcaccactttccagccgtcttcttcccaggcggcggcgccgctgaccaccaggttgggccggaactgctctatttgtacgctggcggggcagcgctgctggagatcccgtagcgaggcctcgttgaccagcagatagggaaagccatcggcaaaggagagcggcacgctttcaaagcgttttacccttcgcgttggctgcgggccgacccagcgcagttgcacctcgcgggcgaaaaaaccgctcagccacaggttaatggccgcaggcgctataaaggccgtaaaatggttgccccagacttcagtgggttctggctgcgggtcaaaatccgcaaagcgcaccagcgcgctgctgccatcgggcgcggtgaggtgcagcccatcgggtagcagggcgggcgtgaagcgtaccatcgcgggaaactgacgggcggtgatgaaagtgccgtcgggttcagtgagcataaatatacgatcgaacgccaggccgctgctgtccgccagcgcatgggtaagaccggtgccgcgcatcgatttaaccggatgaataaaaagccgcgataaggttgccacgccatcctcttctgaatctggaaataagcgctcaactttatgacatagcgttgagattagctataatgcgcaacaattttctaagtgaataagtgacgatatgatttctctgtttgccagtacggcccgcgggctggaagagctgttaaaaactgaactggaaaacctgggcgggcaaaacgtccaggtggttcagggtggtgtccattttgagggggacacccggcttgtctaccagagcctgatgtggagtcgtctggcttcgcgcatcatgatgccgatgagcgagtgcaaggtgtacagcgaccttgatctctatctcggggtgcaggcgatagactggacggagattttcagccccggcgcgacctttgccgtgcacttcagcggcctgaacgacaccatccgtaacagccagtacggcgcgctcaaggtgaaagacgccatcgtcgacagcttcacgcgcaaaaatctggaacgcccgaacgtcgatcgtgaaaagcccgatctgcgtatcaatgtctggctgaataaagatactgcgcatatcgcgctggatctgagtggcgaaggtctgcaccagcgcggctaccgtgacggcaccggccttgcgcccattaaagaaagccttgcggccgctattgtgatgcgatctggctggcagccgggtacgccgttgctcgatccgatgtgcggttccggtacgcttttgatcgaagcggcgatgtacgccaccgaccgtgcccctggcctgcatcgcgggcactggggattcggcggctgggcgcagcacgacgacgccatctggaaagaagtgaaagccgaagcccaggtacgcgcccgtaaaggcctggcggattacggttcgcgtttctatggttccgacaacgacagccgcgtgattgaacgcgcccgcagcaacgcccgtcgcgccggtgtggctgatctgatcgcgtttgaggtaaaagacgtcgccaaactcaccaacccgctgccggaaggcccgaccggaaccatcctcagcaacccgccttatggcgaacgtctggacagcgaaccggcgctgatcgcgttgcacagtatgctggggcgcattatcaaaagtcagttcggcggctggaatttatccctgttcagcgcttcgccggatctgctcaactgtctgcaactgcgcgccgatcgccagtttaaagccaaaaacggcccgctggactgcgtgcagaaaaactatgctattgccgtgaccagcgccgatgcgcagggcggcggcagcgcgtcgatagcggaagattacgctaaccgcctgcgtaagaacgtcaagaaactggaaaaatgggcgcgtcaggaaggcattgaatgctatcgcctgtatgacgccgatttaccggagtacaacgtggcggtggatcgctacggcgattccgtggtggtgcaggagtacgcgccgccgaaaaccgtggatccgcagaaagcccgtcagcgcctgttcgatattatttccgccactatcgcggtgctcggtatcgccccgaacaagctggtgctgaaaacccgtgagcggcagaaaggcaaaaaccagtatcagaagatgaacgagaaaggggacttcatgcaggtaagcgaatataacgcgcgcctgtgggtcaacctgaccgattatctggataccggcctgttcctcgatcaccgtatcgcccgtcgtatgctgggccagatgagcaagggtaaagacttccttaacctctttgcctataccggcagcgccagcgtgcatgcggggctgggcggcgcgaaatccaccacgacggtggatatgtcccgcacctatctggagtgggccgagcgcaacctgcgtctgaataatctcagcggccgcgcgcaccgtctgatccaggccgactgtctggcctggctgcgcgataccgatgaacagtttgatctgatctttatcgatccccccacattctctaactcgaaaagaatggaagatgcctttgacgtgcagcgggatcacctgcgcctgatgaaagatttgaaacgtctgctgcgcaaaggcggcaccattatgttctcgaacaacaaacgcggtttccgtatggatcacgacggtctggctgagctcggactgaaagcacaagaaatcacgcaaaaaacacagtcgcaggatttcgcccgtaaccgtcagatccacaattgctggctgatcacctcagcctgaaggaagaataaatgtcattaattagtatgcacggtgcctggctgtcgttcagcgatgcgccgcttctcgataacaccgaactgcacatcgaagataacgagcgcgtgtgtctggtgggacgtaacggcgcgggtaaatcgacgctgatgaaaatccttaaccgtgaactgggtctggatgacgggcgtattgtttacgaacaggatctggtggtggcgcgcctgcaacaggatccgccccgcaatgtagcgggcagcgtgtacgatttcgtggcggaaggtatctcggagcaggcggaatacctgaaggcctatcatgagatttcccatctggtgatgaccgatccgagcgaaaaaaatcttaacgagatggcgcgcttacaggatctgctggaccaccacggcctgtggcagcttgaaaaccgtatcaatgaagtgctggagcagattggtctggaagcggatatggcgctggcctcgctgtccggcggctggctgcgtaaagcggcgctgggccgtgcgctggtcagcaacccgcgcgtgctgctgctcgacgaaccgaccaaccacctcgacatcgaaactatcgactggctggaaggcttcctcaagaccttcaacggcaccatcatctttatttcccacgaccgttcgtttatccgcaatatggcgacgcgcattgtcgatctggatcgcggtaagctggtgacctatccgggcagctacgatcagtatttgctggagaaagaagaagcgctgcgcgtggaagaactacagaatgcggaatttgaccgcaagctggcgcaggaagaagtgtggatccgccagggcatcaaagcgcgtcgtacccgtaatgaaggacgtgtgcgcgccctgaaagcgatgcgtcgcgagcgcggcgaacgccgtgaagtgatgggcagcgcgaaaatgcaggtcgaagaggcctcccgctctggcaagatcgtctttgagatggaaaacgtcaactacggcgtggacggcaaagtgctggtgcgggatttttccgcccaggttcagcgtggcgacaagatcgcgcttatcgggcctaacggctgcggtaaaactaccttgctgaagctgatgctcgggcagttacaggctgacagcggccgcgtgcactgcggcaccaaactggaagtggcctattttgaccagcaccgcgcggaactcgatccggacagaacggtgatggataacctctccgaaggcaaacaggaagtgctggtgaacgggaaaccgcgccatgtgcttggttatctgcaggacttcctgttccatccaaaacgcgccatgacgccggtgcgcgcgctgtcgggcggagagcgtaaccgcctgctgctggcgcgtctgttcctcaagcccagcaacctgctgatccttgatgaaccgaccaacgacctggatgtggaaaccctcgaactgctggaagagttaatcgatggctatcagggcaccgtcatgctggtgagccacgatcgtcagttcgtcgataacaccgtgacggaatgctggatcttcgaaggcgaaggccgcatcggtcagtatgtcggcggttaccaggacgcgcgcggccagcaggcggcttcgctggcgcataaacagtcagcgtcgaaaaaaagtgccgaaacggcggcccctaaagcagaaactgttaaacgtgccggtaacaaactaagctataacctgcaacgcgaacttgagcagctgccgcagcgtctggaaacgctggaagcggaactgagcgcgcttcaggcgcaggtcgctgacggtgcattcttcagccagcctcatgaccatacgcaaaaagtgctggccgatatggcgcaggctgaacaggcgctggaagaagcttttgagcgttgggaataccttgaggcccttaaaaacggcgcgtaattcaggataaacgtatgtgcgatcaccaccatgccacccggcacattttgtgttctcagtgtgacttgctggtggcactccccgcgctggaggacggtcataaagcggactgtcctcgctgcgggcataccctgaccacaaaatgggccgaaccgcgtcagcgtcccagcgcctattcgctggcggcgctctttatgctgctgctggccaatctctttcccttcgtcaatatgaaggtcgccggtatcaccagcgaggtgacgctgctggaaattccgcgcgtgatgttttcggaagattacgccagcctcggcacctttttcctgctgtttgtgcaactggtaccggcgttttgcctggtgacgatcctgttgctggtcaaccgcgtcacgctgccctggcgcgtacaggcttttctggcgcggatattctttcagctaaaatcctggggcatggcggagattttcctcgccggcgtgctggtgagttttgtgaagctgatggcctacggcgatattggcatcggcagcagttttgtgccctggtgcctgttctgtctgctgcaactgcgtgcctttcagtgcgtcgaccggcgctggctgtgggacgatctcgcgcatatgccgccggtggatcagccgcttaaaacgggcgtcactggccttcgccaggggctgcgctcctgcccgtgctgcaccgcgattttgcctgcggatttacgccagtgtccgcgctgtcacacccgcggttatgtgcgacgcaaaaacagtctgcaatggacaatggcgctgctgatcacctctgtcctgctttatctgcccgccaatattctgccaatcatgatcaccgatctgctgggcgataaaatgccctccaccattctggcgggggtcattttgctgtggggggagggatcctatccggtggcgctggtcatttttatcgccagtattatggtgccgacgctcaaaatgatcgcgcttggctggctgtgctgggacgcaaaagggcacggcaggcgtgacggcgagcgcatgcacctgatttatgaagtagtggaatttgtcggccgctggtcgatgattgacgtttttgttatcgctgtgctgtccgcgctggtgcgcatcggcggtcttatgaacatataccccgcaacaggcgcattaatgtttgcgctggtggtcatcatgacaatgtttgcggcaatgactttcgatccccgtctgtcctgggatcgtgagccagaatcaagccatgaggagcagtaaaaacatggagacgaaaagtggggatgcgaaggtgcaaaaggtaaaaagctggtcgccggtgtggatctttcccatcgtgaccgcgcttatcggcgcatggatcctgttttatcactacagccatcaggggccggtggtaacactcatcaccaacaatgccgaaggcatcgaagcgggtaaaaccaccatcaaaagccgcagtattaacgtcggcgtggtggaatccgccaccctggcggatgaccttaagcgcgtggagatcaaggcgcggttgaacgcggatatgagcaaactgctgcatggcgactcggtattctgggtggtgaaaccccaggttggccgggaggggatcagcgggctgggcacgctgttatccggtgcttatattgagttacagccgggcagtaaagggacgcagccggaaagctataaattgctggattcgccgccgctcgcgccgccggatgcgaagggcatccgcgtgctgctcgacagtaaaaaagcggggcagctgtcgccgggcgatccggtgctgttccgcggctatcgcgtgggctcggttgaaaccagcacttttgattcggaaaagcgcaccatcagctatcagctgtttattaatgcgccaaacgatcgtctggttaccagcaacgtccgcttctggaaagacagcggtattgcggtggatctgacgtccgccgggatgcgcgttgagatgggatcgctgaccacgctgtttggcggcggtgtcagctttgatgtgccggaaggcattgacctgggcacgcctgtagcggaaaagaccgcattcacgctgtttgacgatcagcgcagtatccaggaatcgctctataccgaccatatcgattacctgatgttcttcaaagattccatccgtggcctgcaggcgggcgcgccggtggaattccgcggaattcgtctggggacggtaagcaaggttccggcgatgatgccggggatggaacaggccctggacaacgattaccgtattccggtgctggtgcgtattgagccggaacgactggccagccagcttggcgaaatgccggacatgaaatcccatatcaatgaactgctaaaaagcggcctgcgcggttcgctgaaaaccggcaatctggtgacaggcgcgctctatatcgatatggatttctatccgaaagcgccgccggtaaccggggtacgtcgctatggcggctatgaaattattcctaccgtgagcggcgggctggcgcagatccagcaacgtctgatggataccctggataagatcaacaatctgccgctgaacccgatgattgagcaggccacgaattcgctgaatgaaacccagcgcaccatgcgccgcctgcaaaccacgctggataatctcaataagatcaccgccagccagtccgcgcagcaactgccggcggatatgcagaaaaccctgcgcgagctgaaccgcagtatgcagggcttccagccaggatcggcggcgtacaacaaaatggtggcggatatgcagcggctggatcaggtactgcgtgaactgcaaccggtactgaaaacgctgaacaccaagagcaatgcgctggtatttgaagcgaaggataaaaaagatcctgagcctaagagggcaaaataatgaaaaatggagtagtcatcgccgcgacgctgctgctggcggcctgtagcagcaacgtggaagagacgaattattatcagttgccgacgccgcaacagaataccgtgcagcgccagagtggtagcgccgaccgtctgctgtgggtggagcaggtttcagtgcccgattatctggcgggtaatggtgtggtgtaccagaccagcgatgtaaaatacgctatcggcacgcaaaacctgtgggccagcccgctcgatcagcagctgcgcacaacgctggtgtccaacctcagtcagcaattacctggttgggtagtggcttcaacgccgcttggcaacgagcaggatacgctgaacgtgacggtgacagggtttcacgggcgctatgatgggcgggtgattgtcagcggcgagtggttgctcaaccatcaggggcagctgataaagcgaccattccatatcgaaatgacgcagcagcaggatggttacgatgcaatggtgaaagtgctgggcgaggcgtggagtcgtgaagcgggcgacatcgcgcgggaacttaaccgtctgccctgattgctattaatcctaaaaaaccgccggtttgctcacgcactggcggttttttttatgtcggttttccgggcatttacttgtgccgtctcacactttttgtacaaatgaagttctgtgtatctcacatttatgacaatggtatgaattttgtgcattgacgatgctgttcatccgcgttacaaaagagacgtgattgcgcattttgtaatcactgttttcttttccaccagactcaaaatatgagggaaacgaggcatgaagagacaaaaacgagatcgcctggaacgggcacatcaacgtgggtatcaggctggtattgccggacgctcaaaagaactatgtccttaccagacgctgaatcagaggtcatactggcttggaggctggcgagaagccatggaggtcaggacagtaatcgcctgattctgtctctttagtaagaaacctccgcctggcggaggtttcgcctgtcagggcactcagaatgcagacgtatcctggaacagcccaactttcaaatcgtttgccgtatagatcacgcgaccatcgaccagcacttcgccatccgccaggcccataatcagacgacggttaaccacacgcttgaagtgaatgcggtaggtgacttttttcgccgtcggcagaacctggccggtgaatttcacttcacccacgcccagcgcacggcctttgccttcgccgccgagccagccgagatagaagccaaccagctgccacatggcatccagacccaggcagccaggcatcaccggatcgccaatgaagtggcaaccgaagaaccacatgtccggatggatatccagctcggcttcaacatagcctttatcaaagttaccaccggtttccgtcattttgacgacacggtccatcatcagcatgttgggagcaggtaactgcgggcctttttcgccaaacagctcaccacgaccagaggcaagaaggtcttctttcgtataggattcgcgtttatctaccatgttttgagtaagccttattgtaagtttgggacgcaggatagctaacacgtgtacgctgaacaagtccgatcagttcggtacaaaccagttcaaccagcgtaacggccacggaaagcgatggcgtgcttcctgctgcgaggcctgggcgatgcgttcctgaatggtctgaatgagggtggtttgcccttcagcatcccaggccaggtttgtcagtaagggtagcgcatctgtcacatcatcgatggcccagataaagaattgtccggcttccacggcgtcgagcagcgtctgcggcagacacagatgacgtacgttagcagaaggaatgatgatcccctgcttaccggtcagaccacgctgctggcagatactgaagaaaccttcgatcttttcattcaggccgcctaccggctgcgcgcgtccgaactgatccaccgaaccggtgatcgccagatgctgattaacaggcacgtccgccagcgcgctgatcagggcgcacagttccgccatcgaggcgctgtcgccgtccacttcgctataggactgctcgaaggtcagcgaggcagagaaggggatctgctgatccagctgaagctcggccattaagaaggcctgcatgatcatcatgccttttgcatgaatatttccgcccagctccgctttgcgctcgatgtcattaaattccccgtcaccgatatgcactacgcaactgatgcgcgacggctcgccaaaggcgcgcgggtgcccagggaattcgacaaccgaaagggcgttgatctgaccgacgcgctcaccttcggtttcaatcagaatttgttccagcaggatctcatcctgaatgcgttcaggtaagtatccttcacgccattcgcgctggctgagcatggtctgcaactgttgtgcatcaaacgaggtctctgcgcccagcgccgcgacttcacgcagctggcgcgccagccacagcgggcacagcggcagcgtttcctgatcgccggtgtaacgcacagcttcacggatcaacaccggccatgcatccttcgccggaacgggcagatcggcgctggcggccacgtgcagcacccactggcaccactgcgccatggtttccgcatccgttatctgaagattatcttcgtactcgctgtaaatggactgggcagccagctccggttccatctcctggaattcggccagtgaatccctctcgccgacgaggatcaccttcagctgtaacggcattgacggcacgctgaccggtaacggacgcgactcgtcaaaggagacccagtcgaagcgctggcgggtgatcatggttttcaggcgcatccacagcagcggctgtgccagcagcgtacgcagggagatcaccagcacgccgccgttagcctgatgcaccaggcccggttgcagggcaatctcattattaaactgacgcaggcagccaaaaagctgctctgcttctacccagtcggcaatgacgaccgggtttttggagacgaagtcggccagcggatccgttgaggcttcaaaggtaacgcttcgaccagcgatctggtattgcccaccagtaaacggctgatcttccggcagtaattgacccacagcatcagcaataatacccagatactccacttcctccggcgcttttgccagcaaaaagcgtgacgatgccagcggatgaagcagttgctccagcgcgtactgtaagcggggttgcgtatcgccgagggataaatcctcctcagacggcgcacaagattgtgtaaatacctcctgataactgtcggtatcagggacaaggtcttgccaggcgagtttagtaatggtcaaagttgaggttttatcgtcagaagtaaagggcggaattataccgtaagcggcaaagcatcacaccagtaatacgcgatttcctgaccgcaaagtcgtctgcgtgttcacaggatatgatttcttttcagcagattgctaaaaaactgatattctgaactgagttacagggtaacactgagatcgcgatgaaataccaacaactggaaaatcttgaaagcggctggaaatggaagtacctggtgaaaaagcaccgtgaaggtgaattaatcacgcgctatatagaaaccagtgcggcaaaagaggccgtggatcagctgttgacgctcgaaaatgacccggttcgtgtgaatgcctggattgaacaacacatgaatgcggcattaatgaatcgcatgaagcagactattcgcgcccgacgcaaacgtcactttaatgccgagcaccagcacacccgtaaaaaatccatcgatctggaatttatggtctggcagcgcctggcagggctggcccagcgccgtggaaaaacgctctcagaaaccatagtgcaactgattgaagatgccgaacacaaagagaaatacgccagtaaaatgtcgacgcttaagcacgatttgcaggcgctgttaggcaaagaataaacccgcgatatttttcacgccggatcgcaggcaataaaaaaccccgcagcgcggggtttttttaagacgtaaacttaagcctgcggctgagttacaacgtctttgatacctttaacttcgatctcaacgcgacgatccggagccaggcaatcgatcagcgcagggcgcgctttcacgttgtcacaggtgctgccggtaaccgggttggattcgcccataccacgagcagagatcttgttggacgggatacctttagagatcaggtagtcaacaacagactgagcacgtttctcggacagaccctggttgtaagcgtcagaaccgatgcggtcggtgaagcccagaacaactacggaaccgtctttcggatccaggttgctcagctgggagtacatctgatccagagcctgctggccttctggtttcagagtcgctttgttgaagttgaacagtacgtcagacttcagggtgaagtgcttggtggatacctgcggagccggagccggtgccggagcaactaccggagcaacgtcttcctgctgaccgaagcggtaagaaacacctaagctcagcagaccgttgtcctgacgggtaccaacagtttgcgcgtcgccgatgttgttaacccactggtattccagacgggtagcgatgtcacgggtaactgcccactcaacaccaccagcgaataccggggaaacaccggtgtcgtggtctttagcgtggaaatcagcgccaggaacgttggctttagcgtctgcacgccaaaccataccacccagacgggtgtaaacgtccagatcgtcagcaaccgggtagctcagtttggtagtcagctgaacgccttgagctttgaacgcaccgtttacggtgtcgcctttataggcttcgcggcccagccagtcgtaacccagttcaaaaccaacgtacgggttaacctgatagccaccgaacgcaccagcacccagctggtcattacgggtcgggccgtcattaggaatgaaaccagtatcgtggaattgggaccagcccagtttaccaccggcataccaggtattatctttcggagcggcctgcgctacagtagcgaagccagccagtgccactgcaatcgcgatagctgtctttttcattttttgcgcctcgttatcatccaaaattcgccatgaatttctcgccagagaaaacacggtttaaatccttcaccgggggtattgctctaagtatctctaccgatatcttcggtttatgccgagcacccctggcgatgtaaagtctacaacgtagttggaaacttacaagtgtgaagtccgtcaggcatatgaaaaaaaaagctttctgcgtgcattatttaacatttatgacgagaatataatcaatgcaaaacagcgcaaaccgcaccagacaggcattgcagcacgatttcgcttaagaaccggtcagcccaggaattcacaaaaaaaatcccaggaattatcttaaactggcttaatgatacaaatttgagtgaatttttagcccggaaagctgtcttgtggcgtgaggatccctccgcacgggacgcataataaagcccatcgcattaccttcttcagccgcctgaaccagacgctgatgttcatcatccgtcagttcttctgtatgccagccgataacaacactgtaattgccggtgcgtaacgctctgatcatggattccagggtatcatccggggaaagctggctgatctgcatcagtttggtcaacggcagccctgccgcctgaacccactgacggcttaatttttgctgcggggttaaccatagctgccagcgcgactgctgaccgagctgttgcagaaggggcagtaacagcaactgcgtcatgccgggctggtcttcacgataaaccacttcgctgataaggccagtcgagtcgccagccggttttgcctgtgtgcggttgcccgtcatagcgttaagtgttgatgcacgattagcgtagcctgaagtgtacataatcaatccagccctgatagttactgtatggatgtacagtaactcctggacgtacaaagatcaacctcaatttctgaaagcacctcgcaaatttgcgggataactgatgtccgttaaaaaatcatcttgcccgccgcggacaacttccctatgttcctcattaacggatccgttactaccagaagatgcctttatgccatgattttaaaggaataatcatgaaagatatgtcttatcaacggatccatgaatcacgtgaatacctctcagagttgggtactattcgccatcgaacgctgttcggcggttacagtctttccgttgatgatacggtgttcgccatggtggcaaagggggatctttaccttcgcgcctgtgagcaaagtgctgaataccgtgcgcaacatccggctccgttactgacgatgatgaaaaggggcaggccagtagtactgaactattaccgcgttgatgacagcttgtggcaggacagggatacgctgatgaagctttccacctggtcgcttgccgccgcgtggaaagaaaagatgcagcgcctctgcaagccccggcttaaagatctaccgaacctgaattttcagctggagatgctgctgtgggaagcgggcgtgacggatgtcctcacgctgaaaaaactgggcgctaaagcgtgctgggtcaggctacgcacgcttaatacacatctgggcgttaacgtattgctggcgctggagggagccatcgaagggatgcatcaggccgcgctcccggcgcagcagcgccaggcattgacgacatggtttacagagtttgaggcggagcatcggaaacatcagcggacaacctgacgctgcaatcggctgatttcaggaagcagcgctaccaccaggccgatctgctgtaaaaccagtggttctttactgtccggacgggaatccacctgcgtaatgcgatcggccagctgtgccagcgttttctggactcgttcttcatcagcgggggcgtggtgtaacgcgtcgtcaacgtagcacaccgcgtcgtccagcagagtgaggatctcagcagaagtcagtttttcccggtgcgcgcccagcgcggaaatgtagctggtaaaagtgtggttgaggcacaacagacggaatgcggcatcgcgcagttccgttgacgcgcctggctctgttgacatattggataccaccgacgccagttcggcatcgcggttatgggcatcgcgccttgcaatacggtacgccatgcggttatcacgtccctggtgatactgctcaaggatagcgtcaaggtagcggcagttcgcatcaatggcccgttccagcacgcgtggaagattacgaaaacgccagtccggccagataaagctcaccgcagcccaggcaatcgcacagccgataagggtgtcaataatacgcggaatggcaacttcaaagccttccccaagcaggttaaagcacagcagtaccagcagggtaataaacatggtggcatgggcgtactgcacattgcggaaggcgaagaacagcacgccggtaatgacgatcaaaatcagttgcccttcaatggacggcacaaaatagagcaccggcaggccaatcgccacgcccaccagcgtgccgataatacgcagcgccagacggtgccgggtggcgttgtagttgggctggcagacaaagaggctggtcagcaggatccagtaaccgtgttccaggccggtaaactgtataaaagcgtaaccgacacacaacaccacagacatgcgtatggcgtggcgaaaaagtgctgattccggcgacagattgcggctgaggcgggcgcgaatgtcgctcatgccgttaagaccctcatccgccagcatgttatcggtgtcgttgcgcggcagggtctgcgcctgctcagattcgatcgtcgccagctgtgcgtcaatcgcgcgaaggttttgcagcagaaagcccagcgctttcatctgttcgtcagacgtgccgtcgccgcgggcacgctccagcgcggcatcaagatgggtaaaagcgcgctcgaagcggccatcatgctgatagggctcgcgtaataaaatgcagcgtgataaatgcgcgcaggcctgcgactgcatggagagcaggcgctgaaagcggaacatcacgtcgctgtagcgaaactgttcccgcagcgtctgatactggatatgagacgaactggcgcgctcgtgaatatcctgcgcgacaaaatagtagtgcagggttcgccgggtgccgcgttgcccacgatccccgcgcagacgcgttaataatgaacttttcgtctggttcagcgtggaaaccagctggccgttcgccagcgccaggtcatacagcggcgcctggctttcatcttcgatatcgggatcgaacaggcgggatttcagctccagaaaatgcgccagctgttcatagcaacgcgcaaggttgtcctgtagcgggcggatcgggaagaccagatgaccaatcagcgtcaacaggttaaaccagacagcccccgccagcagcagaaggggttgctgataccattgctcgtaaagcgagatgccgagcatggtgtaaatggcgatcagcagaccgccaaaggcaatagtcgcgtagcgctgcccaagcccgcccagcagaataaatccgctggtggaaatgatcagccccagcgcaaacagccacggccacgggaacagcagttctaccgaggcggaggcgataaaaaaggagatcaacgtgatcagcagattacgtaaacggccggcgaggcggtcatccagatcggccagcgccgccgccacgacgccaagcgtcagcgggatggtcagctttacatcacccatccaccacggcagggcggtagtgccgcacagcgcgatgaaaattctggcgttataaagccaggtactgttccatgtatagcggcgaagcagggggctgagcatcgtggttcagatccttaattattgaaagcggcgacgggcattagcttcacgtgccgctcgcgccgtttccaccgacaccacgcggcgtccgaccggccacagggcaatgccggcgatcttgaaattcgcaatgcctaccggaataccaataatcgtcagacattgtgcaatacctgacacaatgtgcatcaggcagagccaccagccgaacagcacgaaccacaaaatgttcagcagcgtaccgccggtgttcaggatgacgctggactctcccggcgacagttcatccacatgtaccgcctcatttccgtaaggcagcagggaaagcttagtaatttcccagcaggagcgcgtcagcggcagcgtaataataagcacaatactgaccagcgttgccagcagccaggcgagagtggtgaaaaaaccacccagcacaaaatttaaaatattcagtacagtacgcataaatcctcagggaaaagccgttaacgaaaagacccatcaatagtaacgattttttgggctggagcacacattctctggcggttacactggcgcatcacgacatgagttgagaacggcacgtcatggaactgaaagcaacttctttaggaaaacggctggcgcagcacccctatgaccgggtggcgattttacacgctggtgtcaaagtgtctggcgatcgccacgaatatctcattccattcaatcagttactcagcatcgaatgcaagcgcggcctcgtgtggggcgagctggagtttgtcctggtggacagtaaagtcgtgcgtctgcacggaacggaatgggcgcaaacccagctgttctggcaacatctgcatagccgctgggagcagtggagcaaagagatgagcgaggtggcggcgggcgtattgcaggcgcagctggaggcgattaacggccatgttgaccagggcaaatggttaacccgtcagcagaccgaaggattacagcagcagatccgtggcgcgtttgacgcgctgccgctgcctgtcgccaggctggcgtcttttgacaattgccgtgagctgtggcgtcagtgccaggcgtggctggcggatgtggaaggccgccgggcgcagcataaccaggcgtggaccgatgccatgctaaaaaaatatgctgatttctttgccggcatcgaaagctcgccgttaaacccggcgcaggcgcgggcggtggtgaacggtgaatcatccctgctggtgctggcaggcgccggtagcggcaaaacctccgtgctggtggcgcgcgcaggctggcttatggcccgcggcgaagcggcggccgatcagatcctgctgctggcctttggtcgcaaagcagcgcaggagatggatgagcgcattcgtgaacgactacacaccgacgagatcaccgcgcgtacctttcatgctctggcactgcatatcattcagcagggcagtaaaaaagtgccggtgatcagccgtcttgaaaacgataccgatgcgcggcagaaactgtttattgaggcctggcagcagcagtgcagcgagaaaaaagcccaggccaaaggctggcggctatggctggaagaggagctcaactggacggttcctgaaggcaatttctgggacgacgaaaaattgcagcgtcggctagctggccgtctcgatcgctgggtcagtctgatgcgcatgcacggcggggcgcaggcggagatgattgccagcgcgccggaagacattcgcgagcggttttcgaagcgcgtaaagctgatggctccgctgttaaaagcctggaaaacggcgctgaaagcagaaaacgccgtcgatttttcagggcttattcatcaggccattaacgtactggaaaaagggcgctttatcagtccatggaaacatattctggtggatgaattccaggatatttctccgcagcgcgcggcactgctcgccgcgctgcgccgccagaactcccaaacctcgctgtttgccgtgggcgatgactggcaggcgatctaccgctttagcggcgcgcagctcgaactcaccaccgcgtttcatgattattttggcgaaggcgattgctgtgcgcttgatacgacttaccgctttaaccagcgtatcggcgagatcgctaaccgttttatccagcaaaacccggcgcagatgtccaaaccgctgaacagtctgaccgcgggggaaaagaatgcggtttcgctgctctctgacgatcagctggatgcgctgctggataagctcagcggttttgcgctgccggatgaccgcatcctgatcctggcacgctaccatcatctgaagcccgccgcgctgcaaaaagcggcaacacgctggcctgaactgaacctcgattttatgaccgttcatgccagtaaaggccagcaggcggactatgtcattgtgctggggttacaggacggtcaggagggcttccccgcgccggagcgggaatcggtgatggagcaggccttgctgccgcagccagaagattttccggacgccgaagagcgccgtttgctttacgtggcgatgacgcgggcgcgtaaacgcgtctggctgctgtttaataaagcgcagccgtcacgatttgttgaggttttaaagcggctggacgtaccggtggcgcgtaagccctgaaattattcaggcggtaaggccgcctgaatgccattacttcaggcgctctgccaggtagcgcggataatccgggatcataatgtccacgctgtcgctgaaagtgggggactggataataaaatctgcggtggagatattggtggcgaccggaatgttccatacggtggcgaggcgcaacagcgctttgacatccggatcgtgcggcacggcgttcagcggatcccagaagaagatcagtacatcaattttaccttccgaaatcatcgccccgacctgctgatcgccgcccatcgggccgctcagcatggcattcacctcaagccccgtggcacgggaaagcagattaccggtggtgccggtggcatagagttcatgctgttccaggatcggctggtggcgttccacccagttcagcaacatctttttgcagtgatcgtgggcgacaagggcaatatgcttgcgcgcggggagagtgcgagtggtcagttccataatcatattccgcgaatgaatttcgttacagattactggaagcgtttgatgctgcaatagaaagacgcaaaaaaaacctctgacggaatacctttgtgaggggaaccaggatcaggacggcggctgctgttttgcccattgcagaaagcggtcgcgggtttgcggatccgcctgttcaaaccagaatttcaggcgctgctcggtaagggtttgcgattgcgacgggatcgtatccagctcagacagaccggacagcaaagcgctgtcatcagccatggcaggcgcaaagagcggcaacgaggctgttttccccgctttgttatagcgtacggtttcgcgctcatagttaatcactttccccttatcccgcagcggcaaaatatcgagcagcagcggtatcggcgcggcttcaccatccagcaggacgatagctggggcgctgtcgaatttttccgcggctttccagctatccagcgagggtagagagaagttcaccagctttaccgaacgcgtgttgaaactcacgaccagcggcggggaaatgtagagccgcatttcatgatttgccccacggatggttttttcaacgcgaaacaccagctggtgcgggccgttatccagctcaatgctgtccgcgccgcgcagcaacagactcgacactttcttgccgtccagcaccagcaaatcaatatcggtggaaaggcgtaaggtggtggcgacgacggtaaccggcaacaggcaaaagatcattgtcatcgtcaggccggttctcatgggtgtctcctgcactgtcgggtgagtcgcgagaatctataaagttttcagcacgcttttgtttactaccatatagagaggcgcagcttttttctctcatgcagaggtatgggataaatggtggcctgcagagctttggcgtacactggatcgactggcccggaggataaaatgaaagaaaccgatattgctggcattctgaaatcgacccataccattgcgctggttggcgcgagcgataagcccgatcgccccagctaccgggtgatgaaatacctgctcgaccagggctatcatgtgatcccggtatcgccgaaagtggccggtaaaacgctgctgggacagcagggatacggctctctggcggaggtaccggaaaaaatcgacatggtggatgtgttccgcaattccgaggcggcatggggggtggcgcaggacgctatcgctgttggcgcaaaaaccctgtggctgcagctgggcgtgatcaatgagcaggcggcggtgctggccggtgaggcaggactgaatgtggtcatggatcgctgcccggcgattgaaattccccgtctgggtctggcgcgctaaataaaaaccccgcacaggcggggttttttcagttgcgcaggcgcggtgcctgaagctgtttacgaatggtctgcgccagttcgtccattgagggctgttcaggatgctcgtcctggatctcactggtaagctgcgcttccgccagataggtatgcaccggctgaccgttgtcgtcttccatcaccacgtgataccagggcgcatcgcgcaaatcatcatcaaccgccagctcatccacagacggcttatcaagtgaatactcaggatcaatgtccaccaccacacctaaatagcctaacagtgtgtggcgcacttgctggccgataccatatttgctggcaatcatactcacctccgtggaaccgttactgacaccaaatatgtgggcaacgatccagaaatcaagttacatgacgcggcaggcaaaccccttcagatacagtccttccgggtaaggggcgatcaccgggtgatcggcagcctgtcggaactgttctataaattgtacatcacgacccgcatctattgcggcatcagcgatgattttctgaaataaatcggtagtcatcaggccagagcaggagaaggttaacagcacgccgccaggattgagcagctggatcgccagcatattaatgtctttatagccgcggcatgcgcccatcagctggcttttgttttcgacaaatttcggcggatccatcacgatcacgtcgaatttctccccctgatcgcggtatttgcgcagcagtttgaatacgtcgtcgcgaacaaattccgctttgctgagatcgagtttgttaagctcaacgttctgacgggccacatccagcgcttcctgcgacgtatcaacactgaccacctgtgcacagccgcccatcagcgcagaaacggcaaagccgccggtgtaggagaagcagttgagcacacgtttaccctcaacatagcggcgggttgccagacggctgtcgcgctgatcgaggtagtaaccggttttatgaccggtctgaatatccaccagcagcttcatgccgttctcttcgattggcagcagcgcgggcggcagatcgccgacaaccagaccctgcgtcagctccatcccctcttttttacgcactgccacgtcgctgcgatcgtaaatggaacaggacggatagcaggcctgaagggctgcaatcagcgccgggcgttgatattccgcgcccgcgctcagcaattgcaggacaagaaaatcgccgaaacgatcgatggtgatgcccggcaggccatcagattcaccggcgatcagacggtagctgtccagaccatcacgcgtcgccagccagtcacgccattgctgcgcctgcttcagacggcgggtgaaaaattcaatatcaatgctttcatctttgtcgaaggtccacacacgggcgcggatctgcgatgccggggagtatgcgccacgggccaaccattttccctgatgatcgacaatatcaatggtttcaccgaggctggctttgccttccatgcgcgcaaccgcaccggagaagacccagggatgacggcgcagtaacgatttttcgcgccctttggttaacactaaacgtacactcataattagcttatttgtcatattgaagaaaatggccgccattttcccgagttcagccgtgaattgcaatgtaccggcagataaaccctccgttcagctcttatgccaggaatgacacgacctgtcagcccccctttatagaatgcctctcaatcgccaatgcattcataatcctggataaaatatgacaacttcagcgtatcgctactcctttatcgccgaaccgttcaccagcctggcaggaaaattactgggtgtggaattacaaacccgccttgaaaaagaggggcagcaggtgctgcatccggagttgatcatcgcgggctgggatacgcagtcaaaacgccagtatttatatgaacagcttgggcaggtggcaaagcagagcgcgtggatccgggatcgcaatgtgctggtatcgctgccgctctatgatgctgagtgtgcggtgttattgagctatgactccgtactgcgtggactgttatccacactgccgtttgtccggctgacgctggcggaaaatatcagcgacgtgcgcgacgaactacaggggatccgcaacgctatgtggctgggggaggtgggcggcggcagagcaaacgttctcgggctgatgagccagcaatttgaagcgctgatccttgacagccatttttttaaggacgaagtgataaagccaaccttcccggtattaatcaaaaatcttcggcgctattgtgacaaggtggtggtgcgcggcgtgaccgatcggcgttatctgccggtattacaggaagcagagatctggggcgtgcagggatcattttatcgccccgtgccactggggaaactggactggttgctgtgaagctggcggcggggcgctaaacttatccgttaccatcatgttgaaaggagcaaaaaatggaaaaccagacctctcagggcgtgaaatgctgggtgcacggcagtgtgcagggcgtgggatttcgttacagcacgcagcatgaggcgcagcggctgggactcaccggctatgcgcgtaatcttgatgacggcagcgtggaagtggtggcctgtggtgatgccggacaggttgaggcgctggtggcctggcttaaggctggcgggccgcgcagtgcgcgggttgagaaggtgttaaccgaacctcatcaacccaccacagcctatacccgctttgatattcgctattaaatgcattttaccggtttaggcaaaccagcaattttggtggcctgttttgccgggcctttggggaaaaggcgatacagatagcggctgttgcctttctcctcgccaaatttgttcgccatggctttcaccagcatgcggatcgccggtgaggtattaaattccaggtaaaattcgcgaacaaaacgcaccacttcccagtgttccggcgtcagcgcgatcccttctttttcggcaatccgttcagccagcgcctcgctccacacggtggtgtctttcagatagccttcgctatcggtttcaatctcacggccttcataagtcaacatagtgcatcgcaaagtcagtcaaaaacggggtcagtttagcaaataaaaaagccccgcataagcagggcttcggtatcaggccgcgagttagtctctgctggagaaaccaagaatgctcagcaggctgacgaagatattgtacagcgagacgtacaggctcacggtggcgcgaagataattggtttcaccgccatgaatgatattgctggtttcatacaggatggcaccggttgaaatcagaataaacaccgcactgatcgccaggtgcagggcaggcagttgcaggaagatgttcgccaccataccaatcagcaccaccacgatacccgccatcagcataccgcccaggaaggacatatccttacgggtggtcaacacataggccgagcagcagaagaaggtcagtgccgtaccgccgagcgccagcccgatcagatcgcccatgcctgccgacagataagcattaagcattggccccaggatataacccaggaaaccggtgaacgcaaaggctgccaggatgccggacggcttattcgccagcctgtaggtcaggaacatcagcccgtacatgccgacaatggtcagcaggaatcccggcgccggcagggcgagcattgtgctgagcgtggcggttaatgcggaaaacgccagcgtcaggctcaacataaaataggtattacgcaacaccttgtgcgtgctgagtagcgaggtacgctcgcgcgaagaacttactatacgatccatgcgtcactctcttatgacagatgtaattagttgtgaagaatagaaaaaaccaggcggcaggagatagcggttttacccatctttactctgacaataatcccatgacgatagcattaaattctttataaaaagcgtctggcagcaggagtgcgttttccgggaaaataatcagatcaagctcttataggtcactgaaaaatattgccttattttgcacccgtcgctaagagtattagtcagagtgtcatcttatacagggataaggcgaaaacaatgaaatcaggtaatacgcatattttcagaatgactctgctcgctggcgcggttttatgcgccagcgccgtaacctttgccgctcaggtgccgccaggtactgaacttgccgcaacgcaggcgctggtcagaaacaatggcagcgagcccgcctcactcgatccgcataaagtggaaagcaatgtcgaattcaatattatcagcgatttattcgaggggctggtggcggtaaaggctgatggcactattgagccgcgtctggcggagaaatgggaaaataaagacagcacggtgtggaccttccatttacgtccgggcattacctggtctgacgggacggcaatcactgcgcaggatgtggtctggagctggcagcggctgattgatcccgcgacaggctctccgtatgccagttaccccggcaatatgcatattctgaacgctgcggacattgcacagggtaaaaaacctgcctcgtcattaggcgtgaaagcgctggacgatgccacgctggaagtgactctgacgcagccgacagccgcctttctggctatgctcgcgcacccctcgctggtgcccgtagataaagtgctgatcggtcgctacggcgataaatggaccaagcctgaacatttcgttgccagcggcgcctataagctcagcgaatgggtggttaacgaaaaaatcgtcgccgtgcgtaatgcgcgctactgggatgatcagcacacggtgattaatactgtcacctatctgcccatcaatgcggaaacagcggatgtaaaccgctacaaagccggtgaaattgatatcaccaataccattccggtgaatcagttcgcccagctgaaaaagacgcttggcgatcaggtacacatttccccgcaactggcgacttattactatcagttcaacaccaccagagcgccattcaacgatccgcgggtgcgccgggcgctgaacatggggctggataaagacatcatcgcgactaaggtgatggggcaggggcagcgcccggcgtgggtcatcagccagcctgaaattggcggggtgagcctgcataatccggattacgccgcctggcctgaagagaagcggctggcggaagccagacggctgcttaatgaggcaggatttaatgacgcccatccgctgtcgtttaatctgctctataacaccatggaaacccatcagcgcatcgctatcgccgtcagctcaatgtggaaaaagaatctgggcgtggaagcaaaactgcaaaatcaggaatggaaaaccatgctggataccatgcataccggcaatttcgacgcggtacgttatgcatggattgctgattatgatgacgcctcaacattcctgaacactttccgcaccggcgacagcgaaaacacgacccagtacagtaatccggcttttgatacggcaatgcaaaacgcggcaaaggcggccaacgttgaagagcgcggaaaatattatcaacaggctgaagatttgctggcgcaggacgtgcccgcggtaccggtttatcactatgtgaggacgcatctggtgaaaccctgggttggtggctttgcacccgatcgcctcggctactttttgacgaaagatctttttatcaaaaaacactgagttttatgctgaataaatggtcattttgttgttatttcagtcgattaaacaggatttgatggtttttcagccaaacgataaaaatggtgctttacatggcgcaccgggatgtttatagtgcgcctcattccggaagtgtggccgagcggttgaaggcaccggtcttgaaaaccggcgacccgaaagggttccagagttcgaatctctgcgcttccgccagattaaacaaggggttaccatttggtaacccctttgtttttctggtctcataacttttctctccccgtacctttcaatgtatcctccttgcttatgctcctgtccaggacaggaaagccaggctgcgcctgatacccggcccatcatgtacttaccgccgggacgccatttttattcgcgataatagggagtattaatggggaaagtattggtaatactcaaaagctggcactggacgagcttgcgatgttcctcataatggaagtaaaaggcctctcttgcctggtcataaatcatcttatccagattcgcaaactccactattaacagcgagcctttgcgtaaatggccgccccccgtttcaaagttattctcaccccatgcctcctgcgtatgttcatagcgatgcaggatgacttctatttgcccgcgcagagggcaacgtaatctgataacagaattttccagggaaaaagcaaaggaaggggaggttaaaatccacaggaaagcgaaggttagaaaaaatctcattatttgaatgccctgactatttttcgcttttatggcattaaaattaaaccccgtccttgagcacaatcatatcgtgagtttgagtgatggcgatatatacagctggtgaatgattaggaccagaatgctatatgctgcgttaaggcgggaagaggatgcggataaaccaggcggaaaagagacatctgttgcagtactggccggtaaacgcccgatgcgtcaaccggccagttaaatagagggtaaatcagtcagcgaccagccacatatcggcttcttcgaacatctcttccagcattctgttcagtttttcacgatcgcttttactggcatcactattgagtgaattcgcctgcatcggtttaacgcgcacatcggcatcgggaaaaatacgatgaacacgatgtgtcagttcgttcagtatgatttcacgagcgccaggcagcccggcgacgttacgcttatcataaactaactctacaaacacacttcctccggaaactggttatttatacagttctcatcatacgagggttgttcgcagaggtaaagagaaagtcaggtcatttgccgtacctgcagggaagcgcatcagtcagcggcgaaaaaaacctcacaaatgaataacggtagcgtaagcagcgcgccagccagagtaatgaatgctacgccgatcaacagaatgctcatcggatacctcgccgtgcagggatacctgatattaaaaaatatagcggctatgtgacaataaattgaaggtatacataactttacccatgttcagcggtgataaatgcaggcaaagccaaactttgcggcatcgcttcaggaaaagcgtcataaatctgtcacacttattttccaacgcaaaagaggacggtggtatgaaaaaaacaattctggcggcgacgcttgccgcgctgaccctgactatattgcctgcgcaggcgcaggacgccccgcagggttatcagttgcagcaagtgctgatcatgagccggcacaatcttcgcgccccgctggcaaacaatggcagcgtgctggaacaatccacaccgaacaaatggccggagtgggacgtgcccggcggacagctcaccaccaaaggcggcgtgctggaagtttatatggggcactacatgcgtgaatggctggcggagcaaaaactggtgacgtccggcgagtgtccggcgccagaaagcgtatatgcctacgcgaacagcctgcaacgtaccgtcgccacggcacaattttttatcaccggcgcgtttcccggctgcgacattccggtacatcatcaggaaaaaatgggcaccatggatcccgtgttcaacccggtgatcacggatgcctctgcggcttttgaccagcaggcagtgcaggcgatggaaacgaagcgtaaagaattccagctcggagagagctatcagctgctggaaaaaattacccattatcaggattcaccagcctgtaaagaaaaacagcagtgctcgcttgccgaagcaaaagatgctttcagcgcaaaatatgagaaggagcctggcgtctccgggccgctgaaagtgggtaactcgctggtggatgcctttacgttgcagtactacgaaggtttcccgatggatcaggtagcctggggcgaaatcaaaaccgatcagcagtggcgggtactatcgaaactgaagaatggctatcaggattcgctgtttacgtcgccggaagtggcgcgaaacgtcgcggcgccgctggtgaaatatattgaaaaggcactggtggatggcgcaggcgggccggcaaaagtcaccctcatggtcgggcatgattcaaacattgcttcgctgctgacggcgctggatttcaaaccctaccagttacacgatcagtatgagcgcacgcccattggcggaaaaattgtcttccagcgctggcacgataccgcgggcaaccgcgatctgatgaagattgaatacgtctatcaaagtgcaaaacagatccgtaatgccgatgtgctgactctcaccgcaccggcgcagcgggtcacgctggcattaaatggatgcccggtagatgcggagggtttctgtgatatccagaaattcaatgcggtgctgaaagcggtaactaaataagatgggaactcccccgccagtgggcgggggaagacagatcagacgttcttacgttcgatggtttgttcgccccagaacaacgaatctttgtcggttttcttgaaggccaggatcaacacttcgtcattgccttcttcccagatttgctctgcgagcttttcgtcatagttggcgagttcgaaaatggcttcagcgatttctggtgaagtattgcgcagggtggcaaattcacccacgcgatgggctttggcttcttgagttggcatgctacgtcctcctgtcagattagtgtttcagtttcacggcaagaccggccacgtattcgccctgatagcgggcaatagccagttcttcggcgctgggctgtcgtgagccgtcgccaccggcaatcgtcgttgcaccataaggtgttccgccgcgcacctgtgaaacatcaaaaagttctttcgccccataaccgatgggcacaatcaccattccatgatgcgcaagcgtcgtccatgtggaagagatagtgtgctcctgaccgccgccagtacctgtagaactgaatacgctggcgatcttaccgtgcagtgcgcctgacgcccacaatccgccggtctggtcgaggaaggtgcgcatctggcccgccatattgccgaagcgcgtgggcgtgccgaagataatggcgtcgtaatccgctaattcctgcggtgtcgctactggtgcggactgcgctttaccccctgatttcgcaaaaagctcaggcggcatggtttcaggcacgcgtttgatggtgacttccgcccccgccactttttccacaccttctgcaatggcctgcgccattgtttcgatgtgcccatacatggagtaatagagcaccagtacgcggacattcgcgccatctgtcgtttgcatgtctctctccttcgctcaacaaatcacaaaataagcgtagcacatggagagttttcgcttatctatcagacgggtcttaggagatcgccgggagtcgtttgagcttcagatttaaatggcaggcattgttgcaaaatgaaacatttttgccgcttcggatttcgcaagtcataagaaaggcttatcaatgtccacgataaattaaatcctgaacggccagtatgatgttgcagaatattaacaacgggtagccggatggctgatgctggctaagctttagtcatgcgatgcgataaacctttccggttcgtgtcgtgaatgggaagtaattccgtgaacgtaatgcagtatgatgtctaatgtttaacaattctggaggtcagaaatggcaaaccatcgtggtggatcaggcaatttcgctgaagaccgtgatcgagcatcagaagcaggtcgtaaaggtggccagcagagtgggggtaatttcaaaaataaccctgaacgcgcatccgaagcgggaaaaaaaggggggaaaaatagtcacggcagccgcggtaacagcgagtagcgctgcgtagctaagacgagtaacacgcctgttatttattatcgcgtgtgaagcgtccccgccgccggattatccggcggttttttttgcccgcaatctgtattcagttaacaggacgcattgccggaaacaggatcacgtcgcggatggtcggtgagtctgtaaacaacatcaccattctgtcgatcccaatccctaatcctgcggtcggcggcaggccatactccagcgctgtcacataatccgcatcataaaacatggcttcatcatcacccgcatcgcgggatgccacctgctcccggaaacgctccgcctgatcctccgcatcattaagctcagaaaaaccgttgccgatttcccgtccgccaataaagaattcaaagcggtcggtaaaatgcggattatcatcgctacgacgagccagcggcgagacttctgccgggtattgcgtgataaaggtcggctgaataagctggctttccgcgaccgcatcaaatatttcggtgatgagccgcccgtgtccccaactggcttccgggacaatacccagtttgtcagccagggcggcggtaagggcaggggaatccagctcttccatcaggatcccgctaccgtatttgacgatggcttctttcatcgtcaaacgggtaaagggcttgccgaaatcaaaggtgtgatcgccgtaggtcacctctgtggcgcccgtcacctccagcgccagcgtccggaacagcgcctcggtcagctcgatcagatcctgatagtccgcataggccatgtaaagttccatcatggtgaactcgggattatgacgcggggaaatgccctcgttacggaagttgcgattgatctcgaacacccgttcaaagccgcctgccaccaggcgtttgaggtagagttcgggagaaatgcgcagaaacatctgctggtcgagggcattgtgatgcgtaataaacgggcgcgccgacgccccgccagggatcgtttgcatcatcggcgtttccacttccataaactgacgggcgtgcataaagctgcggatggccgccatcattttggaacggatacggaacgtgctgcgtgttttttcgttagcgataagatccagatagcgctggcgatagcgacgctcctgatcgattagcccgtggaatttgtccggcagcggcctgaccgctttggtgagcagacgtaattcagtacactccacggtcaactcaccggtttgcgttttaaacagcaccccggctgcgccgataatatccccctgatcgaacattcgcagatgctgttcatagcgcgtcagaccaatgccttttgcgctgatatacagctgaatgcgcccgcccatatcctgcaatgtaataaacgccgctctacccataatccggcgcgtcatcaggcggcccgctacgcgcacgacgatcttttgcgcttgcagcgtttctttgctgaagggatcgtaaagctgatgcagacggtcggccgtggcatcgcggcggaaatcgttcggaaaggcgttaccgttgcggcgcaactgcgccagtttttgcatacgcgcgctgaactcatcgttcagcgtctgcgtttgacccgtcgtgtccatacttgtgtcagcctctttaatagtggtagctgacaggcactttactgccgggagggtgaggaatgcaagtaaaatgatcttcatggagatcgttttgatctccattggcgtaacatgttactcgtctttcgtaccgtaagagtgttttatttcgtccatcagtgatgacgcctgtgcgtagaaacgctcgcgctggctggtggataggctataaagctgctgttcaaaatcactctgcaacagtgaatcatgcaggatccctttcactccctccttgtgaatgactttcagcaacgcctccacttcatttttatccagcgagttgaataccatcgaccaggcgaattccagcggatccttcgtggggcgattttccccggtagtcgcgccattgtcggtcagtaacgccggtggttccttgtgtacgccagaggccagccattccacggagacgccttcccggtcagcgatttttttcgccatgctcagcgagggctcagtaccacggttgaggtaattgttaagtgtggagtaagagagatcccacgctttcgccacggagcgcgtgctgcgtgaaccaatgagcaatcgcagccggtaggccagtccttctacagacgtatcttcatcaccagtcaggggttcattcttcatcgtcttccatcctgcctcatacaactctgcaagttgatgcgcaaagcgaccaaaaatatgcgagacgtgccgcatttatccgattcaggactttttatcgcctcaaaagagatcaatgctatgtctgcttcgttacattgagttcaacccatagggttatgccatggggtaaaagaaagaggttaatcgaataatggctacaaatgaagagcatagggactggaaccggatagatattgtcgccgcgctgcacaagcagggcgtttctatccgtgaactctctgtgcgtgccgggctgaaacccgacacgctaaaaaatgccttatcccgcgcctatccaaaagctgaacgcattatcgccgatgcgctgggcgttgcgccggaacatatctggcccagtcgttatttgaatggcacccgcaagtctgcggaagattcttcactaatcaattaacgctgaaacaaggaggggcaatgcgctgaaaataataaccgctacggcacgatcattaaataaacacacagcttttattatacagagatggaatgatgaataatcccggaaataaaatgggagtcatgcatctgaccatattaaccgcggttaatatgctggggtcaggtattattatgcttcccactaaactcgccgaagtcggtacgatgtctattatctcctggctcgtaattctgcctgggtgccttacaccaatttcagcccaatttatcaggggctctgcggcatgagcggtaaccggataccgggaaaggtgatctacgaaacccagtctacgcacaaactgctctgctgacgccgggtatggatcgcctgggcaacatggaggagcagggtattccggcctctgttgtggcgaaatacctcgatcagcaggggattatcgtcgagaaaaccggtccctataatctgctgttcctgttcagtattggcattaacaaaaccaaagcgctgcgtctgatgcgggcgctgaatgatttcaaacgcgattacgaccgcaacctgcacgtcaaagagatgctgccttcggtataccatcagtagcccgcattttacggcaatatgcgtattcaggtgctcgccaccggcattcatgccctgatccgtcaacaccgtctgcccgagctgatgtttaacgcctttgaaactctgccaaccatggtgatgaatccgcatcattatcctggtttcgaaaccgatattcatggcgcgtatcgccagccggatggtcgctatacggtgaaagtcatcaaaaacctgcgttaatctcactgtccgccatgcccggaacgcgaggggcatggcggttttttttgcttccggtgttgaactccgcaaaccgccatcgcacactacagcgctgatttcattactggttgtcgcatggaaactttcttgtcccgctattccttctccgtcaaaccgcaggaagccctgctgatccttatcactatgttctggggcggcaccttcctcgccgtgcaatatgcggtgacgatgagcggtccattcttttttgtcggcctgcgttttgccactgccgcgctggcggtggccttgctgtcgctgaaagtgctgcgcggcgtcacctggctggaagtaaaagccggtgtggcaatcggggtatccattgcgctgggctatagtttgcagacatggggattacagaccatctccagcagtaaatcggcgtttatcaccgccatgtatgttccgctggtgccgctgttgcagtggctgtgcctcggcaggatgccggggctgatgtcctgtatcgggatcctgctggcctttaccggtttgatcctgctggccgggccagggggcgatctgctggtgccgggggagggggaactgattaccctggcaagcgctgtggctatcgccgcagaaattattcttatcagcgcctgggccggaaaagtggacatccgccgggtgaccattatccagcttgccaccgcctcactggtggcgtttttcgccatgatccctgccggggaagccgtgccgccgttgtcgcctgcgctgctgggtgtcgggctgggactgggcattttcagcgccattattcaggtggtaatgaactgggcgcagcgcagcgtctccccgacgcgggcaacagtgatctataccggcgagccggtatgggcggggatattcgggcgtattgccggtgaacggctgccgctgctggccctgctgggcggcgtctttatcgtactgggcgtgctggttagcgagctgaagttcaacaagaaaaagggcgtgagcgaatgacccggggcgaagtaaaaaagagcggtaaacggtcgcaggcggtgagcgagaaaagggcggcgatccttgctgcggcgctggcgctgttttcccgctcgggcatccacggcacgcgccttgaacaggtggccgagcaggcgggcgtctccaaaaccaatctgctctattactacccgtcgaaggaagcgctttatgtcgccgtactgcaacagatccttgatatctggctggcgccgctgaaagccttccgggaagattttgcgccgctggtggcaatcaaagagtatatccgcctgaagctggaagtctcccgcgatcacccgcaggcctcaaggctgttctgtctggagatgttgcagggcgcgccgctgctgaaagcggagctgaccggggatttaaaagcgctggtggacgcaaaatcggccattatcgccggctgggtggagagcggtaagctcgcgcctgtcgacccgcatcatctgatctttatgatctgggccgccacgcagcattacgctgattttgcgccccaggtggaagcggtaaccggggcgacattacaggatgctgagtttttccagcgcacggtggataatgtccagcggatgatcatcgaagggatccgcgcacgttaattccccggcggcagcggacagctgagatcgccttcctcacactgtaacagcgaggccagccaggcttcgcgctcgacggttttatcatgcagacactgattgttgatcatcggctgcacgctgccgccttcagtggcggagctgataaaggcgcagtcggcgtcgcgcatggtgatccacgcctgttgcgcttttttgagcagctcgcgctgcggcgcgtcggcgcgtttcatggcggtgctgtaggtgtcgttgagttttttatccgccgcctgatattgcgtggcggtgcagctgttcagatcggcctgcgtgctggcgctggcgcagtcatccgcgagcgccggggcgcttaacagcgcagcagcaaaaaagagggatgtgcgtttcatcatgtctcccggagtagcgaaaacaaaagcctacacggtcaggcatggccgggcaagcctgagctgacggggtttatgtcgggtggcgctacgcttacccgacctacagatcgaacggtggttatgtcgggtggcggcttcgccttacccgacctacaaactacaaatctaatggtagataccgtaggcccggcaagcctgcgccgccgggcacccatcacaacttaaccgatggtcatcaggctggcgttgccgcctgccgctgcggtgttcacgctgagagaacgctccacgcacagccgctccagcaggatattgctttcgccgcgggcaaagccctgcaccgacacaatcgccccttcacgctccgccacctgctcgcaccaggcgcgcagctgatcggaatcgccgtggaagatcaccgcatcgaatgcctgggccgcgagggtttccggcgcggcaagctgaatacgcgcagtcaccgcctgcggcagacgtttttgcagatcgcgatgcagaccatcttccggccacagcacctgactacccaccgacagcaccgccgccagctgcgtcagcgcatcctgttcgttatcggcgaggcacagcacgcgctcacgcggtaacagggtccaggtattacgctcaccggtcggccccggcagcacccgctgcgtaccactctgcgcctgttcagcaaactgtgcgcacagcgtctgcaactccgggttgtccttcgcccagctctgcaatgccgccagcggctgcgcgagcagggttttcagctgcgtatccacggcctgcccggcatcatgacgggtgagtgtggtggtcacggcggtttccggacggctggagagcaggcggtacagatacagcgggccaccggctttcggtccggttccggacaagccttcgccgccgaacggctgcacacccaccaccgcgccaaccatattgcggttcacgtacaggttaccgacgtgcgcgctgccggtgactttggcaatggtttcgtcgatgcgcgtatgcacgcccagcgtcaggccatacccggaagcgttaatttgcccaatcagcgcgtccagcgtctcgcggcgataacgcaccacgtgcagcaccgggccaaacacctcttttgtcagttcgtcaaagcgctccagctcaatcagcgtcggcggaataaaggtgccggtgttccactctttcgcgtcttcacggttgtcatacaccgcctggaacaccttgcggcctttggcgcgcatggtctgaatatgattttcgatgctggctttggcttcggcgtcgataaccggaccaacgtcggtggagagacgctccggattgcccatgcggcactccgccattgcgccgcgcagcatggtcagggtatgatcggcaatgtcgtcctgtaagcagagcacgcgcagcgcagagcagcgctgaccggcgctgtcaaaggcggatgccagcacatccaccaccacctgttcggtgagcgcggaagagtcgacgatcatggcgttcatgccgcccgtttcggcgatcagcggcgttgggcgtccttgcggatccagtctggtggcaatggtgcgttgcagcagcgacgccacttccgtggagccggtaaacatcacgccgcgcacacggctgtcggcggtcagctgcgcgcctacggtttccccgcgccccggcagcagttgcaccacacccggcggcacgcccgcttccagtaaaatcgccacaccagccgcggcgatcagcggcgtctgctcagccggttttgccagcacgcagttgcctgccgccagcgcggcggcgatctggccggtgaaaatcgccagcgggaagttccacgggctgatacagaccaccggccccagcgggcggtgggtttcgttatcaaaatcgtggcgcacctgatccgcatagtaatgcaggaagtccaccgcctcgcgcacctcggcgatagcgttgctgaaggttttgcccgcttcacgcaccagaatgccgatcagctgctgcatctggccttccatcagcatggcggcgcgttcgaggatcgccgcgcgctcctgcggcggggtggcgaaccagattggcgcctgatccaccgcgcttgccagcgcgcgctccacttcggcggcggtggcttcgcgggtatagccgacaatatctttcggctcggcagggttaatgaccggcgtcagttcgcccgtctcacagggctgctccagcaccggcagcgcctgccattgttgctgggcgctgttaagcagggcagaggagagggacgccaggcggtgttcattcgccagatccagcccggcagagttgacgcggccattggcgtacagctcgcgcggcagcgggatcttcggatgcggcagtcccacctggccttcctgggcggcgagtttttccacggccttcaccggatcggctaccagctcatccagtggcagggtggtatccgcgatgcggttaacaaaggaggtgttcgcgccgttttccagcagacgacgcaccagataggccagcagggtttcatgggtgccgaccggggcataaatacggcaggggcgattgagtttgccgtcggccactttacccaccacctgttcatacagcggttcgcccatgccgtgcaggcactggaactcatactgacccggatagtagttctgaccggcaagctgatagatcgccgccagcgtgtgagcattatgggtggcgaactgcgggtagatcaggttcggcacgccgagcagtttcttcgcgcaggcgaggtaagacacatcggtgtacaccttacgggtatataccggataaccttccagaccttccatctgcgcgcgcttgatttcgctgtcccagtacgcgcccttcaccagacggatcatcaggcgacggcggctgcgaccagcgagattaatcagataatcaatcacaaacgggcagcgcttcatgtacgcctggatcacaaagccgatgccgttccagcccgccagctccggctcgaagcagagtttttccagcaggtcgagggagatctccaggcggtcggcttcttcagcatcaatgttaatgccgatatcgtactggcgcgccagcagggtgagcgacttgagacgcgggtacagttcttccatcacgcgatcgtactgggcgcggctgtagcgcggatgcagcgccgacagcttgatggaaatccccggcccttcatagatcccgcgaccattagaggccttgccaatggcgtggatcgcctgctggtaagaaaccatataggcctgggcgtcagccgcggtgagcgccgcttcgcccagcatatcgtaggagtagcggaagcctttatcttccagcttgcgggcattagccagcgcttcggagatggtttccccggtaacgaactgttcacccatcaggcgcatcgccatgtccacgcctttacggatcagcggctcgccgctcttgccgatgatgcggttaagggagcgggagaggctggcttcattatgggtggacaccagacgtccggtaaacagcaggccccacgtggcggcattgacgaacagcgacgggctgcggccaatgtgcgactgccagttaccgttgctgatcttgtcgcggatcagcgcatcgcgcgtggctttatccggaatacgcagcagcgcttccgccaggcacatcagcgccacgccttcctgggaagaaagggaaaactcctgcaacaggctttgcaccataccggcgcggccgctggcggttttctggttacgcagtttttccgccagttgataagccagcgaatgggcggcgctcgcgaccggctcaggcaggcgcgcctgttcaagcagcataggtacggcatcggtttccgggcggcgatacgcagccgtaatggtggcgcgggtcaccgactgcggcagaatgtttccggcaaattccaggaagggctgatgcggttcttccgtggcttcactaatctcttccgcttccgcagtttccgcgttaaaaggcgcagcaaactccgctggcgtaccctcggtttccagcttttcaaggtaattaaaaatggcctgtttgatcagccagtgcggggtacgatcgatacgtgaggcggcagttttaattctttcgcgcgttgcatcgtccagcttaacccccatggtggtggcgcccatgtgcgtgactccctttattctgatgtcataccgtattggttaacctgaaatatccactatgttgcaactttgtgcaaccatgttaattgtgacctcgccagcaagctaataaatggcttaattgttaatgaagggtaatgctatttaacgaccttgcgtcgccgtctcacgccttaaaacatgcggcgcttaacactttttcaaggtgcaacctttaaaagcgtgagcgagtgcaacctggcaataaaaaggcataaaacagggatgaaattgatgtgaatggtgtgttaaatcgattgtggttcagaaacgcttccggcaggatacggtcgccccataaaacaatgacgctttttccacgttccggagaaggtgcccgcggcaagcattttatttgccgacgaataaatctggagatcttttcatggcagttagcacaccaatgatggtgacgtttttaatttatatctttggcatgatcctgatcgggtttgtcgcctggcgttcaaccaaaaactttgacgattatattctgggcgggcgtagtcttggtcctttcgtgactgcactttccgcaggggcgtccgacatgagcggctggctgctgatggggctgcccggggcgatttttatttccgggatctccgaaagctggatcgccatcggcctgacgctgggcgcatggatcaactggaagctggtggccgggcgtctgcgcgtgcacaccgaagccaacaataatgccctgacgctgccggattatttcactggccgttttgaagataaaagccgcgtcctgcgtattatttccgcgctggtgatcctgctgttcttcaccatctattgtgcatcaggcattgtggcaggcgcgcgtctgtttgaaagcactttcggcatgagctacgaaaccgcactctgggcgggggcggcggccaccatcatctatacctttatcggtggattcctcgcggtaagctggactgataccgtgcaggcgagcctgatgattttcgcgctgatcctcacgccggtgattgtaattatctccgtgggcggttttggcgattcgctggaagtgatcaaacaaaaaagcattgaaaacgtcgatatgctgaaagggctgaacctggtggcgatcatctcgctgatgggctggggtctgggctatttcgggcagccgcatattctggcgcgttttatggccgccgattcccatcacaccattgttcatgcccgccgtatcagcatggcgtggatgatcttctgtctggcgggcgctgttgccgttggcttcttcgggatcgcttactttaataacaacccgtcgctggcgagcgcggtaaaccagaacgccgagcgcgtatttattgaactggcgcagatcctctttaacccgtggatcgcaggcattctgctgtcggctattctggcggcggtgatgtccaccctcagctgccagctgctggtgtgctccagcgccattaccgaagatctgtataaagcatttctgcgtaaaaacgccagccagactgaactggtatgggttgggcgcgtgatggtgctggtagtcgcgctggtggccattgcgctggcggcgaatccggaaaaccgtgtgctgggcctggtgagctatgcctgggcgggcttcggcgcggccttcggtccggtggtgctgttctcggtactgtggtcacgcatgacccgtaacggcgcgctggcgggtatggtgatcggcgcggtgacggtgatcgtctggaagcacttcgaactgttcggcctgtatgaaattattccgggctttattttcggcagtatcggtattgtggtgttcagtctgctgggcaaagcgccatccgctgcaatgcagcaacgcttcgcggaagcggatgcgcattaccactctaaacctggcgcacccgcgcagggcatccgttaattgtaatttgtgacctcccgggacccggcagcgctgcgctgccgggctattacttcgttacctttccacgctttcctgcttcctgatccttaccctgcaaagcatttacattctgtgattattcaaatcagattttacttgtctttcctcttgccgtaatgataatcactatcattgaaattttacttttctttgcatcagttgacagtcaataacgtttaagggttttccacatgtttgtcccgtttctcattatgttacgcgaggggcttgaggccgcgctgattgtcagcctgatcgccagctacctgaagcgcacccaacgcgcgcgctggtttggtgtgatgtggattggcgtctttctcgccgccgcgctctgtctggcgctgggcattatcatcaacgaaaccaccggcgagtttccgcaaaaagagcaggagctatttgaaggaattgtggcggtgatcgccgtggtgatcctcacctggatggtgttctggatgcgtaaagtgtcgcgtaacgtcagggtgcagctggagcaggcggtggatgccgcattgcagaaggggaaccgtcacggctgggcgctggtgatgatggtgttctttgccgtcgcgcgtgaagggctggaatcggtgttttttctgctggcggcattccagcaggatgtggggatctggccgccgatcggcgcgctggcaggcctggcaacggcagtggtgctcggttttttactctactggggcggcgttcgcctgaatatggcggcgtttttcaaatggaccagcctgtttattttgctggtggccgccgggctgtcggcaggggcgatccgtgcatttcatgaggccgggctgtggaaccacttccaggacgtggcgttcgatatgagcaacacgctcagcacccatacgctgttcggtacgctgctggaagggatttttggttatcaggaagcgccgagcgtcagcgaagtggcggtatggtttatctatctgatcccggcgctggtgctgtttgcgctgccaccccgtaccggcacgcagccatcgcgcatggcgccgtaattattttaaacttgctcaactagttacaacatactatttaagggaaaggtcatggcacttcattttcgtcgtacagcgttgcaggcgggtatcgccacgctgctgtcctgtgcatttgctgcgcaggctgcggatgttccccaggtcaaagtcacggtaaacgataaacagtgtgagccgatgacactcacggtaaacgccggtaaaacccagtttgtgatccttaaccacagccagaaagcgctggagtgggagatcctcaaaggcgtgatggtggtggaggagcgggaaaatatcgccccaggcttcagccagaaactgaccgccaacttacagcctggcgaatacgacatgacctgtggcctgctgaccaacccgaaaggcaagctgatcgttaaaggtaaggccaccggcgatgccgcgcagggcaacgtgctgctcagcctgagcggggcgattaccgactataaaacctatgtcaccaaagagatggacggtctggttgccggcaccaaagcctttaccgatgcggtcaaagccggtgacattgaaaaagcaaaatccctgtacgcgccgacgcgccagcattacgagcgcatcgaacctattgccgagctgttctcggatctggatggcagcatcgatgcccgtgaagatgactacgagcagaaagccgccgatccgaaattcaccggtttccaccgtctggaaaaagcgctctttggcgataactccacaaaaggcatggagctgtacgccgatcaactcaacagcgacgtgctggagctgcaaaaacgcatcagcgaactggcgttcccgccgtcaaaagtggtgggcggcgcggcgggcctgatcgaagaagtggcggcgagcaaaatcagcggtgaagaagatcgctacagccataccgacctgtgggacttccaggccaacgtcgatggcgcgcaaaagattgttgatctgctgcgtccgcaactgcaaaagggcaacagcgaactactggctaaagtggatgcgaactttaaaaaggtcgataccatcctcgcgaaatatcgcaccaaagatggttttgaaacctatgacaagctgaccgatgccgatcgtaacgcgctgaaagggccgatcaccacgctggcggaagatctggcgcagttgcgcggtgtgctcgggctggattaagcagaaatgaaccacgacgaagattacggcgtgagcgagccgtcgcgccgccgtttactgaaaagtatgggcgcgcttggcggcgcgctggcactgaccggcggctgcccggcgcatgcggccaaaccgcagagcgcgccgggtacggtatcgccggatgcgcgcatggaaacccagccgttttatggcgcgcatcaggcgggcattctgacgccgcaacaggcgtcaatgatgctggtggcgtttgacgtgctggcgagcgataaagcggatttgcagcggctgtttcgtctgctgacgcagcgcatcgcctttctgaccaccggcggcccggcgccggacacgccgaacccgcgtctgccgcccacggattccggtattctcggggagtttatcacaccggataatctgaccatcacggtatcgctcggcaaatcgctgttcgacgagcgcttcgggctggccgcccatgcgccgcgcaaactgcaaaaaatgacacgctttccgaatgactcgctggatgcggcgctgtgccatggcgatgtgctgctgcaaatctgcgccaacaccgccgacaccgtgatccacgccctgcgcgacatcatcaagtacacgccggacttgctcagcgtgcgctggaaacgggaaggcttcatttccgcacacgcagcacgcagtaaaggcaaggagacgccgatcaatcttctcggcttcaaagatggtaccgccaacccggacagcaagaatgacgcgctgatgaaagaggtggtatgggtgcaggccagtcaggatgaacctgcctggaccgctggcggcagctatcaggcggtgcgcatcatccagttccatgtggaattctgggatcgcacgccgctgaaagagcagcagacgatttttggccgtgacaagcacagcggcgcaccgctcggtatgcagcatgagcacgatgtgccggactacagccgcgatccggatggcgatgtgatcgccctcgacagccatatccggctggccaatccgcgcacgccggaaacccggtccagcctgatgatgcgccggggctacagctattcgctgggggttactaattctggccaactggatatggggctgctgttcgtctgctatcagcacgatctggaagaaggattcctgacggtgcagaagcggctcaatggcgaagcgctggaggagtacattaagcccatcggcggcggttatttctttgcgctgccgggggtgcctgacgccgatcattatctggcgcaaggcttgctggaagcctgacgccgccaaccctgccggccacggcagggttccttccttacggatcgccgcagcactatcattttttgctatgagcaactcattgttatatttctgtaatataaatgtcagatgctcttagtcacggaagcgctggttgaagttataaaaaagtaatctcaatgttgcacttgtgctaaattgaaaggtaaggaaagcagccagtgttcccggcagtgatgagtcctttcactatggagatcgcgaatggtaaggtcctgtaccggacataacagcaaatcatcccgcaaatcccggtgcggtagatcctctaccggcaatgacttcctcaccgctttattttccatcccctctgaaatccctgatgtatccgatgcggcagatgtcttatctggtcgttctgcggcgtcatgtccaaaagcaagcaatggcttacaaggaagccaaacctcagacgttcgtgcgcataatcgcgtcgctgttgacgcgtgtgatgtaaaccaacaactcaaggtgctatccatgggaagacaaaaagcagtgatcaaagctcgtcgtgaagcaaaacgtgtgctgagacgggattcgcgcagtcataaacagcgtgaagaagaatcggtcacctcgcttgtgcagatgagtggcgtagaatcaattggcatggcccgggactgccgtgatagttcgccaattgccgcgcgtaatgaagctcaggcgcactacctgaatgctattgagagcaagtcccttattttcgcgaccggtgaagcgggctgcggaaaaacctggattagcgcagcgaaagcggcggaggccctcattcataaggacgtggagaggattatcgtcacccggccggtcctgcaagccgatgaagatcttggcttcttacccggcgacatctcggagaagttcgctccttatttccggcccgtctacgatgtgctgctgaaacgtcttggggcgtcctttatgcaatactgcctgcgaccagaaatcggcaaggtagaaatcgcgccgttcgcctatatgcgcggacgtacatttgaaaatgcggtcgtcattcttgacgaggctcagaacgtgaccgctgcgcaaatgaaaatgtttttgacgcgcctcggggagaacgtgaccgtcatcgttaacggtgatgtgacgcagtgcgatttgccgtcgggcgttaagtccggcctgagcgacgcgctggcacgttttgaggaagatgaaatggtaggcatagtccgcttcacgacagatgactgcgtccgctcggccctctgccagcgcacgctgaaagcgtactattaagacagttttttgatgacaaagcccgggataccgggctttggtttttgtagggcaaaataaggacgaaaaaaaagcccgtacgtgagtacgagctcttctttaaatatggcggtgagggagggattcgaaccctcgatacgttgccgtatacacactttccaggcgtgctccttcagccactcggacacctcaccatattgttttgctgccttcccgcagggggcaacggggcgctactatagggattcggcttaaatcggtcaagcaaattttatgcctgccggtgcgttcggttaagcagtgagcgattgctgttaatcactacagttttattacctgcgcgtatatacacgcaaaaaaagcccgtacgtgagtacgagcttttctataaatatggcggtgagggagggattgactcgctgcgctcgccctgcgggcagctttctcgcaggctcgtcagctgtccaaatgcgcaggcgcatttgtcgaaccctcagtcgggggttctcatccctccctctccggggactacaaaagaaaaaagcccgtacttacgtacaggctctcatcctgaatatggcggtgagggagggattcgaaccctcgatacgttgccgtatacacactttccaggcgtgctccttcagccactcggacacctcaccatattgtcatcccgttgttgctgggacggcgctaatgtagggaaatcctcactcagcgtcaatcaactttttcaataaattagcgcgttcagacaaacttccagcaacctgcttcttaatcgcgcgggaattgatttttttatcagcaacgcagacagcccctgcatcaggaagaaatttgttatgctgctacgctgataaatccccttcaaagatagccgcgcggctggctaaaaatcatgcgcttaccaataacagcgccacaacatctggagttgatatggacattcttttctggcatccgacctttgatacccaatactggctaactgaactcaaacgggcgctgccgcaggcgcgcattcgcgaatggaaacccggcgataacgatcctgctgactatgcgctggtctggcaaccgcctgttgaaatgctacagggcagggaactgaaaggcgttttctctctgggcgcgggcgtcgatgcgatattgagcaaactgaaagcgcatccggacatgctgctgccatccgtgccgctgtttcgactggaagataccggcatgggcctgcaaatgcaggaatatgccgtaagccaggtgctgcactggttccgccgctttgatgattatcaggcactgaaacagcaggcgaaatggcaaccgctggaggagtataagcgggaagactttaccgtcggcgtgcttggcgcaggcgtgctgggatcaaaagtggcggaaagcctgctggagtggggattcccgctgcgttgctggagccgcagtcccaagagctggccgggcgtcaccagctttgccggcgaggcggagcttggggaatttttacggggtacgcgggtgctgattaacctgctgccgcgcaccgccgaaaccgaaggcattattaacctcaatctgctcaaccagctggctgatgacagctacttcattaacctggcgcgcggcgcgcatgtggtggaagccgatctgttgcaggcgcttgagcgcggcaagctgaaagctgcgatgcttgatgttttcagccaggagccgctaccggaaaccagcccgctgtgggcgcatccccgcgtaagcatgacgccgcacattgccgcggtaacgcgcccgctggaagccatcgcctctgttgcctggaccattgagcaactggaagccggcaaaccggtaaccgggcaggtggatcgggttcgcggctattgaggatcgcccggctgtcgccgggttttcattataaaggcaggcgatatttgttatccttgcggaaatcaccagaggagagagccatgtatcccgttgacctgcatatgcacaccgtcgccagcacgcacgcctacagcacgcttcatgactatatcgccatcgcgaaaagcaaaggcctcaagctttttgccattaccgatcatggccccgatatggcggatgcgccgcactactggcactttgttaacatgcgtatctggccgcgggtggtggatggcgtggggatcctgcggggtattgaggccaatattaaaaatactgacggcgagatcgactgcaccgggccaatgctcaccgccctcgatctgatcattgccggttttcatgagccggtattcgcgccgcaggatcaggcgactaacactgaagcgatgatcgccaccatggccagtggtcaggtgcacatcatcagccatccggggaacccgaagtatcctgtggatatcaaggcgattgccgaagccgccgccacccatcaggtggcgctggaaatcaataattcctcttttctgcactcccgtaaaggcagcgaagccaactgccgggcgattgccgccgccgtacgtgacgcgggaggctgggtggcgctgggatccgattcccacaccgccttctcgctgggtgattttaccgaatgccgtaaggtgctggacgacgtcgatttcccggaagatcgtattcttaacgtttccccgcgccgtctgctgaatttcctggaatcgcgcggtatgccgccgatccctgaatttgctgaattttaatgtctgttatggaatcaacgaatgaatgagttttcaatcctctgccgcatgctgggctcgctttactatcgtcagccgcaggatccggtgctggccccgctgtatacgctgatccgcgagggcaagctggcagagaactggccgctggagcaggatgagctgctggcgcgcttacaggccagcgcggatctgcctgcgctgaccgcagactacgacgcgctgttcgtcggcgatgactgcaaggtgtcgccataccgcagcgcatgggtggaaggcacaaccaaggcggacgtcagagcatttttgaccgaacgcggtatgccgctgacggatgcgcctgccgatcattttggcctgctgctgctggcggcatcctggctggaagataatgcaggcgaggatgagagtgaagcgctggaaatcctgtttggcgattaccttctcccctggtgcggcaccttcctgggtaaggtcgaagcccacgccaccactcctttctggcgtaccatggcatccctgacgcgcgatgcgctggcggccatgtgggacgatttgcaggacgataccgctgaataacgtgatcaccatcacttatttaatgtaacgagcaattcgttattgcaaataacgtgcggcagatcgcatcttaccggcgcgcatctgctaagatgcgcgccatgaacatactctttgcaatcgcactcactaccggcgttctgtccgcgctctggggttgggtggctgtcactctgggactgttaagctgggcgggttttcttggctcgacggcctatttcgcctgtccgcagggcgggcttaaaggcctgcttattacgctgtgcacgttgctgagcggtgtcgcctgggcgcaactgattatccacagcagcgccatgctgccgcagttgtcgatcgccggctatgccatcaccggcatggtggcctttttcatgtgtatgcaggccaaaaatgtactgttgtcctttgtgcctggcacctttatcggcgcctgcgcaacctttgcagggcagggggactggcggctggtgctgccatctttactggtcgggctgctgtttggtttcgcgatgaaaaatggcggactgtggctggcagggcggcgggctaaagaaagttctggcgcggtggcagcggaataaaaaaggcgtgacgaaaaccgccacgcccgcgcacattattattatcaggactcaggcggtacggccatctggcggtatttctgtagcacggcgtttttcacttcgccggggctttgcaaatcccacagcccgcgatcgataccgtcattgatcaggaagatcaccccggtttcaatggctgacatcaggcacagcattactggttcattagcggtatagccaatttccccctccagcagacgttgataatcaataaagcggaacacgcccgcctggacttcataagacaaaatcgttttgctggtgttgactgacgagaggatctcgccggtgctgacgttaaccacgcgcaggtttaccgccacctgatcgagctgatactgcgtatcgccgccaataccaaagtatcgcgcccccacgccgcccgattttacattgctttcatagccaataatcgagccttcgatcatcacgtttgccgccgtcaacgattgcaggggaacgcgattattcatcgccaccgtgccgttttcctgggcggcgcggataatcttgcgctcgtttaacaggttttgcagaccctgacgctccagcgggataaaccagcgggaatccttcagcgccgtgaccagcatcgccgtggcgctctgcggcaccgccgtggagaagttactcgccggataggctttaaactgcccggtttcatcctgaatgttatacaccgacacaaagactttgccggaagggggtggcagatgcgttaagtcgcgaaaactctgcgcccgtggcatcagggtcggtttggccgcttcttttggcggagcggtcaagcatccgctcaataaacacaccgccagtaaaataagtaagcgctgcatagtcattgtcctgtagtagctgtgtgttaaaaatcggtcgaattgctttgtaaaccggccacctgaatggtcgatgttttgcccgttttacggtcggtgacgtttagctgtaattgcccgtcgttattagcgatatcgacaataaaatcggtggtgaccatccggcctggtttgccggtatttatattggtcagcaggccgcccaacagctgcgactgaatagcctgggtaaagttatccagcgctgacggcgtttcaataccaaaatcatcgtcataactgggatctttataagagttttgcgcctgggcgctattcaataaaaacgcgccgttatttggattccctccaaaattaggattgcgaaactgaaaggtcatatttcctgccgagcacagcggggaaataagcataagggtgacaacggcacaagcgatacgcatgacagcctccggaaaattattaggttttagtattcgtctttcgccagatcgccggtactgagcagagcctgatcaatttgccggcgatccagtgcttcttcggtttgcgctatcgcgatatttacgttgttgtcgaaatcgcgtttggtcggaaataaaaaggtctgataaaccagatcctgattaaccgtaatggtgatccagctgccccagcgcgcacttgggcgttcattgatggttaaattacccgtataactgctttcccatttatcgctaaatgcacgatagaaatcgtgtcccaccgatgacaccgtgtggtcagtcagcaatcccggcacttccacttcaaccgcgtacaggttcccggcagccagcagaagttctgcggctgcaagccaggctatgtaaggtttcatgatgctaacgcctgaggttatcgttagcccaggagaccgcctgcgtacggtttttaaccgagatctttttaaataagttatacagatgcgttttaaccgtgttttcgctgataaacagggcgcgggcaatctcgatgttcgaggcgccgatgcgcagcttattgaggatctctttctcacgatgcgtgagtaaggcagactcagcgctgttatagcgataattacccgagtgggtgatgaggtagctggccagtttctgtgagaagtagcattcgccgcgctggacgctttgcaggccgtccaccacatgcgattcatcctcggtcacataaaaaaccccgttgatatgcggccagttttcaatgtcgcggaaggggtactcgtcgggggtattcagtaacaacaattttatattgttgtttttacggcttaaattttcctgccagtactggataagttttttatccgcttccatcatatcaaagaggatcacgctgccaggattaatatcatccagagatcgttgaatattatggagtttccctgtaattgccagggagttttttaaatgttgtaataaagctgtagcctgtaatgagggtttagtgatcagcaagattgactgagcatgtaaactctggacttcattaaacatgatgaaactccgcttttaggtacatccgcagcctatccccatgacaatatggagacccagaagtactgacagatgttgaactgctgtgtgtaataaaataataagcccgttagtgggcaaaattaacaaagtaaaaacatactgctggtttcaatctagtcattaccaaccttaaatcaagtgttaaacatgtaacaggatgtaaaattaaattattaaatgtgttttttgcatgtttttatccatcggttttaatggttaagttgtacaagttaatacttgtgtatcaaatttaatgtcataaatatttcatgtaacttattgataattaatgcgatatattaaatatgttaaaatttaattgtgcactaatattaaattaccaattccacttttttaatgtgaccacatcgtaaagaaaaagtcgcgtggtgacagattctgtaaaaatcttctttgtaaacgctcaaaagttctatgcaaagcgcaaaaatattcttctggtactgtaaaggtattggtgtttggtgcgaattgtgacagaagtgcaataaatgccagaaagctctccgctccttctcatgctttaaggtgagtatgtggataaaaatacgaatcgcaggtgagatatttaagatatttctccgcacatactctccattgttacgaggcgttaacaaatattgaaatacgttaatgaccccggcagacattatttatgaatgacaatcaggtccaggtgacagcatgaaaaacagactgttatttatggtgttggcaatgttgagtgcgcctggaattaccttagcggcaggttacgatctggcatcttcagaatataactttgcggtgaatgaactgagcagggcttcttataacaaagcagccattatcggtcagcagggtaacaataacagcgctcagctaagccagcagggatcgaaattactggcggtggtttcacaggacggtggaaataaccgggcacaggttcagcagtcaggaaattacaaccttgcgtatgtcgatcagacgggtaattccaatgacgcgactattacgcaaggggcttacggtaataccgcgatgattatccagaaaggctcgggtaacagagcgaatattacgcaatttggtacgcaaaaaacagcagtcgtagtgcagaggcagtcgcaaatggctattcgcgttacccaacgttgaaagcattgagacgcttacatatcaatccgatgggggtttaccatgaaatttatcaaagtggcagttgtagcagcgatcgttgtttctggcagtgcttttgcaggctccattccgcagtatggtcacggcggtcacaatagcggcccgaattcagaactgggtattttccagtacggtagcactaacgctgcgctggcactgcaaactgacgcccgtgattccagcctgaccattacccagaatggtactggtaacggcgctgacgtaggtcagggttcggacgacagcaccatcgaactgacgcagactggctcacgcaacaacgccactatcgaccagtggaacagccgtgattctgaaatcaacgtcaaccagcacggcgtgctgaacggcgcgctggttaaccagactgcctctaactccttcgtggaagttcgccaggttggttttggtaacaacgctaccgctaaccagtactaagacttcagcagtagaaaagaacagggctccggccctgttttttttcatccggagaaacctatgcatccactattattgctggcggcgctctccagccagataacctttgataccgtacagaacggtgacatctacaccattacgccgcaggtgacgctcgcccagtcctgtgtctgccaggtgcagatcagcgccgtccgcaccggcaacggcggacaaagcacctcggtgcagcgtcataccgtcaccatcccggcgcatcagctcactgcgttatcccgtttacgtatgacgctttcaccgcaggataacgtctccattaccgtcaccgttaccgacgggcaatcactgcgcctgtcgcagcagtggggcgggacgagctgatctgctcctctttcagcaatgactggtaagacaatatccctgtcagcggtaaaacactgctgtacacttaccctgtgaacccggttaagagagacgatcatgcactcgcgtataaaggttattaagggtgacatcaccacgcaacaggtggatgtcatagtcaatgcggcaaatccctctttgatgggcggtggcggtgtggatggcgctatccatcgtgcggcggggccagctttacttgaggcctgtaaagtggtgcgtcagcagcagggcgagtgtccgcccggtcatgcggtgatcacccttgcaggggcgctaccggcaaaggcggtgatccataccgtcgggcccgtatggcatggcggcgatcaccatgaagcgcggctgctggaggatgcctatcgcaacagcctgaaactggcggaggccaatggttatcactcgatagcgtttccggctatcagtaccgggatatacggcttcccgaaagcggcggcagcagaaattgcggtcaatacagtttcggaatttctcacccgtcgcccttcgtttggcgaggtatactttgtctgttatgacgatgaaactacccgactttaccagcgcctccttacccaacagggagaaggaggcggcgaataatacacgactggggctggcaatagccccggtctgcgcggcccatccaggggagtgcggtttactggtgctggatgacagcctcgacgccttcgccgcccgctaccggctcgttgagatggccgaacagactctcgacattcagtattacatctgggaagacgacatgtcaggacggttgctgctgtccgtcatcctcgatgctgccagtcgcggcgtgaaggttcgcatgttgctggacgataacaataccgtcggcatggatgacacgctgcgcattctggacgcgcatcccaacgtcgagctgcgcttattcaatcccttttcttttcgcaccctgcgggcgctgggctatctcactgattttgcccgcctgaaccggcgtatgcataacaaaagcttcacggttgacggggtggtgacgctggtgggcggcagaaatatcggcgatgcctatttcggcgcgggggagcaaccgctgtttaccgatctggatgtgctggcgatagggccggtggtgaaagacgtcaccgacgattttgagcgttactggacctgtaaatcggtttccacgctacaggatgtgctggatatcgctgaagaggacatcgtccggcatatccgcatcccggaatcctggtacagcgatgtcaccgcgaaacgttacctgaacaaactggaatccacccgcttcgccacgctgctggaaaccaactcgctgccgatgatgtgggcgaaaacccgcctgctgagcgacgatccgcgtaaaggtcaggggcgggcgcgaaatcatacgctgttgccgcagcgcctcgtcaacgtgatgggcatgccggagcagcaaatcgacatctgttcggcctattttgtccccacgcgctccggtgtggcgcaattgctgcaactggtgcgcaagggcgtcaaaatcgccattcttaccaattcgctggccgccaatgatgtcgctgtggtgcatgccggttacgcccgctggcgcaaaaaattactgcgtcacggcgtggcgctgtatgaactgaaacccacccatgaagggggccgccatccccatgaccgcggcctgaccggtaactccggctccagtctgcatgccaaaaccttcagcattgacgagcgtaaggtctttatcggctcgttcaatttcgacccgcgctcggcgatgctgaatacggagatgggttttgttatcgacagcgaaccgctggcggcacgtatccaccagcgctttgtgcaaagccagcgggatgtggcctgggagctgcgtcttgaccgctgggggcgcattaactggatcgagcagaaagacgggcaggaaatcgttcataaaaaagagccgaaaacccgcttctggcagcgtatgctggtgcgctttgtctaccgtctgccggtagagtggctactctagaggacgagtagccacataggttatcaggcctggctttttaccggctgctgttgcggcttaccggagaacaggaaacgcaacagcggaatgcgcagatgcacttcatagaggatcagcgcgccgcccaccacaaacaccagtcccgtcaaaaagcccagcagattggagtgaatgtgcggggtgatccaggcgccataaaacagcgttaacggatggtgcaccagataaataaacagcgacgcattcacgaaataggtgacgcgggaggactggaaattcagcagacgatgtcccagcgaaaacaccacgttaaccatccacaggcccatcaccatcgtaatcacgctttccgtttcatacatccaggcatcgccgctgccataccgctgattgagcaggtaggcgcaaaacgccagcgtcgagcccagcagacaggcaggggagggggtggtaaacagatctttgagtcgtggacttataaaggtcagcgcgcccagcagaaagaacggcacgtaaaacagcgtctgcatgacggtgaaattaaacaggccatcgctgaggatcggcgaccaggcgatcaacagcgtgcggcgcagcgcggcatagagcacgccgagcagcaaaaacagcaacgtgagtttacccatgccgatgtcagtgaaaaatttaccgggtttgagacggcgctggatcacgccaaacagccagacgccaagggtggtcagcaccaccagcaccagcaggaaccacaggtgagaaaccagttcccagatcagggtgttgtatttgtcataggccgacagcgtatgccagctttccgttttacctttgacatgttgcagcatcataaactgcggcagggtgagcaacggaatggcggttaacatcggaatgccgacacgttcgacgcgcactttccaccagcgttttaccgggtaacgcagaaacagcatgtaggagaaatagccggagatgacaaaaaagacctgcatgcggaacgaatgaataaaatcattaaacagggtcaggccccaggacgggctggcgctgttaacgtgccagacatggctggagtaaataagtgagatatgaaaggggattcccagtaacatcaaccacgcgcggatggaatccagaaaatactcacgctgtgcagggattttgctcatataactccatgcagtatcagacttttcgccttattccataggctaaataaagggtacattcggtggcaaccctacactaagtcagacaatctgtctccaggataaacgcgtaattgataatggtggactttcatttgcttacacactgagccagcgcgcgaacaaagccgggattaagttgtcggaatgccagaacttccattaaaatggatggatcgatttaagcacacaaagggggaagtgcttagttatatgaaacataaacaacaagtgatgaaaatgcgttggttaggcgcagcggtactgttatccctgtactcctcatcgggctgggcttttaccctcgatgatgtagcaaaacaggcacagtcattagccggtaaaggctatgaagcccctaaaagcaacctgccttctgttttccgcgatatgaaatacgcggactatcagcagatccagttcaatcacgagaaagcttactggaataacgttaaaaccccattcaagctcgaattctatcatcagggtatgtacttcgacacgcctgtcaccgtcaatgaagtgacctcgaccgccgtgcgtaaaattaaatacagcccggattacttcaatttcggcaacgtccagcatgacaaggacaccgtcaaggatctgggatttgccggatttaaagtgctgtatcctatcaacagcaaagacaaaaacgacgaaatcgtcagtatgctgggcgcgagctatttccgcgttattggcgcgggtcagacttatggcctctcggcccgcggtctggctatcgataccgcgctgccgtctggcgaagagttcccgcgttttcgcgagttctggatcgagcgtccaaaaccgaccgacaaacgcctgaccatttatgcgctgctggactccccacgtgcggcgggcgcctaccgctttgtgatcattccgggtcgcgataccgtggttgacgtgcagtcaaaggtctatctgcgcgacaaagtgggtaaactgggcgttgccccgctgaccagtatgttcctgtttgggccgggtcaaccgtcgccgaccaccaacttccgtccggagctgcacgactctaacggtctgtcgattcatgccggcaacggcgaatggatctggcgtccgctgaacaacccgaaacatctggccgtcagcagctacgccatggaaaacccgcagggctttggcctgttgcagcgtggccgccagttctcccgcttcgaggatctggatgaccgctacgatctgcgtccaagcgcctgggtcactccgcagggcgactggggcaaaggcaaaatcgagctggttgaaatcccgaccaacgatgaaaccaacgataacatcgtcgcttactggacaccggatcagcttccggagccgggtaaagagatgaacttcaggtacagcatcacctttagccgcgacgaagacaaactgcatgcgccggataacgcctgggcgctgcaaacccgtcgttccaccggtgacgtgaagcaatctaaccttattcgtcagccggatggcaccatcgctttcgtggtggacttcgtcggccaggatatgaaaaaactgccgcaggacacgccggtgacggcgcaggccagcattggcgataacggcgaaatcgttgaacaagccgtgcgctataacccggtcacgcatggctggcgtttaaccctgcgcgtgaaggtgaaagatcctaaagcgacgaccgatatgcgtgctgcgctggtgaatggcgagcagccgctgagtgaaacctggagctatcagctacctgccaatgaataagactactgagtatatcgacgcgctgccgctttctgatattgagaaagcggcgctgccgaccacggacctgcgcgccgtgcacgaagcgctggatgctgagcaccgtcatttcgagcgggacgatgacaccccgctcggctcggtgcagacgcgtctgcaacaggtctggcccgagtccctcggcgaaggtcaactgatcaaagacgatgaaggacgtacccagcttgaggcgatgccgaaagccacgcgttcttccatgttccctgaacagtggcgtactaacccgattggtcgtttctgggatcgtctgcgtggccgcgatgtgccgccgcgctacctctcccgtctgaccaaagagcagcaggagagcgaaaagcagtggcgaatgatgggcacgatccgtcgctacattttactgctgctgacgatctcccagacggtggtcgccacctggtacatgaaaaccattctgccttatcagggctgggcgctgatcaacccgaccgatatggtaggccaggatctgctggtgtcagccatgcagctgctgccttacgtactgcaaaccggcattctgatcctgtttgccgtgctgttctgctgggtatcggctggtttctggaccgcgctgatgggcttcttacagctgctcatcggtaaagataaatacagcatttcgcactcgacggtcggggatgaaccccttaatccggaacaccgtaccgcgctgatcatgccgatctgtaacgaggacgtggatcgcgtatacgcgggcctgcgcgcgacctgggaatcggttaaagccaccggcaatgccgcgcattttgacgtctatatcctgagtgacagctacaacccggatatttgcgtcgccgagcagaaagcctggatggagctgatcgcggaagtgcagggcgaagggcagatcttctatcgtcgccgtcgccgccgcgtgaaacgtaaaagcggtaacatcgatgacttctgccgtcgctggggtaatcagtacagctatatggtggtgctggacgccgactccgtgatgaccggtgactgtctgagcggtctggtgcgtctgatggaagccaatcctaacgccggtattatccagtcttcgccaaaagcgtcgggcatggatacgctctatgcgcgctgccagcagttcgccacccgcgtgtacggtccactgtttaccgccgggctgcacttctggcaactgggtgaatcccactactgggggcacaacgccattatccgcgtgaagccgttcattgagcactgtgcgctggcgccgctgccgggtgaaggctcctttgcaggttctattctttctcacgactttgtggaagccgcgctgatgcgccgtgcgggctggggggtgtggatagcctacgatctgccaggctcttatgaagagctgccgccgaacctgctggatgaactcaagcgtgaccgtcgctggtgccacggcaacctgatgaacttccgtctgttcctggtgaaagggatgcatccggtacaccgcgcggtgttcctgaccggcgtgatgtcctatctgtcggcaccgctgtggtttatgttccttgcgctctcaaccgctttacaggtggtgcatgcgctgaccgaaccgcaatacttcctgcaaccgcgtcagctgttcccggtgtggccgcagtggcgtccggagctggcgatcgcgctctttgcgtccaccatggtgctgctgttcctgccgaagctgctaagtatcattctggtgtggtgtaaagggccgaaagagtacggcggtttcctgcgcgtgaccctgtcgctgctgctggaagtgctgttctccgtgctgctcgcgccggtgcgtatgctgttccacacggtgtttgtggtcagcgccttcctcggctgggaagtggtgtggaactcgccacagcgcgacgacgactccaccccatggggtgaagcctttatgcgtcatggctcgcagctgctgctgggcctggtatgggccgccggtatggcgtggctggatctgcgcttcctgttctggctggcgcctatcgttttctcgctgatcctgtcgccgttcgtgtcggtgatctcgagccgtgccactgtcggtctgcgtaccaagcgctggaaactgttccttatcccggaagagtattccccgccgcaggtgctggtggataccgacaaatatctgaccatcaaccgcgcccgcgcgctggacgacggctttatgcacgcggtgtttaacccgtcatttaacgctcttgccaccgccatggccactgcccgtcaccgtgcaagccaggtgctggaaatcgcccgcgatcgtcatgttgagcaggcgctgaacgaaacgccggataaactgacgcgcgatcgtcggctggtgttgctgagcgacccggtcaccctgtcacgtatgcattaccgcgtgtgggcagccccggagcgttactcgtcgtggatcagccattacgaggcgctgcggttgaacccgcaggcgctcaacggtaagtaagccgcacattaaggaaaataccggcccgcaggccggtatttttttgtctgaatgaataaggagggaggcgtgaaaattttcgctgtcgccattatggcgctgttgctgagcggttgcggcagcattatcagtcgtaccctgccggggcagggtcacggtaaccagtactaccccggcgtgcaatgggacgttcgcgattcaggctggcggtaccttacggtgctcgatctaccgttctcgctggtattcgacacgctgttgctgccgctggatgcgcatcacggcccttatgaataatcagcgctgatcccactcgtcggctgccgcgcggccttcctcggtgtccagcggcggctcaagctgatattcgccttcgtcccactcatgcagggtgttttcttccagccactcctgacggatctcgatctcatcgaaatcacggtcaaacacgctctgcgcggcttcaccggtaagcatcggcagacattcaccgtcatcgctctcttcagctaaaaactctgcctgccacatgatctcaccatcctgaagcacatacttctggatgttaaactgctgtatgttggcgttttcttcatccagttccggattcgccgccagaaactcctcacgtgcagcatcaatggcttcttccagcgtggcatacatagtcattgtcttctccctgtaattggatgtgatgttcagggaaagaatagttgaagatcggaaagtgcaagggcgatcaggcaaaattaagcatcatcacatcgccgtagcttcccgacgacgccgccgcaggctcagccaggagtagatcacgttgaacatcaccaccgaggcggtgaccagaaataccgtgcggaagccatagctggccgagaccgccgcgccaagcagcgggccggtgacgttaccgatatcgcggaacgactggttatagctgaagatgcgcccggcaatctgattggttgagttatagaccagcagcgtctgtacggctggcagcagcgcaccgtccgccgcgccaagcagaaaacgtaatatgcccagctgaaccggcgtctgcacaaaggacatcgggatcagcagcaaaatcgacaccatcagcgcggcgataaggattttttccggcccgatgcgatctcccagtttacccagccggggggcgctgagcagagccgcgacgccgggcaccgaggcgatcatgccgctgataaaggcgatgttgctgacgtcccccgccagatcgcgcacgtacagcgtcaggatgggcgcaatggagccggtggcaacctggataatcatggtggtgacaaacaggctcagcaccagtctggggcttttcagcgaaccaatgacttcacgcgcgtgcagcatctctttcttcgccaccggcgtgaagttttcgcggatgcaaaacagcgtcagtaaaaagcagatgaacagcacggcggcggtgatgaaaaacaccgggcgcaaaccgtagctatccgccagcagtccgcccgccagcgggcctaacagcgccccgctgacgccaccggttgatagtgtgcccagcgcccagccgcttttattgcgcggcatttgcgtggcgatcagcgcattggcgttagggataaatccgcccagcagaccgagacaggcgcgtagcgccagcagttgccagatattctgcgccagccccatcagcatcattaccaccgccatgccgagggccgagcgcagcagcatcagtttgcggcctttacgatccgccagaccgccccacagcggggaagcgacagctgagaaaagaaaggtgatgctgaacaccagaccggaccacatattgagcgcgctgtggccgctgacgcccagctgctctatgtagagcggcagaaaaggcatcacaaggctgaaggccgcgccggtgagaaagcagccgatccaggcaatggcaagattccgtttccagttaaggggcgtcgctgagggtgacataaccgtccggttgcaggcgttaacaggtttaaatagtaagcctgctaatcatacgcctggggagaaggggccgcaaaccggagagcgcttaaagcttaaagcgggggggggggagagaagttgccgggtggcgctgccgcttccccggcttacagatgaatgctaataacgggaaggaacgccttccggacgggtcttgaagcgacgatgcagccacatgtactgctccggggccatcatgatgcatttttcgatcacgccgttcatccaggcggcggtggtttcggcgtcatccagcggcggatcgttttgcggatccagcatcaccagttcgtagcccttaccgccgggtttacggcgcggcacaaagggaacgatgctcgcctgggacattctcgccagcatccaggtgccggaagtggtcgcggcctggtctacggcgaaaaagggcacgaacacgctggcgcgcgggccatagtcgtgatccggcgcgtaccacaccacttcgccgtttttcagcgcccgcaccatgcctttcaaatccttgcggtcgagcatggttttattggagcgcaggcgtccccaggtttgcagcaggtcgattaccgggttgtcattcgggcgataaaccccgatccccggcgtctgcataccaaacatacgtgcgcccagttcgagggtcagaaaatgcaccccgatcagcagaatgccgcgtttctgacgttgcagttcatagaccggctcaaagttgatgatgtccgcccagcgggcgatacgtttgtccgaccagaaccaggccatgccggtttcaaacaggcccatgcccaccgactcaaaattcttcaccaccatgtcgtggcgcgccgcctgactcatttccgggaagcaaagctccaggttacgggtagcgacatgcacacgacgcttcatcaggcgcatcgccagatggccaagacctgtacccatccgataaatcaccgggtaagggagctgaaccagcagccacagcaaaccaataccaaaccaggttaaccagtagcgcggatgaagtaaggcggtggaaaatttgggtagatgtgtcatgtcattcctgtgattcgacaagccgtgcgttaatgccttcgcactaagataaattcaccgacgtttatggcggagaaatcgttctttccagagcctcgttgcctggtattttttctggtgagtgaaatgtagcgcaaaatgtatggatgtaaattaacagtatttgctatatgatgctgcccgtttttcacccatctctcgttattgcaggataagtacaccatgccagtgttacacaaccgcatttcgaatgaggagctgaaggcgcgtatgctggcggaagccgagccgcgcaccacggtctcattctataagtatttcactatctccgatccgaaagccacgcgcgatgccctctatcaggcattaacggcgttaaatgttttcgggcgcatttatttagcacatgaaggcatcaatgcgcaaatcagcgtgccgcaaagtcagtttgatgcgctgcgtgactgcctctatgcctttgatccggcgctggatggtctgcgactgaacgtcgcgctggatgatgacggaaaatctttctgggtgctgcgcatgaaagtgcgcgaccgtatcgtcgccgatggcattgaagatgagacgtttgatgccagcaatgttggggattatctgaaggcggcggaagtaaacgccatgctggacgatcctgacgcggtatttattgatatgcgcaaccactacgaatacgaagtggggcattttgaagatgcgctcgaaattccggcggacacgttccgcgaacagttgccgaaagccgttgagatgatgcaggagcacaaagacaagaaaattgttatgtactgtaccggcggcattcgctgcgaaaaagccagcgcctggatgaagcataacggtttcaacaaagtctggcatatcgaaggcggcattatcgagtacgcccgtcgcgcccgcgagcagggactgccggtgcgctttatcggtaaaaactttgtctttgatgaacgcatgggcgagcgtatttccgacgatgtgatcgctcagtgtcatcagtgcggcgcgccgtgcgacagccataccaactgtctgaatgacggttgtcatctgctgtttattcagtgtccggcctgtgccgagaagttcagcggctgttgcagtgtgttgtgtcaggaggagcgggcgctgccggaagaagaacagcgtcgccgtcgggctggtcgtgaaaacggcaataaaatcttcaacaaatcccgtggtcgtctgaatacccagcttgggatccccgatccggaataaattgttgccgggtgacgcagctgcgcacccggcaatcattctgcattacttcttacgcacgccttccaccgaaataatcagatccacatcctgagacgccggaccgagatcggtagtgatgttgtaatctttcagcttgattttacccgccgcttcaaagcccgcgcgtacgccgccccagggatcatcgccctgaccgatcagtttcgctttcagcgtgacaggtttggtgacgccgttcagcgtcagatcaccggtaatatccagcgcatcgccgtctttcttcactgcggttgacgcaaaggtcgcctgcgggaatttcgccacgttcaggaactcggcgctgcgcaggtgcttatcacgctcggcatggttagtgtccacgcttttggtattgatggtgacgttcactttatccgccgccgggtttttctcatcgaaggtgaaggtgccgtcaaaatctttaaacgtaccgtacagccagctgtagcccaggtgctgaatacggaagttaacgaaggcgtgctggccctctttgtcaattttataatctgctgccacggcagagccggtagtgaacagcagggcgctcagggcgagggcggtaatacttttcttcatcgtcatactccggagtcaggggatgatttacccagcatgcgcttgagggtgtcatctttatcaatgaaatggtgcttgagagcggcaagcgcatgcagcgcggagaagatcaccacgccccaggccagccatagatggatttcacctgccagatccgcctgaaccccggcgtcggcaaaggtggcggggatctcgaaccagccgaaaacgctgatgggttttccgtcggcggtggagatcaggtaaccgctgaacacaatggcgaacagcagggcatagagggcgacatgtccggccacggcggccagacgggtggtgcgcgaccaggatttcagcgccgcaggcggcggcgagatccagcgccacagcagacgcaccaccagccccatcatcagcagaatgccgatgcttttgtgcagttcaggtgcctggtgataccagccgtcataatagctgagcgtcaccatccataatcccagggcaaacatgccatacaccaccagcgccatcacccagtggagtgtcatcgacagcacgccgtaacggcggggagaattacgccattgcatataaatgtccgttttaaataacaaggtgaaagtaaaatggcgcggcgaaaataatattgcaacttataaataacaaaaataaacaatatttttacttattcatttttattgatggattgatggctttggcattcaatgatttcgttataaatcgcggtccggagtggtggcgggcgctacaacagggggttataagttataaccctcattcaaaaatactgggcagaaaagcgcggatcttcaggaaatgtcaatttttgtcaggggattaatcaatataaaagagatagataatatccagtatgcccagcaccagccagaaaatgagatagagcataaaatgctcgcggatattattcataaaaaattcaaatatacgacgcatcgcgttacctgggttcagataatgaaaacaggcccgacgggcgggcctgcggtatcaggatttatcgaaacggctaagggcgaagggcgtcagatcaaaagatggcgtctgcccggcggcaaaacgggcggcaatttcacccagcaccggcgcgaacttgaagccatgcccgctcagtccgctgaccagcagcgtgttgtcatggcccggcagggtgtcgatgataaagtcctcgtccggggaattatcataggtgcaggccgcgccgtgcagacagcagccaatgcccggcaggaactgacgcaggaaaggaaaggcttccgaaccatcggtagccacgctgccaaagggcgtgcgctcctcttctgaagaaataatctgtccgccgttatgcctgccgattttcagcgcgtcatcctcagccggaaaaccgtagaactgatcgccggagggcatctcgccggtaaaggccgggaagttgtttttggcgctgtaacggccatcggcctgataccaggcgaaaatcttgcgtaccggctgcaccggcagggaggggagcagccgcgtgacccaggtgccggcgctcaccagcagcttcgcgccgctgtactgaccgtcggcggtgtcaatggtgacgccgtcatcatgatgatggatagcggtaaccgggcagttaaacagctgggcgcagcccgcttcacgggcgaggcggatccaggttttcaccgccagttcgctgcgcagaaagccggactgtgactcaaacagaccgatatacccttcagggacgcggatctccggccagcgcgccatcagcgctgccgcatcgaggcgttcgacgtcaagattaaattcacgggcgctttgcgccacgtttgcgaggaaagcggaatccgcaggacccaggttgatgacgccggtgcgttcaaagaccgcttcaccgctgtcagcggcaagctcatcccacaggctctgggcgcgcagcaccagcggaacatatttctcgccttcaccataggcgtggcggataaggcgggtgtcaccatgatggctgccgtgctgatgaggcggcagccaggcgtcggtcatcaggacattcagcccggcgcgtgtggcatagtagcctgccgcagcccctacagagccgctgccgacgataatcaggtcatatttcattacgctctcctggcaaattcttcaggcaggagagtaattaacctgtatgggatatacaagccagaaataaatcaggcacccgaatgggtgcctggaggacagaagatactcacgatctagtgtctgcgatactcatctgcctgatagtcaccggattcgatcttggcgatccctgcttccagaatcgaaataaactgacgggcaacttcagtggtgagccacagcgtctggccgacctcagtgtcatcacggtcgggctggcttggggtctgatagtgcaaacgcagcatcatggcatcgtaactgtctacggtgctgatgtcccaccctacgagcggatgagtttgaatgacttcattatttttaaccatttcaacccccatttgcgtacgtgaatacaacgattattgaggttcaatgcgtgtttttctgaagcagcttaagtatatcaataattaacgtgaatgcgttaattattagaactatcggcaattccgtctttttatttaaatttttttgaaagaaacgggcaggagatacgggctgtttttcaccatcctctgatttcaataaggaaatggcggaaaaaaatgcaaaaaagccggggcgacccggcaagaagaacaatgagggtactgcttagtgaggttgtagtttaatcctgtctgaaccagtcatcggcgctttcccaggtttcctggagaatttcgctgacgcggtctttatcttctttcgccgcgccgaacaccgtcaggctgttggcggcggcgaaacgtactgaaactttgccttcgctgtgcggatagtcgtcacagacgcggcgggagagttcctgagccagcgcatcaatagcgcccggcggtaaggcggtggttctggcgatagtcacttcgatacgcatagtagccccctgtataatttactggttatttatacagtcattaccctgcatttacaacagggggcagcgaatttttaacgcttcacgcgccagcgcacggtttctccggcgaggaagggcaccagggtgtcgtcggtaagggcaatgctttccggcacctgctcctcctgacgctccagctccacaaaactctcattgaccggcaggccgtaaaaacgcggaccattcagcgagcagaaggcttcgaagtgcgcaagcgcccccatctcctcaaacaccgtggcatagcttgccagcgccgtcggcgcgttaaagcagcccgcacagccacagcttgcttctttacgatgacgggcatggggggcagagtcggtgccaaggaaagcgcgcgtaaaaccgctggcgaccagttcacgcagcgcctgctggtggatattacgctttaggatcggcaggcagtacaggtgcgggcgcacgccgcccaccagcatatggttgcggttaaacatcaaatgctgtggcgtgatggtggcggccagcagctcattgccgtcgcgcacatagtcggcggcatctttggtggtgatgtgttcaaacaccactttcagacccggcagacgctgacgcagcggctccatcacggtgtcgataaagcgcgcttcccgatcaaaaatatcaatatccgcgtgcgtgacttcaccgtgcaccagcagcggcatgcccagtttttccatgcgcgtcagcaccggcataatggcgtcaatgctggtcacgccgtggctggagttggtggtggcgttagccgggtaaagcttggcggcggtaaacaccttttcgttaaagccgcgttcgatttcgtccggatccagcgtatcggtcagatagcaggtcattaatggcgtgaaatcatgtccggcggggacggcgtcgagaatgcgctggcgataggcgatggcggcatcaacggtagtgatgggcggcaccaggttcggcatgatgatcgcccggccatacagctcactggtgtagggcacgaccgttttcagcatatcgccgtcacgaagatgaatgtgccagtcgtctgggcggcggattttcaaaacctggggttgtgctgtcatgagtgcgctccggcttgcgtggtaatcagtcagtgatggctggttttatgccgggcacaaaggataggcgtaaacgttttcgtttgcatcccttttccgcacaggacgcataaaaaagggcgcctggcgcccctgggttagtcagtaaaagggatgacgatttcgccgggtttgacttcaagccctttcgcgaatttcttcgccagcgcttccccctggctgctatcttccctcagcacataggcgggttgctggttaaagtagttacgcagcgactggttaagatagggcatcagcgtctgaatgacgctctgcattttctgcggcgtgacggtggcatccaccacttccatctcctgcaggtagatttcgcctttctctttattgaaaaccggcagcgctttcagcttcagcgcaatggtggccttctggctgccgaaaagggaattcatatccagattcgcatcgccggtaagggtgactttattgggctcttcgcggccaatcgcgctgctcagattacgcagcacaatgtgcgcgtccgccacgcccggcacgccaatatcgcgggagaaatcgttacgtttttgcagcgcctgattaatttcctgctcacttacggtgtactgggttaacggattacacccggcgagtaaaccactcacaatcagcgtggcggctaagactatcttcttcatcggtttcctcaacatgacacctttatgccaatcgtgacataaaggagcatcccgcaccagtgcggcacatgccagcagaaaacaccgaaaagcatgacgggcgctttcgcacccgtcccgttacgctcagattgccatggatgagagcagattaatctgcgtctgtttggccatattgtcgcggtaatccgccacgcgggtcggccaggtgatgcctgacaccagcgtcaggttacgcagcagcgggaagagatgaatgtcatcctcagagagttcgccattaacggcgttaggcttgacgatgagcttatccagcgcccgcaggtcgtcgctgatgttcttaaccagcccggcggagtgggcgaggtgctccgcaaaatcgccgatagccgcctcctttttcgccacaaaatacgcgcgcgcttccggcgtggcgaactcatcaaagggggatttggcaaagcgcgggatcagcaggcgattcacatagccattcaccttgcgcagccagtcggcaatggccggattctgcgcgccagtgagcagcggctggtggtcaagctgatcaacatagtggacgatatccatgctttccgggagatagcggctgtcgtccttttgcaggatcggcgccatcttctgaccaatcatacgcaccggcgtggcttcgtcatcattgagtaacacgttcagttcgacggggagattcttcaggccgaaaatcatgcgggctttaagacagaacggacagtgatcgtagatatagagcttcacgtttctcctccagatgattgtggttctcactttcagtatggaagagaaaaatgcggctttcaaatcagatgcctggctccggcacctctgtgcgggcgcttttctggctgaactgccaccacaaggcaacaaaggtggcaagaccgattagccccagcatcagccagggcagctccggttgcgccgacagttttccggcgtcaaacagccagccgccgcccgcgtaacccagcgcaccgccaaaagccagccccagtcgactaaagcccatatagctgccccgcgcacgggcgtcagccagatccgcccccagggtttcccgcgccggttcggcgataatcgcgccgagataaaacagacaaatcagcataaacagctgttgcagcgagccgaccatacctaccggcaacaggctgagcgacatcagcagcagcccggccatcaggcgatgctcaaggcgaaaacgcttctcgctccagcgggcgatgggatagagcagggtcagcgacaggcaggcttcaatggcgtacatccatttcaccgcggcaggggatccggcgatatcgttgaccataatcggcagcatcagcatcacctggaccgccagcatgtaataaccggtcagcgtcagcacgtaggtcacaaagcgtttatcgcgcagcacccgctgtagcccttcgcgcaccggcgttttcaccgtcgacagcttccacgccggtaacagccaggcgttaaagcccgcgcagaggataaacagcaccgcgccggtggcgcacaccaggcgaaaatcgtactgcaacagccagcttcccagcagcgcgccaatcaccgccccggcgctgtcctgcatcatcagcagcgagaaaaagcggccgcgctgccggggacgcaccagtttgaccaccagcgccgagcgcggcggatcgaacagcgttccgccaagcccggaaagaatgcaggaaaaccacagcagccagggttcatgcgccaccgccatggcggcaaatccggcggcgcgcagcagcataccggtgacgatcatcggcttggcgccaaagcgatccgccaccgcgccgccgaaaatccccagcccctgctggacaaactgacgcaggccgagggcaataccaaccatcagcgccgcccagccaagctgatcgacaaaacgaatagagataagcgggaagacgacaaagaagcccagcaccaccagcatattgtcgattagcaggaaatatttacccatgctccgtgcctgcgatacgcgggacatctcccctccggggaacaaaaaatcacccgcttattctgcggggtggcgcagcattttcccacccgccgcagcgacaatattttttcatcaaaccaccgctttgattgatgaccttcatcgaaactccattccggcgcagaaaatggtatgttgctgttttcacagaccggcattgcgcaggtatagttaaggaaaaggggtaacaagacgtgagcggaaggagtggttattgatgtttggctatcgcagtaacgtacctaaagcacgcctgaccaccgatcgcctggtagtgcgtctggtgcatgagcgtgatgcctggcggctggccgattattacgcagaaaatcgccagtttctgaaaccctgggagccgatccgcgatgacagccattgttatccttccggctggcaggcccgcctcggcatgatcaacgaattccataaacagggcagcgctttttactttgcgctgctcgatcccgaagaaaaagagatcatcggcgtggcgaacttttccaacgtcgtacgcggatcctttcacgcctgctacctcggctactctattggtcagaaatggcaggggcaggggttaatgtttgaagccttaagcgcggcgatccgctatatgcagcgcacgcagcatatgcaccgcatcatggccaattatatgccgcacaataaacgcagcggcgatttgctggcgcgtctcggttttgaaaaggaaggctacgccaaagcctatctgctgattgacggccagtggcgcgatcacgtgctgacggcgttaacggccaccgactggaccgcagggcgttgacgattatgcatcatctgctgaacaacgaggccgctttagcctccgtatccattactcacacagacgggagaatgaagtgagccgattacgaattggtgtggtagggcttggcggcatcgcgcaaaaagcctggctgccggtgctggcggcggcaacggactggacgttacaggcggcctggtcgccgacgcgggaaaaagcgctgccggtatgtgaaagctggcgtctgccctatgccgactcgctggcgcatcttgccagccagtgcgatgcggtctttgtgcatacctcgaccgcttcacattatgcagtggtcagcgagctgttaaatgccggggtgcacgtctgcgtcgataagccgctggcggataatctggcggatgccgagcggctggtggagctggcggcgcgcaaaaagctgacgctgatggtcggttttaaccgccgctttgcgcccctgtaccgcgatctgaaaacccggctcgaaaaaggggcgtcgctgcgcatggataagcatcgcagcgacagcgtcggcccgcacgatctgcgttttacgctgcttgatgactatctgcatgtggtggacaccgccctctggctggcaggcggcccggcgcagttgcagggcggcgtgctgcacaccaatgacgaagggcagatgtgctacgccgaacatcacttcagcagcgatctgttgcagatcaccaccagcatgcatcgccgcgccggcagtcagcgcgagtgggtacaggcggtgaccgacggcggcctgtatgacgtcaccgatatgcgcgactggcgggaggagcgcgggcagggggtgatccttcgtccggtgcccggctggcagagcacgcttgagcagcgcggatttgtgggctgcgcccgtcatttcatcgaatgcgtgcaaaatcagacggttcccgaaaccgccggtgaacaggctgtgctggcgcagcgcgtgattgaaaaactctggcgcgaggcgatgacggagtaaccgcccgtaacataagccggtagtatttcaccgcaatccaggtagactacccgccataccccccgacgcctgctctgcaggcgttttgccgtcaggttgtggacgaacaacgtaatgaatttattaaaatcgctggccgcagtcagctcgatgaccatgttttcccgtgtactgggatttgcgcgggatgccattgtggcgcgtgtttttggggccgggatggccaccgatgccttttttgtggcgttcaaattacctaacctgctgcggcgtattttcgccgaaggggcgttctcgcaggcctttgtgccgatcctcgcggaatacaaaagcaagcagggcgacgacgccacccgcgtgtttgtctcctatgtgtccggtctgctgacgctggcgctggcggtggtgaccgtgctggggatgctggccgcgccctgggtgatcatggtgacggcgcctggctttgccgataccgccgacaaattcgccctgacatcaaaactgctgactattacctttccgtatatcctgctgatctcgctggcctcgctggcgggggcgatcctcaatacctggaaccgtttttcggtaccggcgttcgcgcccacttttttaaacgtcagcatgattggcttcgcgctctttgccgcgccttactttaacccgccggtgctggcgctggcgtgggccgtcaccgtgggcggcgtgctgcaactggtctatcagctgccgcacctgaagaaaatcggcatgctggtgctgccgcgcatcaatctgcgcgacgccggggcgatgcgggtggtgaaacagatgggcccggctattctgggcgtgtcggtaagccagatttcgctgatcatcaacactattttcgcctcctttctggtttccggttctgtctcctggatgtactacgctgaccgcctgatggagtttccctccggcgtgctgggcgtggcgctgggcaccattctgctgccgtcgctgtcgagaagttttgccagcggcaatcaggacgaatactgccgcctgatggactgggggctgcgtctgtgtttcctgctggcgctgccgagcgcggtggcgctgggtattctggcgaaacccctcaccgtgtcgttatttcagtacggtaaatttaatgccttcgatgcgctgatgacccagcgtgcgctggtggcctattcggtggggctgatcgggcttatcgtggtgaaagttttggcgccgggcttctactcccgccaggacatcaaaacgccggtgaaaatcgctatcgtcacgctgatcatgacccaggtgatgaacctgatattcatcggcccgctgaagcacgccgggctgtcgctgtcgattggtctgggtgcctgtctgaatgcttccctgctgtactggcagctgcgtaagcagaacatctttacgccgcagccgggctgggcgcgctttctgctgcgtctgattgttgcggttgcggtgatgtccgccgcgctggtgggcatgatgatggtgatgccggagtggtcgcagggcaccatggcctggcgtctgctgcgcctgatggcggtggtggtagtgggcgtgatcgcctatttcgccaccctggcggcgctgggattcaaagtgaaagagtttgcgcgtaagacggtataaaaacagcaacagggagtcaaatgactccctgtctgtaactggtaacgcgtacggtcacgatcagatggagattttcttgccgccgcgcgtggtcgaggacgtctgtccgttggccccgtataaccctggctcctgatgcggtttcagcacctcaagcgcttgctggttacggataatctggccttcaagcaaccagccgttgtgctggttaagatcgcgtaaatgctgtgtcttggcggtaatggactgccagcgttctgcaacatcatcattggaagcgcgtctggcgttctgctccgcgcgtcgctgttgctccagatagtccagcgtagcgagcaacgagctcttttcttccgtaatgcgctgcagggcgctgccattgaagtggcctgcggaaagttgctgttgctcagcatccatcacgactttcaggtcgttcaggataactgtcatcttatccagtatttctgacagttgattcatacgcttatttactctgtaagaaactctgtgcttcctgaatcagtgcatcggcgattttgccggtgtccattttcagttcgccgttgcggatcgcggccttcaggctttctacgcgctcaacattaatatcgtcgtcaccggactggaccagacgggactgggcattgctgatggtaacgttagtgctgttagcagtaaccggtttttccaggcgcgttttggttgcctgagtttcgttgctttcgcgctgttgaacagtgttgaccggcttcaggggcgatgtacgttcaatgctcatagtgtggtcctcatcgaggttttgcggcgcagacgcctgccattcatcatatgttgattatttatcggcagatgccgcaaattctttaaagaattatagattaataagaatattcccatcaggaccgaccatcccgctcaccacctggcctgacgccatgcgaacccgggcgttttgcgccacggcagcgttattcatcgcctggccttcgccgttaacgctaaagccgtcgccctgtgcgataacctgcactttctgaccagctttgatacgccaggcctggcgcagcatcgacagctggatcgcctgaccgggggcgacgtcgcgtaaacttaccgcatcctgcgcctgattgatatccagcatggtacgcggcggcagttgatcgagacgaccacgggtgagggtgacgctccccggttgcagcgtactgccacgggttatcggctgcgcggcgacgacataattgcccgtggcctgcacctgcacctgaacgtaacgtttttcattggcgcactgcgccagcacgttcacattcccccagagtttagcacttcccgccacgctgagcgccggttgttcgcaggcgggcagcagatttggcgcgctgcgcacctttaccaccacctcatcgctgaagcctgccagccgctgggcaaaaaacgccgtcagctgcgcattgagatccgccgccagcagcgacgcgctaaaaaacagtaaggtcgcggctaaaccgcctttcagggtgttcatcgcagactcctgcctgtttaaagaatgccgagattctacccgcacaataaatctatcaacgcaataaatagcgacgcattttgcgcttattcagacgatgacgcatggacaacgccatttaagctgtcacctgtcaatttatcatcagcgtaatgtcatcagcgggggagacatgctcgataaactcgatgccgcgctacgttttcagcaggaagcgttaaatctgcgcgcgcagcgccaggaagtgctggcggccaatattgccaacgccgataccccggggtatcaggcacgcgatatggatttcagcagtgaactcaaaaaggtgatggagcgcggtcgtgctgaaaatagcggtgtagccttgcagctgacctctgcccgtcatattccggcgcaggcaatgaccgcgccgtctgccgatctgctgtaccgcattccggaccagccttcgatggatggtaataccgtcgatatggatcgcgaacgtacacaattcgccgataacaccctgaaataccagaccggtctgaccgtactgggtgggcagatcaaaggcatgatgagcgtattgcagggggggaattaacagatggcattactgaacatttttgatatcgccggttccgcgatgaccgcccagtccaagcgtctgaacgtggcggccagtaacctggccaacgccgacagtgtcaccggaccggatggccagccttatcgcgcaaaacaggtggtatttcaggtagacgctgcgccaggcgcggcgaccggcggggtgaaggtctctgaagtgatcgaaagtcaggccccggacaaactggtgtacgaaccgggtaacccgcttgccgatgcaaaagggtatgtgcgtatgccgaacgtcgatgtggtgggcgaaatggtcaactccatgtccgcctcccgcagctaccaggcaaacgttgaagtgcttaacaccgtcaagagcctgatgctcaagaccctgaccctcggccagtaaaggaacaaggcatgtctatttccgttaacgttaatgacactaccgccgccgccggtacttccgccgccacgggcaacagctcgctgaccggcagtaaagcagaagatttacagggcagctttttaacgctcttggtcgcacagctgaaaaaccaggatccgaccaatccgatgcagaacaacgaactgaccacacagctggcgcaaatcagcaccgtgagcggcattgaaaagctgaacaccacgctcggctctatctccggtcagcttaataacaacgcctcgttgcaggccagcacgctgattgggcatggcgtgatgatccccggcactacgatactggcgggtaaagaaaccaccacgccgtttggcgttgaactccagcaggccgccgataaagtcactgccaccattaccgataaagccggtgtggtggtgcgcaccatcgacattggcgcgctgaaagcgggcgtccatagcttcaactgggacggcaccctggcggacggcacggcagcgccggacggttcctataacgtggcgattaacgccagcaacggcaccactcagctggttgcccaaccgctacagtttgcgctggtgcagggtgttacccgcggcagcaacggcaacttgttagatttgggtacctacggtaccaccaccctcgacgaagtacggcagattatctaagccttcatttatcaggagtaagtcatggccttttcacaagcggtcagcggcctgaatgctgcggccaccaacctcgatgtcatcggtaacaacatcgccaactccgccacttacggctttaaatctggcagtgcgtccttcgctgacatgtttgctggttctaaagtcggtctgggcgtaaaagttgcgggtatcactcaggactttaacgacggcaccaccaccaataccggtcgtggcctggacgtggcaatcagccagaacggtttcttccgtctggtcgacaacaacggttctgtttattacagccgtaacggtcagttcaaactggattccgaccgtaacatcgttaacatgcagggtctccaactgaccggctatccggcaacaggtacgccgccgaccatccagcagggcgcgaacccgaccgccatctccgtgccaaacacgctgatgtcggcgaaaaccaccaccactgcggcgatgcagatcaacctgaactcgtctgacaaactgccgaccattgccacctttgatccgaccaacgcggactcttacaacaagaaagggtcggtgacggtatatgatacccagggtaacgcccatgacatgaacgtttactatgtcaaaacggcaaacaaccagtgggatgtgtggacccaggattccagcgtcacaggcgcaacgccggtgaaatctgcccagatggcctttgacaccaacggtaatctggacgaagtgcgtaactacacgctgaacaccaccaccacccctgcaagctgggatctggccgctacgccgaatgcacagccgcaggtcaatatcgtcacgggcgcactgaacggcgcgatcccggcgaccttctcgctgagctggctcggctccatgcagcagaacaccggttctaacaacatcgtggcgaccagccagaacggttacaagccgggcgacctggtgagctaccagatcaacgatgatggcaccgtggtgggtaactactccaacgaacagacccagctgttaggtcagatcgtgctggcaaacttcgccaacaacgaaggtctgcaatccgaaggcgataacgtctggtccgcctccggcgcatccggtgtggcgctgctgggtaccgcgggtaccggtaacttcggttcgctgaccaacggcgcgctggagtcgtcgaacgttgatctgagtaaagagctggtgaacatgatcgtcgcgcagcgtaactaccagtcgaacgcgcagaccatcaaaactcaggatcagatcctcaacacgctggttaacctgcgctaatcgtctgacgggatggcttcatggatcacgcaatatataccgcgatgggcgcggcaagtcagacgctcaatcagcagtctgttaccgccagcaacctcgcgaacgcgtcaacacccggttttcgcgcccagctgaatgcgctgcgtgcggtacccgttgaaggattgtcactgccgacgcgtacgctggtgacggcgtccacgcccggcgcggatatgacgcagggtcaaatggactacacgtcgcgtccgctggatgtggcgttgcagcaggatggctggctggcggtacaggcgccggatggcaccgaagcttatacccgcaacggtaacatccaggttaacccggcaggtcagctgactattcagggtaatccggtaatgggcgacggcggcccgatcgccgtgccggaaggcgcggagatcaccatcgctgccgacggtaccgtgtcggcgcttaccccaggggatccgccgaataccgtgtcgcctgttggccgtctgaagctggtcaaagcggaaggcagcgaagtggtgcgcggcgacgacggcatgttccgtttaagccaggccgcgcaggcgacccgtggcgcgaccttacaggccgatccgaccatccgcgtgatgtccggcgtgctggaaggcagtaacgtgaagccggtagccgcgatgaccgacatgattgccagtgcgcgtcgttttgagatgcaaatgaaggtgatcagcagcgttgacgaaaacgaccagcgcgccaactcgctgctgtcaatgagctaataaacaggaacacccatgatcaactcattatggattgccaagaccggccttgatgcccagcaaaccaatatggacgttatcgccaacaacctggcgaacgtcagcaccaacggttttaagcgtcagcgtgcggtctttgaagacctgctctaccagaccatccgtcagccgggggcgcagtcctccgagcagacgacgctgccgtcaggcttacagatcggtaccggcgttcgtccggtcgccactgaacgcctgcacagccagggtaacctgtcgcagaccaataacagtaaagacgtggccatcaaaggccagggtttcttccaggtgatgctgccggacggtaccgctgcctatacgcgcgatggctcgttccaggtcgatcagaatggtcagttagtgacggccggtggtttccaggtgcagcctgcgatcaccattccggcgaactcgctgagcatcactatcggtcgtgacggtgtggtgagcgtgacccagcagggtcaggccgcgccggtgcaggtcggccagctcaacctgacgacctttatgaacgacaccggtctggaaagtattggtgagaacctctacaccgaaacccagtcttccggcgcgccaaatgacaccacgccaggcctgaacggcgcgggtctgctgtatcagggttatgtggaaacctctaacgtcaacgtggcggaagagctggtaaacatgatccaggttcagcgcgcgtatgaaattaacagtaaagcggtatcgacgaccgatcagatgctgcagaaactgacgcaactctaaggcgtgatccggtgcgctaaccccgcaccggcaccctgtttttgaagatgaaagcaatgtacaaaaccgccgcgtttcgttatccgcttctggctctgctggcaacctcccttaccggatgtgccttgatcccttcgacaccgctggtgcaaggggcgaccactgcccaaccgacgcctggcccggcgccgattgtcaatggctccatttaccagtctgcgcagcctgtgaactatggctaccagccactgtttgaagatagacgtccgcgtaacgttggcgacacgctgaccatcgtgctggcggaaaatgtcagcgccagtaaaagctcctcggcgaatgccagccgcgacggcaaaaccagcttcggcgtcgataccgctccacgctatctgcaggggctgttcggtaatgcgcgcgcggatgtggatgccgacggcagcaacagctttaacggtaaaggcggcgcaaacgccagcaatacctttagcggcaccttgaccgtcactgtcgaccaggttctggtcaatggcaacttacacgttgtgggtgaaaaacagatcgccattaatcagggcactgaattcatccgcttctccggtgtcgtgaacccacgcaccatcagcggcagcaacacggttccgtctacccaggtggcagacgcgcgtatcgaatatgtcggcaatggctacataaacgaagcgcagaatatgggctggctgcaacgtttcttccttaatttatcgccgatgtaactgaggtatcccatgtttaaatctctgattggtatagcgctggtgctggtggcaacgattgcccaggccgagcgtatccgggatctcaccagcgtacagggcgtacgacaaaactccttaattggctacggcctggtggtcggtctggatggtacaggtgaccagacgacccagacgccgttcaccacccagagcctgaacaacatgctctcgcagatggggatcaccgtgccgccgggcaccaacatgcagctgaaaaacgtggcggccgtgatggtcaccgcgcagctgccgccttttgcacgtcagggtcagaacatcgatgtggtggtgtcctccctcggtaacgccaaaagcttacgcggcggtacgctggtaatgaccccgctgaaaggcgtggacagccaggtctatgcgctggcgcagggtaacgtgctggtcggcggcgcaggcgcatccgccggcggcagcagcgtgcaggtgaaccagcttaacggcggccgcatcaccggcggcgcggtagtggaacgtgaactgccaagccagttcggcgcaggcaacaccattaacctgcaactgaacaatgaagacttcaccctcgcgcagcagatcaccgacactatcaaccgttcccgcggctacggcagcgccacggcgctggatgcgcgtaccgtgcagatccgcgtgcccgcgggtaacagttcgcaggtgcgtttcctcgcggatatccagaatatggaagtgggcatgacgccgcaggacgcgaagattgtcattaactcccgtaccggctcggtggtgatgaaccgcgaagtaacgctcgacagctgtgcggtggcgcagggtaacctctccgtgaccgtgaaccgtcaggcgaacgtcagtcagcccgatacgccgtttggcggcggtcagacggtggtgacgccgcagacgcaaatcgatctgcgtcagagcggcggctcgctgcaaagcgtgcgctccagcgccaacctgaacagcgtcgtacgcgccctgaacgcgctgggtgccacgccgatggatctgatgtccatcctgcaatcaatggaaagcgcgggttgcctgcgcgcgaaactggaaatcatctaatgttgaccgacagccgactggcggcgagcgcggcatgggatgcgcaatcgctgaatgaactgaaatcgaaagccgggcaggatccgggggcgaaccttcgccccgtggcccgccaggtggaagggatgtttgtgcagatgatgctgaaaagcatgcgtgaagccttgccgaaagacggcctgttcagcagtgattccacgcgcctgtacaccagcatgtatgaccagcagatcgcccagcagatgaccgccggtaaaggcctcggccttgccgatatgatggtcaaacagatgggcggcgagcaggcggcgcaggccgccgcgtctgaacctgagcaggtgccgatgaagttcccgctggaaacggtcaccacctatcagaaccaggcgctgacgcaaatggtgcgcaaggcgatgccgaaagccccggaagtcaatgatgagccgctgaccggcgacagcaaagacttcctggcccagctttcgctgcctgcccgactggccagccagcagagcggcgtgccgcatcacctgatcctcgcccaggcggcgctggaatccggctggggccagcggcagatccgccgtgagaacggcgagccaagcttcaacatttttggcgtcaaagccacctcaaactggaaagggccggtcaccgagatcaccactaccgaatttgaaaacggcgaagcgaagaaagtgaaggcgaagttccgtgtctacagctcgtatctggaagcgctgtcggactacgtgggcgtgctgacccgcaatccgcgctacgctgccgtgaccaccgccgctaccgccgagcagggcgctcaggcattgcagagcgccggttacgccaccgatcctaactatgcgcgtaagctgaccggcatgatccagcagatgaaagcgatgggtgagaaggtgagtaaagcgtacagcaacgatatcgaaaatctgttctgaaaactctcaagttcagaaaggcgttgccgataatctctatcaggattcatgtctgacagtttataaggaacctccatgtccagcttgatcaacagcgccatgagcgggcttagcgcagctcaggctgcactgaataccgccagtaataacatctccagttataacgtggcgggctatacccgtcagacgacggtccttgcggcagcaaacagtaccctgggcgcaggcggctggactggcaacggcgtatacgtgtcgggcgtccagcgtgaatatgactcgttcatcaccaaccagctgcgtgcggcgcaaacccagagcagcggtctgacaacgcgttacgagcagatgtctaaaatcgacgatatgctctccggcaaaaccaatacgctgtccgccacgctgcaggacttctttaccagcttacagacgctgaccagcaacgccgaagatccggctgcccgtcagacgctgctcggtaaagccgacggcctggttaaccagtttaaagtgactgatgagtatctgcgcgaccaggataagcaggttaacctgtctatcacctccagcgtcgatcagatcaataactacaccaggcaaatcgccacccttaacgatcagatttcccgtctgaccggcgtgggcgcaggtgcatcgccaaacgacctgctcgatcagcgcgaccagctggtcagcgaactgaacaaagtcgtcggcgtggaagtgagcattcaggatggcggcacctataacctgaccatggcgaacggttatacgctggtgcagggcagcaacgcccgtcaactggccgccgtaccgtcatccgccgatccggcgcgtaccactgtggcttatgtcgatgcgacggcaggcaacattgagatcccggaaaaactgctgaccagcggttcgctgggcggtctgctgacgttccgttccactaacctggatcagacccgcaacacgctgggacagctggcgctgagcttcgcggatgcgtttaacacccagcataaagccggttttgacgcggatggcaatggcggtaaggatttcttcaccatcggcacgccgaccgcgctgaccaacagcaaaaacaccagcggtaccacgctgaacccgacggtcagcgacagcaccaaagtacaggcgaccgactataaagtggcctacaccagcaccggctggcaggtgacgcgtctgtcggataacactgcctttaacgtcacgccagacactaccgacggcaccctgaacttcgatggcctgaaaattggcgtatcaggtacgcctaatgtcaacgaaagcttcaccgtgaaaccggtgagcaacgccatcgtcaacatgaagctggcgatctccgacgaatccaaaattgcgcttgcgcaaaccgcgaccggcggcgacagcgataaccgtaacggtcaggcgttgctggatctgcaaaaaagcaaagtggtcggcggcaacaaaacctttaacgatgcttacgcctccctggtcagcaccgtcggcagcaccaccgcgacgctgaaaaccagcagcaccacccagaacaacgtggtgacgcagttaagcaatcagcagcagtcgatctccggcgtcaaccttgatgaagagtacggcaacctgcaacgctaccagcaatattatctcgccaacgctcaggtattacagacagccagcacgctgtttgatgcgttgctgagcatacgctaagtaaggggtgaatgatgcgtattagtactcagatgatgtatgaccagagcatgcggggcattaccaactcgcagagcgaatggctgaagttcggcgagcagatgtctaccgagcagcgtgttaaccgcccgtcagacgatccgatcgccgcgtcgcaggcggttgtggtttcccaggcgcaggcgcagaacaaccagtatgcgctggcccgtaccttcgcctcgcaaaagatttcgctggaagataacgtgctgtcgcaggtggcgacggcgatcacctcggcccagaccaaagtgatcaacgccggcaacgacgcattgagcgatgatgaccgcgcctcgctggctaccgatctgcagggtattcgcgatcagctgatgaaccttgcgaacagcactgacggtaacggtcgttatattttcgcaggctaccagacggataaaccgccgtttgacgccgcgaccggtgcctataacggcggcgctcaggctattacccagcaggttgatgccgcccgtaccatgactatcgcccataccggcactcaggtctttgacaccctgaccggcaatgcggtgaaagagcctgatggttctgcaccggaaaccagcctgtttaaaatgctggatacggccattgcagcgctgaaaaccccggtcagcggcgacgatgccgccaaggcgacctctcaggcggcgctggataaaaccaaccgtggtctgcgtaactccctgaacaacgtgttgagcgtgcgcgcggaagtgggtacccagcttgatgagctggataagctcgacgccctgggcactgaccgtcagttagggttatcgtcgcagatgagcgcgctggtggacgtggactggagttcggcgatttcgtcctacaccatgaaacaggctgcgttgcaggcgtcttataaagcctttaccgatatgcagggtatgtcgttattccagatgaaccgctaagtatcctgatgtaagaaagcccgcgccatcacagcgcgggctttttttatgccggtttacggctgtgtctgtacctgcgtacgggtttccccggcgcgcaggcggatagccagcgcaatcaccccgcagaccgtggcaagagccaccaccgcaggccagcccgccattgagtagactttactgcccagcgccgagcctgcggccatgccgataaacaccacggtaaacagcagggcattcaggcggccacgtgctttaggttcaaggctgtacaccagattctgatgcgccaccaggctggactgcaaacccagatcaaaaccaatggccgacagggcaatcaccaccagctgcgcttcagtggacagcagcggcatgacaaacatcagggcaaaggcgatggtgaccagcagggcgcctaactgagtgacgcgtgccgcaccgactttatctgccagcccaccggccagcggcgcggctaatgcacctgccgcaccggcgatgccaaaagtaccggccaccgcgctgccaaggtgataatgctccagcagcatcaccgccagggttgaccagaaggcgctgaacgagacggacagaaaaccctgagccagcgccgcacggcgcagggctgggtaacgctgccacagctgcaccgtggatttcatcagcgccgggtagctaagctgcgagtggacagcgaaacgcggcagtacgcaccacaacaccacgccaataaaggcaatgctggccgcggcgagctgatacatcacgcgccagccaaaagctgcgccaacaaaaccgctgacggtacgcgacagcaggatccccagcagcaggccggtcatcactgtgccaacggttttgccctgtttgccttccggcgccaggatcgcggcggcgggcacgatgtcctgcgccatggtcgccgccataccgaccagcagactgaccaccagcagggtgttcagttccgacgtcaggctacaggccagcagaaacaccgccagcgccgcgcttttcaacaggatcagcagacggcgatcgtagcggtcgcccagcggcagcagaaataaaattcccagcgcatagcccgcctgcgtcagcgtcggcaccagtcccataccattgatggtgagatgcaggtcactgcccatcaacggcagcaaaggttgcgcatagtagatcgccgcgacgctgaaacccgcgccgatagcaagaataaaaatcaaccagcgtggtacatcaaaaaggggggaatgaccgttcataatagtgtcctctataaggtgtagggtcattttttcctgttccggggtagcgcggtagccagcgcagtggtaaaacggttatacgttaaacgtataggcgtgagaattatgaaacgcactgagcgtatagacagggtggatctgatgcggacttttgtacgcatcgtggaaagcggttccctttctgccgccgcccgccagctggtcaccacccaggccaccgtcagccgtcggttacaatcgctggaaaccctgctcggcgcaaaattgctgctgcgcaccacccacgccatgaagctgaccgatgacggcgagcgctgctatcagcatgcgaaaaacgttatcgacgcctggacgacgctggaagatgagctgagccttgccggagacgagccggtgggcatgttacgggtgcgcgcgccccatgcctttggtcaggaacaactgctggcgccgctgacggcgtttttgcagcagcatccgaagctgtcagtggagtggtttcttaatgataaaagcgtcgactttctcagcgacaatattgactgcgcgatccgcgtgggcgctgaagtggatccgtccacggtgtcggtaatgctggcggaagtaccgcgtcgcgtggtggccgcgccctcgctgctggcaaattatccgccggtggaaaggccgcagcagctggcggcgctgccctgggtggcgctcagcaccttctatcaacacgaggtggtgctgaccgaccggcatggcgcggtggagcatatcccgattacgccaaggcttttcactgacagcctgtatgccacgcgtaataccgcactcaccgggctgggcgcggccattgtctccggctggacggtggaagaggatattcgcgccgggcggctggtggagctggtgccccactggcagcccgcgccgctgccggtacatctggtttatccctgggcgcgttattatccggcgcggttacgggcttttttacagttaatgcgtgatgtgatgcccggacttgcgggaatgcgggtacctggcgggtaagctggagaaatctgcgatgtgagatataaaaaaagccgacccgaaggtcggcttttttacgcaggctgaggattactcaggctgctgcgggcgggtggccggtgctgacgcgtgatgcgttgcactgtgaccaccggccgcgcctttaccgctgaactcaaaagccgggcgtacccagtcgctgtgacgcggcgcttccggaacatactccggcgctggcgcacgggtcataggcgcggtggcggctggctgtgcgctgtgcgctttcaccggctctgcggcaggagcggcaacaggcgctgccacttcttctgctttcaccggcgcaaccggctccgctttcacctcatctgcttcaaccggcagggctgctggcgctgcaacgtcttccgctttagcggtttccgtttcagcggcaggttccgcagcggcaatgatttcttcagcgacagcttcatcggcttcatcaatcaactgcggctcggctgcaaccggggcggcaatggcttcgggatgggtggtttcaaccacaaccggctcaggcgcgctgaccggagtctgcggctcaaccacctgcggctcactcatctgcggttctgctgcctgcgcttcagtggtcacggtttcctgcgcgacttccgcctgctcagctgcggcggtaaccggcagtacagtctgttcgatctgctccgcgatggcttctaccggcgcgttgtcaacgatagcctcttcctgcaccggttccacgctctgggcgaccggataacggatccataccttgccggacgccatttctggcgacgcgcaggcgacggtcatcggcatcggcgactgggtcgggtaacgctcgtcacgataacgacgacggcgctggccgctgacgcgcaggtgacgaggagaacggcgtgaacgacgcggcattcccgcattgtcacgggattccgtcgactcttccccggcagcctgttctgttaccgtaggcagatccacttttgcgatttcggtatgtgccgctggcgcgtcctgaaccggcgcgtctgtaacctcttcggtcaccgcaggggctgcttcgccgaagcgtactttctggctcagctggcgctgtttacggcgcggcagcgtctgcacacgctcttcctgctcaaccacatcctgctcagcttgcggctgcggctcatcgccattcagcactttaacttcctgctgcgcctgacgcttatcatcgttacgacgacggttgcgctcgcggcgggactgctgctgctcgtcacgggatttggttttatccgcctcttcaaccgcagcgaccggctggcgattttcacgcgcttcaccgttctgcgactgcttctcgcgacggttacgacggttatcttcgcggccttcacgattatcgcgggcttcacgattatcgcgtccttcgcggctgtcgttaccctcattgcgatcgcgattatcacggttatcgcaattatcacggcgatcgttgcggtcgcggcgattgttctggcgcggcttacgacgctcctgtgaacgctccggcttcacgtctttaacttcagcttccgctttcacttcagccggtttggcaggttcgtcgtcggcaaagagttttttcagcgcgccaagtatacggctgatgaggccaggcgctgctttttcagcaggcgcggcggcggcaggcttatcagccggcgctgccacagtggcttcaggagctggcggaatttccggcatggcaaaggtagccagcgcaggttgttccggctgcttacgctcggcgtactcttcttccgacggcatcgccatcgcttcttcgtgcagtttaggcagcttgtagctcagggttgaggtttcttcacccttacgcacacgcagcacagagtagtgcggcgtttccatctgatcgtttggcacgatcacgcatttgataccgccctggcgcgcttcaattgcgcttactgctgcacgtttttcgttcagcagataggaggcaatcggcaccggcacgatggcgtgaacttcctgggtattctctttcagcgcttcttcttcaatcagacgcagaatggagagggacagggattcgttgtcacgaatggtgcccgtaccgctacagcgtgggcagacgtgatggctggactcgcccagcgacgggctcaggcgctgacgggacatctccagcaggccgaagcgtgaaatatggctgatctggatacgcgcgcgatcctgacgcacggcttcgcgcagacggttttccaccgcgcgctggtggcgcaccggggtcatatcgataaagtcgataacgatcaggccgccgaggtcacgcagacgcagctgacgggcaatctcgtctgccgcttccaggttggtgttgaacgcggtttcttcgatgtcgccgccacgggttgcccgcgcggagttgatgtcgatggcggtcagggcttcggtggagtcgataacaatagagccaccggacggcagacgcacttcacgctggaaagcggattcaatctgcgattcgatctggtaatggctgaacagcggaatttcaccggtgtacagtttgattttgctgctgaaatcaggacgacccagcgcagaaatgtgctgacgcgccagctccagcactttcgggttatcgatgaggatctcaccaatatcctgacgcaggtaatcacggaaggcacgcacaatcacgttgctttcctgatggatcaggaacggagcagggcggctttcagcggctttctgaatggcttcccagtgcttcatacggaagctgagatcccattgcagcgcttcggctgatttacccacaccggcggtgcgaacaatcagacccatgccgtccggcagttcaagactggccagcgcttcttttaattcggtacgatcgtcgccttcaatacgacgagaaatgccacccgcgcgcgggttgttcggcatcaggaccaggtagctccctgcaagactgataaaggtggtcagtgccgcacctttgttgccacgctcttctttgtcgatctgtacaataacttcctggccttcgcgcagcacatctttgatgtttggacgaccgtgggagctgtaattagaagggaaatattcgcgggcaatctctttgagaggtaaaaagccgtggcgctcggcaccgtaatctacgaatgcggcttccaggctcggttcaatacgggtgattttgcctttgtagatgttcgcttttttctgttcatgtccaggactttcaatatccaggtcgtacagacgctgcccatcaacgagggcgacacgcaactcttcctgctgagttgcgttgattaacattcttttcatcgtaacttactcattattcttacattgacgactaagctacgggcagagtatcgcctttccgggtgtgaaccgatggcctcgtgtctgttcacgtcgccaacctcacggttgtcgtacgcttaagaggcgcagagtgtcggttgcctgtatttcatacggaaaaacagcgcaattattcggggaacagcctgggaaaactctccagagaagattccgtctaccggtaaggactgcaacccgcagcccgctaactgcctgaacgatcaatacgtcttacgccattgctgcgtggatgaacgaacgggcaaaattggtgattccgtaaaattcattgttataacaagcttgaacacggaaagcgtaaacattattccttgctaaccctgttatagcaagatgacttttaccatttatcacccggttactcacagttttttcaccgctgcttcgagattgttctaaaagccatcaaaaagcataacgatgcgcaaaccctaccgggtaatcctaaatataagcatagaaaaatgagtggcgctattcggcgtggctatttagaatcgccaaccatgaaaacagagactccagccgtaaaaatggttgctatttcggctgacgaagccgggcaacgaatcgacaactttttgcgtacccagttaaaaggggtaccgaagagcatgatttaccgcattctgcgtaaaggcgaagtgcgggtgaacaaaaaacgcgtcaaaccggaatacaaactgatggatggcgatgaaattcgtatcccgccggtacgcgttgccgaacgtgatgaagaagccgtgtcgccccatctgcaaaaagtggcggcgctgagcgatgtcattctttatgaagacgatcatattctggtgctcaacaagccgtccggtaccgccgtacatggcggcagcggcctgagctttggcgtgattgaaggcctgcgcgcgctgcgtccggaagcccgtttccttgagctggtgcatcgtcttgaccgcgacacctccggcgtcctgctggtcgctaaaaagcgctcggcgctgcgttcgctccatgaacagttgcgcgaaaagggtatgcagaaagattatctggcgctggtacgcggccagtggcagtcgcatgtgaaagtggtgcaggcgccgctgctgaaaaatattctgcaaagcggcgaacgtattgtgcgcgtaagccaggaaggtaagccgtccgagacgcgcttcaaagtggaagagcgctatgaacatgccacgctggtacgctgtagcccggtgacgggccgtacgcaccagatccgcgtccatacgcagcacgccgggcatcctatcgcctttgacgatcgctacggcgatcgcgattttgatcgccagcttgccggcaccggtctgaatcgcctgttcctgcacgctgcggcgctgaaatttacgcatccgaatacgggtgaagcgatccgcatcgaagcgccgctggacgatcagctcaaacactgcctgcaggtgttacgcaacgcgaagtaacacccgacaggacgagggcttatggcctgagccatttatccagccaggggtaaacctcgtcctgttgttgctgataaaaaacatgcccgagttccggccagcttttggtcactaatctgtcatccgcctgttgcgacgcccagacctctcgggcgcgggcaaaggcatcctcgaccgcctgtggcggaaataacttatctttgccgccgctaaaaatcagcatgggtttcggcgcggcaatgctggcgacatcgggaatatcgagatgtgcaggcataccgggatgaagcatataaaaggcggactgcccgcgcagcacgttattgcccggctgcatcagaccgtcataggtgccaaaccaggaaattactgccgtggccgccaccttgtccgacaaggcggccagctgccaggcgcggaaaccgcccattgagaagcccagcacgccaatgcgtttgctgtcgacgttattaagcgtggtgagaaaatccacggtgcgcatatcttcataggccatttcaccggccagcgagcggccaaggttaaaatagttgctcgccagcgcctgttgctgttcgtacaccagcgggccacgctcgccccagccggtgctgtcgatggcgattaccacatagccacgcctggccagctcatcgccgggaaaacgcccgctgaagaacttgtcggcccacgcctgcgcgctggcgagcgtttcggcattcccccacgggcggatgactttctctttgccaatatcaaactttgaaccgtgatcgtgcaataacaccaccgccggatggggacccgctgctttggggagcagcatcagggcgttaatacggttgtcgtcggtgatgttcagggcgattttgcgggcgaggtaactgccacgatcctcctccatcagcgtctgcggcgcaaatggcttatgtgaatccggcgtcagcagggcgctgcgcaacagctggcgggcgtgctgctgccagcgggtgaagtcagagaaatggctggactgccaggcgtcgggataggtcatctgcgcttttaacgccgccacgttgcccggaagattaccttcgataatgccggtcggcggtttattttccgccatacccgagccgctggttacaaataacatcattgccagaaatgcttttgctgaatatttcatcacccacctttaaattaaaacgcggttttaaaaagtcaggtgatgaataatagagcaatgccggtcttaaaccgtgatccttaaggcattaatataataatggattactgttttcccggcgcagcatctggcacagggcaatcagcggcagacccaccagcgtattggggtcgcgcccctcaaggcgttcaaacagggtgatgccaaggccctcgcttttgaagctgcctgcacagttcagcggacgctctttacgcaggtaatcgccgatctcctgctcgctgaggtgacgaaaatgcacatcgaaaggctcacattcggtttgcagatgaccggtagcggaattataaagcgcaaggccggtataaaaagtaacgatattgccccgcgccttcatcaactggcagtatgcattttcttctgtcagcggtttaccggtaatttcaccatccagtacgcacacctgatcggaaccgataataaggtgcgccggataacgttcggcaagggactgcgctttcgcctgcgccagtcgcagcaccagctgacgcggggtttcgcccgccctgggcgtttcatcgacaccgggggcggcgcactcaaaaggcacgccaattttttccagcagcgcgcgacgataaggcgaagtggaagcgagcacgagatttgacatattttttccaccttttatatagcgtaaccaggtcaggcattttaaactacaggccgcaatgtgtgcgaataattggcaaaaggcaaccgcaggctgcctttttctttgactctatgacattacaaagttaatatgcgcgccctatgcaaaaggtaaaattacccctgactcttgatccggtccgtacggctcaaaaacgccttgattacgagggaatctatactcgcgatcaggctgagcgtgtcgccgaatccgtagttagtgtggacagtgatgtggaatgctccatgtcgtttgctatcgacaaccagcgtctggcggtattaaccggcgatgcgaaggtatcggtaacgctcgaatgccagcgttgcgggaagccgtttccccatcaggtctacacacagtattgttttagcccgatcgtcaaagacgaacaggccgaagcactcccggaagcgtacgagccaattcaggtcaacgaatttggtgaaatcgatctgctggcgctggtggaagatgaaattatcctcaccttgccggtagttccggtgcatgattctgaacactgtgaagtgtccgaggcggacatggtgtttggtgaattgcctgatgaagcgcaaaagccaaacccatttgccgtattagccagcttaaagcgcaagtaacaggttctgcctgttcttacgtggataaccgtaattgaggagtaaggtccatggccgtacaacaaaataaaccaacccgttccaaacgtggcatgcgtcgttcccatgacgcgctgaccgcagtcaccagcctgtctgtagacaaaacttctggtgagtctcacctgcgtcaccacatgaccgctgacggtttctaccgtggtcgcaaggtaatcactaagtaatcacgcttttgcgtgatgaagcttagtgaggatttccccgtgtaagcggggatataccgccttgacacgtctaaccctggcgttagatgtcatggggggcgattttggcccttccgtgacggtgcctgcagcattgcaggcactgaattctaattcacaactcactcttcttttagtcggcgatcccgacgcaatcacgccattacttgccagagctgatttcgaacaacgttcgcgtctgcagattatccctgcgcagtcagttattgccagtgatgcgcgcgcctcgcaggtgatacgcaatagccgtggcagttcgatgcgcattgcgctggagctggtaaaagaagggcgcgccgaggcctgcgtgagcgcagggaataccggcgcgttgatggggctggctaaactcctgctcaggccgattgacggcattgagcgtccggcgctgatgacggtattaccgcatcagcagaagggcaaaacggtggtgctggatttaggcgctaacgtggattgcgacagcacgatgctgatgcagttcgcgttgatgggttcggtgatggcggaagaagtgcttggcattcctcatccccgcgtggcattgctgaacatcggcgaagaagagaccaaaggtctcgacagcattcgcgatgccgcagccttgttaaaatccatcccgtcgattaactatattggctatcttgaagctaacgaattactcaccggcaaaacggatgtgctggtatgtgacggttttacgggaaacgtcacattaaagaccatggaaggtgtggtcagaatgttcctttcgctgctgaaatcgcagggcgaggggaaaaaacggtcgtggtggctgattttattaaagcgttggttacaaaaaagcctgagcaggcgattcagtcacctcaaccccgaccagtataatggcgcgtgtctgttaggattgcgcggcacggtgattaagagtcatggtgcagccaatcagcgagcgtttacagtcgcgattgaacaggcagtgcaggcggtgcagcgacaagtcccttcgcggattgccgctcgcctggaatctgtgttaccggaaaaagactgagcgtacatgcatacgaagattattggtaccggcagctatctgcctgaacaagtgcgaaccaacgccgacctggaaaaaatggtggatacctccgacgagtggattgtcacgcgcacgggtatccgcgaacgccgcattgccgcgcctgatgaaaccgtgtctaccatgggtttcgaggcagcaaaacgcgcgctggaaatgtcaggtattgataagaatgaaattggcctgatcatcgtggcaacgacgtcagcgacgcacgcctttccgagcgcggcctgccaggtgcagagcatgctggaaattaaaggctgtccggccttcgacgtggccgcagcctgtgccggtttcacctatgccctgagcattgccgatcagtacgtaaaatccggcgccgtgaaatatgcgctggtgatcgggtccgatgtactggcccgcacctgcgatccggcggatcgtggcaccattattatttttggcgatggtgcgggtgccgtgctgctcggcgcgtctgaagagcagggcattatctccacccatctgcacgctgacggcagttacggtgaattactgacgttgccgaacattgatcgcgtgacgccggacaacccgacttatctgacgatggccggtaacgaagtctttaaagtggccgtgacggaactggcgcacatcgtcgaagaaaccctggcggcgaataacctcgaccgcagtgaactcgactggctggtgccgcaccaggctaacctgcgtattatcagcgcgacagccagaaaactgggcatgtcgatggataacgttgtcgtgaccctggatcgtcatggcaatacctctgcggcttcggtgccatgcgccttagacgaagccgtccgggacggacgcatcaagccggggcagctggtgctgcttgaagccttcggcggcgggttcacctggggttccgcactggttcgtttctaaaatttaaggataaaaacatgacgcaatttgcatttgtgttcccgggacagggctctcaggccgttggcatgctcgctgaactggctgccgactatccggtgattgaagaaactttccgcgaagcgacagcggtgctgggctatgatctgtgggcgctggctcaacagggcccggcagaagaactgaataaaacctggcagacgcagcctgcgctgctgacggcttccgtggcgctgtggcgcgtatggcagcaggcgggcggtaaaacccctgccatgatggcaggccacagcctgggtgaatactctgcgctggtgtgcgcgggcgttattgatttcgctgatgcggttcgcctggtcgagctgcgcggtaaatttatgcaggaagccgtgcctgcgggtacgggcggcatgtccgctattattggcctggacgatgcggccatcgctaaagcctgcgaagaatctgccgaagggcaggtggtttcaccggtgaactttaactcgccgggccaggtggtgatcgccggtcataaagaagcggttgaacgtgcaggcgcagcctgtaaagcggcgggcgcaaaacgcgcgttgccgttgccggtcagcgtaccgtcacactgcgcgctgatgaagcctgcggcagagaagctggcggcagagcttgagaaaatcacctttaacactccgtcagttccggttgtgaacaacgtggatgtgaaatgtgaaaccacgcctgcggccatccgtgatgccctggttcgccagctgtacagtccggtacaatggacgaagagcgttgaattcatggctgcgcagggcgtggagcacctgtatgaagtcggtcctggtaaagtactgaccggcctgaccaaacgtattgttgacaccctgacagcgtcggccattaacgagccggcggcgatgtcagcggcgcttgagcaataacagaggaaaaccaaaaccatgagttttgaaggaaaagttgcactggttaccggtgcaagccgtggcattggccgcgcaatcgctgaaacgctggtcgcccgcggcgcgaaagttgtcggtacggcaaccagcgaaagtggcgcacaggcgatcagtgattatttaggtgctaacggtaaaggtctgatgttaaacgtgaccgatccggcatctattgaatctgtactggaaaatattcgcgcggagtttggcgaagtggacatcctggtcaataatgccgggatcactcgcgacaacctgttaatgcgtatgaaagatgatgagtggatcgatattctcgaaaccaacctttcatctgttttccgtctgtcaaaagcggtaatgcgcgctatgatgaaaaaacgtcatggtcggattatcactatcggttctgtggtcggtaccatgggaaatgcaggtcaggccaactacgctgcggcgaaagcgggtctgattggctttagtaaatcgctggcgcgtgaaatcgcgtcccgcggtattacggtaaacgttgttgctccgggctttattgaaacggacatgacgcgtgcgctctctgacgaacagcgtgcgggtattctggcgcaggttcctgcgggtcgcctcggtggcgctcaggaaatcgccaatgcggttgcatttttagcttcagacgaggcgagttacatcacgggtgaaactttgcacgtcaacggcgggatgtatatggtttaaccacgttatttcctaaaacacatttagggaataattttatttgcgttatcaggccaaaaggcctcaaaatagcgtaaaatcgtggtaagaactgccgggatttagttgcaaatttttcaacattttatacactacgaaaaccatcgcgaaagcgagttttgataggaaatttaagagtatgagcactatcgaagaacgcgttaagaagattatcggcgagcagctgggcgttaagcaggaagaagtgaccaacaatgcatcttttgttgatgacctgggcgcagattctcttgacaccgttgagctggtaatggctttggaagaagagtttgatactgagattccggacgaagaagctgagaaaatcactactgttcaggctgccattgattacatcaacggtcaccaggcgtaagtgaacatctccaggcggtcattcgaccgcctgagttttatcttttagtcccacaaaatctttttttccctccctggaggacaagcgtgtctaagcgtcgtgtagttgtgaccggactcggcatgttgtctcctgtcggcaataccgtagagtccacctggaaatctctccttgccggtcagagtggcatcagcctgatcgaccatttcgatactagcgcctatgcaacgaaatttgctggcttagtaaaggactttaactgtgaagacattatctcgcgcaaagaacagcgcaagatggatgccttcattcaatatggaattgttgcgggctggcaggccatgcaggattctggcctggaagtcactccggagaacgcagggcgcattggcgcggcgattggctccggtattggcggtcttggcttaatcgaagagaaccacacttccctggtgaatggtggtccacgcaaaatcagcccgttcttcgtgccgtcaacgattgtgaacatggtggccggtcatctgaccatcatgcttggcctgcagggtccgagcatctccatcgccacggcctgtacctctggcgtgcataacatcggtcatgcggcgcgtatcattgcttatggcgatgctgacgtgatgctggcaggtggcgctgagaaagccagtacgccgctgggcgtgggtggttttggtgcagcacgtgcgctgtcgacgcgtaacgataacccgcaagcggcaagccgtccgtgggataaagagcgcgatggttttgtgctgggtgacggcgcaggcattattgtgcttgaagagtacgagcacgcgaaaaaacgcggcgcgaaaatttatgcggaactggtgggttttggtatgagcagcgatgcttaccatatgacctcaccgccggaaaacggcgcaggcgcggcactggcgatggccaatgcgctgcgtgacgcgcagctcgatccggctaaaatcggttacgtcaacgcgcacggcacctcgacgccggccggcgacaaagcggaaactcaggccgttaaatcgatctttggcgagtcagcccgtaccctgatggtcagctcgactaaatcgatgaccggacacctgttaggtgccgcaggggcagtagagtccatctactccatccttgcgctgcgcgatcaggcgatcccgccaaccatcaacctggataacccggatgaaggttgcgacctggattacgtgccacacactgcgcgtcaggtctctggtcttgagtacacgctgtgtaactccttcggctttggtggtactaacggctcgttgatctttaaacgcgtctgatccccgtagcctgaaaaggcccgctctgcgggcctttgttatttccatttcagctttctccgcttgtccttcttctttcatcctgccagactggcgtgccatgcaaacaggagccgctatgttcttgataaatggacgtgaacaagactcgcttgccgcgaacgaccgcgctatccagtttggcgacggctgctttaccacagcccggatccgccaggctgaagtccagctattaccggcccatattcgtcgtctgcgtgaagcctgtgagcggctgatgctgccatttactgactggcaggtactggaagccgagatgcgccatctggcgcacggccatcaacagggcgtactgaaggttatgcttacgcgcggcgcgggcggacgcggatatagcgctgccgcctgtcatgcgccgacgcgcctgctgtccgtgtcccccctgcctgcacactatgatcgctggcgggaggagggcatcaggctcgccttaagcccggtgcgtctcgggcgcaatcctcatctggcgggtatcaaacatctcaaccggctggagcaggtgttgatccgtactcatcttgagcagacgaccgccgacgaagcgctggttcttgacagcgacgggttcattacggaatgctgtgccgcgaatctgttctggcgaaaaggcaatgacgtctttaccccgaatctggatcacgcaggcgtgaacggtattatgcgccagcactgtattgcgcagctggcggcgtcaccctttcgtgtggtggaagtccatgcggcagaagaagccctggcagatgccgacgaagtgctcatctgtaatgcgttaatgccggttattgcggttcgtgcatatggcgaacggacgtggacgtcacgcacgctgtatcaatttttagccccactttgtgagcattcgatttcgtcatgaagaaactgtttcggttcgtgctgatcctcgcggtgatcctggttatcgctgcgggtgcgggtctgtggaaagtccgccagatggcgaacagcccgatccttgtaaaagaagagactattttcactctgaaagctggcacgggccgcatcgcccttggcgatcagctgcatgctgagaagatcattaatcgcccgcgcgtctttcagtggttattacgcgtggagccggatctgtcgcacttcaaggccgggacctatcgcctgacgccgaaaatgaccgtgcgcgacatgctgttgctgctggaaagcggcaaagaagcgcagttcccgctgcgtctggtggaaggcatgcgcctgagcgattatcttcgccagctgcgtaacgcgccctatatcaggcacacgctgaaggacgacagttatcagaccgtcgccgctgcgctcaagttcgacaacccggaatgggtggaaggctggttctggccggacacctggatgtataccgccaataccacggatattgcgttgctgaagcgcgcgcatcagaaaatggtggcggcagtggacagcgcctgggaagggcggatggaaggactgccctacgcggataaaaatcagctggtcaccatggcgtccatcattgaaaaagagacggcggtcgccagcgagcgggaccgcgtcgcctcggtgtttatcaaccgcctgcgcattggcatgcgtctgcaaaccgatccgacggtgatttacggcatgggtgaaaaatataacggtaaactgtcgcgcagcgatcttgagacgccaaccgcgtacaatacctataccatcaccggattgccgcctggccccatcgccacgccaggcgaagcctcattgaaggccgccgcgcatccggccaaaacgccgtatctctattttgtggctgacggtaagggagggcataccttcaacaccaatctcgccagccataaccgttcagtgcaggactatctgaaagtattaaaggaaaaaaatgggcagtaaatacatcgttattgaaggtctcgaaggtgcagggaaaaccacggcgcgcaacgtcgtggtggaaaccctggagcaacttggcatcggcgagatgatcttcacccgcgagccgggcggcacccagctggccgaaaaactgcgcagtctggtgctggatattaaatcggtcggcgatgagatcattaacgataaagccgaagtgctgatgttttacgccgccagggtgcagctggtggaaacggtgatcaaaccggcgctggatcgcggctgctgggtgattggcgaccgtcacgatctctccacccaggcctatcagggcggcggacggggcattgataacgcaatgctcgccacgctacgcgacgcggtgctggggagtttccgcccggatttaacgctgtatctcgacgtcacgccggaagtgggcctgaaacgcgcccgcgcccgcggtgaactggatcgcatcgagcaggagtcgctggatttctttaaccgtacccgtgcgcgctaccttgagctggcggcgcaggacgcaagcattaaaaccatcgatgccacgcaatctctggacgatgtgatccgcgatatccgccacaccgtgaccagctgggtgcgggagcagggcgcatgaaatggtatccatggctacgcccggactttgagcaactgattgccagctatcagaccggacgcggacaccatgcgttattgatccatgcgctgcccggcatgggggaagatgcgctgatctacgccatcacccgctatctgatgtgccagcagccggtggagcacaaaagctgtggccagtgtcgcggctgtcagttaatgcaggcgggcacccatccggactattacgccctgacgccggaaaaaggcaaagcgtcgctgggtattgatgcggtgcgcgatgtcagtgaaaagctctatgagcacgcccggctgggcggcgcgaaagtggtgtggatcagcgacgcggcgctgctcaccgatgcggctgctaacgccctgctgaaaacgctcgaagagccaccggcgaacacctggtttttcctcgcctgccgcgaacctgcgcgcctgctcgccaccctgcgcagccgctgccgtattcatcatttatccccgccgtcagaaagctacgccagcgcctggctggcgcgggaaaccaccgccagccctgaggccagccttgcggcgctgcgtttatgcggcggtgcgccgggtgcggcagcgcaactgttacagactgaaagcgccgcccagcggcagacgctctgtaccgcggtaaataccgcgctggacagcgccgactggctctctctgctgggcgtgcttaatcacgatcaggtggcggagcgcctgcactggctggcctcgctgctgatggacgcgctgaaaatgcagcagggcgcgaccctgctgaccaacgtcgacgcgcagccgttagttcaccgtctggcgcagcatctgccgacggcgcgcctgcaggcgatcctcacggcggtatttcagtgtcgcgggcagttgctggacgtcaccggcataaatcgcgaactgctgttaaccgatctactcttatgctgggagcactatctgcaaccgggcaccgtgcttcctgtatcccacttctgaaagagatcttatgtttttagttgactcacattgccatcttgatggcctggattatcaatccctgcataaagacgttgatgatgtgctggcgaaagccgccgcgcgcgacgtgaaattttgtctggcggtcgccactacgctgccgggttaccgtgccatgcgtgatctggtgggcgagcgcgataacgtggtcttctcctgcggcgtgcatccgctgaatcaggacgaggcttatgaagtggaaaccctgcgtcagtgggcggcggaggagggcgtggtggcgatgggcgagacgggtctcgactatttctacaccccggaaaccaaaacgcagcagcaggaatccttccgcaaccacatccgtattgggcgcgagctgaacaagccggtgatcgtccatacgcgcgatgcccgcgaagatacgctggctattctgcgcgaagaaaaggtgacggattgcgggggtgtactacactgcttcactgaagacaaagaaacagccggtaaattgttggacatgggcttctatatctcattttccgggattgtcactttccgtaacgcggagcagctcagagatgccgcgcgttacataccgctcgacaggctgctggtggaaacggattcgccgtatctggccccggttccccatcgtggtaaagaaaaccagcctgcgatgacccgcgatgtcgcggagtacatggcggtactgaaaggtgttccggttgaagaactggcgcaacaaacgacacaaaactttgccagactcttccatatcgaccctgcccgcctgcaattttcctgatcgcacagtttttttaaagctcgtaattaataggctttgcgagtaaagttcaccgcctcaaacggggcggtgacactcttttttgacacattcagacaagacttttgtaaaatagtgcaagttttaagaacggtcctggctgaaacgtgatagccgtcaaacaatgttacgctgatttattttactctgcgtaataaataaagggcgcttagatgtcccgtccagggcgcggttctccccccgcgccaatgcgtgaaaacgtaaaaaaaagcacaaatactcaggagcactctcaattatgtttaagaatgcatttgctaacctgcagaaggtcggtaaatcactgatgctgccagtatccgtactgcctatcgcaggtatcctgctgggcgtcggttcggcaaacttcagctggctgccagaagttgtttcccatgtcatggctgaagcgggcggttccgtttttgctaacatgccgctgatcttcgctatcggtgttgcgctgggcttcaccaataacgacggcgtttctgcgctggcctctgtggtcgcttacggcatcatggtgaaaaccatggcggtggtagcgccgctggtgctgcatttacctgctgaagaaatcgcggctaaacacctggcggataccggtgttctgggcgggatcatctccggtgcgatagcggcctacatgtttaaccgcttctaccgtatcaagctccctgaatatctgggcttctttgcgggcaagcgcttcgtgccgatcatctctggtctggctgcgatcgtaatgggcatcgtgctgtccttcatctggccgccaatcggtaccgctattcagaccttctctcagtgggctgcttatcagaacccggtcgtggcgttcggtatctacggcttcattgagcgctgcctggtgccgttcggtctgcaccacatctggaacgttcctttccagatgcagattggtgaatacaccaacgccgcaggtcaggtattccacggtgacattccgcgctacatggcaggcgacccgactgcgggtaaactgtccggcggcttcctgttcaaaatgtacggtctgccggctgcagcaatcgcgatctggcactcagcgaaacctgagaaccgtgcgaaagtgggcggtatcatgatctccgctgcgctgacctcgttcctgaccggtatcaccgagccaatcgaattctccttcatgttcgtggcgccggtgctgtacgcaatccatgcggtactggctggtctggccttcccgatctgtatcctgctgggtatgcgtgacggtacgtccttctcccacggtctgatcgacttcgtggtactgagcggcaacggcagcaacctgtggctgttcccggttgtgggtctgtgctacgcggcggtgtactacaccgtgttccgtgtgctgattaaagcgctggatctgaaaaccccgggtcgtgaagacgcaaccgaagacgcaaaagcgaccggcaccagcgaaatggctccggctctggtatcggctttcggcggtaaagataacatcactaacctggatgcctgcattacacgtctgcgtgtaagcgtggctgacgttgctaaagtggatcaggctggcctgaagaaactgggcgcggcaggtgtggtggttgcaggttccggcgttcaggcaattttcggtaccaaatccgataacctgaaaaccgagatggatgaatacatccgcaaccactaagaaatagtctggggagactgagggagccgaatggctcccttttttacgtctggtgaatgtgaagccgggtggcgcttcgctgacgctggcctggggactgggattgtgccgggtggcgcttcgcttacgccggcctacataccgggaactgtgccgggtggcgcttcgcttacaccggcctacataccgggaccggcctacatttatggggtttggttactgtaggcccggcaagcttgcgccgccgggcaagtcatttacgcggagtatcagaagctgtagttcgcgctaaccgagaagttacgcggctcgccgaacacataggtgcggctgttgacgttggtttcgtaggttttatcgaacaggttatccagattcgcctgcaccgaaagcgctttggtcacgtgataacgggcgaacagatccaccagcgcgtagctgccttgttctgaacgcagcgtgccgctggcaacaggtacatcagcccatgtgtggttctgccagttcacgccaccgccgaccgtcaggtcctgcagcatcggcaggcgatagctggtgaacattttcaccgatgtgcgcggcagatctgagtttaccgcgacaccttcgctgtcttccgccacataacgcgttgcgccgaaggacatctgccagttgtccgtcagtgcgccgttcacttcaaattcaacgccgcggctgacggtaccattcgcttcacgatatgcggtttccccgttgctgccgggaaccacgccgcctgtggactgcgccagatgatcctgctcaatgcggaatactgccagcgaagtcgtcaggcggctgttcatccagtcagctttcacacccgcttcgtagttgttaccggtgatcggcgacaggtatttaccctgactatcacgttgcgtctgcggctggaaaatcgaggtatagctggcataggtggaccaggtatcgttgatgtcaaacaccacgcccgcatacggcgaagtattgttcttctccagatcctgggtcagggtatgcagcgtgtaattggtatagcgcgcgcccataatgaggtgcagcggatccgccagcgaaatgcgggtcgccatatacgcggatttctgacgcaccgtatcttcctgcgcgaggctcaacggcgaccagtcggtttccgggaagttaccggtataatcgctgtagttgcctaactgcgtatcgccgatgttctcccacgagctgtaatagatattgtgctgtttagtgtaattggtgcccaccatcagctcatgctgacgaccaaagagttcgtaattgccgttagcaaaggtatcgatggcatccactttacgcttgccggtgttgtagccggtgccgccaacaaagggataggacgcgccatacgggctgaccatcaggccggtggttttatcaacctggccgtccagatacagcgccttgctgtcgagctcagtttcggtatgcgtaccgtttaccgtaagctgccagttatcgcccagcttttgcttcagagtgacaaaagtacgctgcgtttcggtatcgctgtaggcccagtcaggcgccgtactgtcgctgcgatcggccttgattttgctgccgtcggtataccagcgcggcaggccgccccaggtctgatggtcagtgttgttttcctgataatcgtaacccacggagaacgccgtggcgtcagtgagatcggcatccagcacgccgtagaagaattttttcttctgaccgtaatgatccagccagctgtccttatcctgatagcccgccaccatacgaccacggatgttaccgttttcggtaagcggggtggagagatccgccacgtaacgttgcttgttccagctgccgtactctgcgctgacgttggtggtgaattcacggctgtcagcgtgcttacgcaccatattaatcgccgcagaagggttgccggaaccggtcgtcagaccattcgcgccgcgcaccacttcaatacgctcatacatagcggtatccgacatcgcatcgcccaggttccagcgggattcaaacagcgtcggaatgccatcgaccatatagttgtcgatcagaaaaccgcgggaatagaaggtgctgcgatcggaatccgccacgctctcagaaataccgatggtatttttcagcacgtcgcccagcgactccagcttctgatctttcatccgctgttcgctgaccagcgtcaccgactgcggaatatcgcgctgaaccagcagcattttggtgccggaggcggtggttttaacgctgtaatcttcactttctgtggctgccgtcgtgcctgaggacgaaccatcgacaaccagcgtatcttccggcgctgccgtggtggccgcaaagcccgccgctggcgtcagtgcaaaagcaatacaaaccgccagcagtgacggatgagtggcaggcggacgttgtccgtccctggcgtgaacggtgaaagacatcattaacccttctgagtgttggtcataaagcaccccgtcaatacgttgtcggcgcggtgcaggatagttaattattcagttatgaaacgcgcatggaaatgcaaatgcgaaatatacgcattacagttcaccctgtaaacagatgtaatatttattaatgaaacccggttttactcagcacgatgaacagggggatgacataagctttcggcagggtaagaaaatgaggtttatagttgaaacatcaggagattgtcactcatactctctggcaatattatgcagtcataaagaaggaagacgacatggcagaagaaactattttcagtaaaattattcgtcgcgaaattccgtcggatattgtctggcaggatgagctggtcaccgcgttccgcgacatttccccacaggctcctgtacacattttgattgtgccgaatattctgatcccgaccatcaacgacgccaccgaagcccatgagcaagcgctgggccgcatgatgaccgtcgcggcgaaaatcgcaaagcaggaaggcattgccgaggacggttaccgcctgatcatgaactgcaatcgtcatggcggccaggaggtctatcatattcacctgcatctggtcgggggccatgccctgggtcctatgctgtctcacaaaggccgctaagatgaccaaagggcgtactgccgtattactggcggcgattttacttgccggatgcagcgcaaaaccggcgatcccggtcagcgatgagcaaacgctggtgatggagtcaaccgtcctcgcggcggggatctccgccgaaaaaccggaattatcccgctcggaaattcagtcttctgcgtcctcaactctctacaatgaaagaaacgtgccggtaacggttaactatcgtttttactggtatgacgccagaggccttgaaatgcatccgctggaagcgccgcgaaccgtcactgtgcctgcacacgcatcggtgacgctttatggcagcgccaactacctgggcgcacataaagtgcggctctatctctatttataaggggtgatttgaatgagaatgatgggacgttacgccctgcttgccacactggcattgatcctgaccggctgtcagattaatcaggaacaacccgcgccggtcgaccaggcgacgccggtaccggaacaaccgaccacgccgcagcaaccgctgccgaccgtgccgtcagtaccgaccatcccgtcacagccagggccgattgagcatcaggacgaaaccgtgcagccgacgccgcgcgtacgtcactacgactggtccggcgcgatttcgccgatggtcagcaaaatgctgcaggcgagcggcgcggcaggcggcagcgtgctgctggtggacagcgtcaataaccgcaccaacggctcgctcaataccggcgaaggcaccgatgcgctgcgcaatgcgctggcgaacaacggcaaattcacgctggtatccgcgcagcagctgggcgtcgccaaacagcaattggggttatccccgcaggacagtctcggcacccgcagcaaagccatcggcatcgcccgtaacgttggcgcgcagtatgtactctattccagcgccagcggcaacgttaacgccccgaccctgcaaatgcagctgatgctggtacagactggcgagatcgtctggtcaggtaaaggcagcgttgcacaacaataaacctgagcgtgacgctattctgtcacgctattttccgcagtttacgcccgccgcagatcagacaacgtccggtctgtccggcgggagtatcattattgaacgcgggcagcagcgtctggtgctccgtttccgtcacgcggccacccccgccgcgccttttctgcgtcagtatcatgtcctgaaacgtctccctgtttcgcttgcgccacagccgctgcgttacggtgaaggctggatggccgtcgattttctgcgcggtgaggtaaaaactgcgctaccggctaccgatgcgctggcagaggtgttgtatcatctgcaccagcagccctgttttggctggcgcattacgctgctgccgctgcttgaaggctactggcaacaggccgcgcccgcgcgacgcacgccgttctggttgcggcaactgaaaaggctgcgcaaacagagggagccgcgcgtgctgcggctggcgccgctgcatatggatgtccacgcgggcaatctggtgcacagtgcgcaggggctgcggctgatcgactgggagtacgcgggagatggcgatatcgcccttgagctggcctcagtgtggatggatgacgccgcgcgacaggggctggtggcggattatgcccgccgggccagcatcgatcccatcatgttacagcggcaggtgcggcgctggcggccctgggtgatgatgctgatggcgggctggtacgagtaccgctggcaacagacgggcgaacaacaatttataacgctggccgatgaaatatggcgccagttgcagactaaaggataagagaggtcagtgtgggtccggtaatgttagatgttgaaggctatgagctggatgccgaagagcgcgaaattctggcgcatccgctggtgggcggtttgatcctgtttacccgcaattatcacgatcccgcccaattgcgcgagctggtgcgccagatccgcgaggcgtcacatcaccgactggtggtggcggtggatcaggaaggcgggcgcgtgcagcgctttaaagagggtttcacgcgactgcccgcggcacagtccttcgccgcgctgctgggaacaaccgagggcggcaggctggcggaagaggctggctggctgatggcaagcgagatgatcgccatggacatcgacatcagctttgcgccggtgctggatgtgggacatatcagcgcggccattggcgaacgctcgtaccatgccgatccggctaccgcgctggcaatggcgacccgttttatcgacggtatgcacagcgccggaatgaagaccaccggcaagcattttccgggacatggcgcggtaagcgcagattcccacaaagagacgccgcgcgatccccgtgatgaagcggagatccgcgccaaagacatgtccgttttccgctcgctgattacggataacaagcttgacgccatcatgccggcgcatgtgatttacagcgaggcggatccgcgtccggcaagcggttcaccctactggctgaaaaccgtgctgcgcggcgagctgggctttaacggcgtgatcttctccgacgacctgtcgatggaaggggcggcgattatgggcagctatgcggagcgcgggcaggcgtcgctggatgccggctgcgatatgatcctggtttgtaataatcgtaaaggcgcggtcagtgttctggataacctgtcgccgatcaaagcagaacgtgttacagagttgtatcataaaggttcatttacgcgtcaggaattgatgtcatccgcgaagtggaaaacggtcagcgccgcgctggaacagctgcacgaacgctggcaggaacataaaacggcgcattaatccatcggtgcgttgcagtgtggtgagggcacaatgatcatctatttacacggttttgactcgaacagtccgggtaatcacgagaaagtattgcagcttcagtttatcgatccggatgtgcggctgctgagctacagcacccgccatccgcggcatgatatgcagcacctgctgaaagaagtggataaaatgttgcagcttaatgtcgatgagcgtccgctgatctgcggcgtcgggctgggcggtttctgggccgagcgtatcggctttctgtgcgatatccggcaggtgatgtttaacccgaatctgtggccgcaggagaatatggaaggcaaaatcgaccgtcctgaagagtacgccgatattgccaccaaatgcgtgactaattttcgcgaaaaaaaccgcgaccgctgtctggcgatcctgtcccgccgggacgaggcgctcgacagccagcgttcggcggcattgctgcaacctttttacgaaatcgtctgggatgaagagcagacgcataagtttaagaatatctccccgcatttgcagcgcatcaaagcctttaaaaccctcggttaatccggcgtacattcttaaaagtcagcttaatcgctgacttttttttcctttactgcggatcacgcttatcttttaagcagcaaaacttgatgtacatcaattttggtatgaccaatgcaccgaacatgctattctcgttaccggtaaggcgttttcctgctggtaacttgttgttaaataaaacttatttttataacttttacttaacaattggttaataattttaagggggtcaccttgactacaccattgaaaaagatcgtgattgtgggcggcggtgcaggcggccttgagctggccactcaactgggtaaaaagctcggacgcggtaaaaaagcgaaaatcacgctcatcgaccgtaaccacagccacctgtggaagccgctgctgcacgaagtggcgaccggctcgctggacgaaggcgtggatgcgctgagttacctggcgcacgcgcgtaaccatcacttccagttccagcttggctccgtgatggatatcaatcgcgaaagtaaaaccctgacgctggctgaactgcgcgacgagaagggcgatctgctggtgccggaacgtaaaatcgcttacgacaccctggtgatggcgttgggcagcacctccaatgatttcaacacgccgggcgtaaaagagcactgtatcttcctcgacaacccgcaccaggcccgtcgtttccatcaggaaatgcttaacctgtttctgaaatactccgccaacctcggtgccagcggcaaggtcaacattgccattgtcggcggcggcgcgaccggcgttgaactgtcagcagagctgcataatgcggtgaaacagctgcacagctacggttacaaagggctgagcaacgaggcgctgaacgtgacgctggtggaagcgggcgagcgtattctgcctgcgttgccgccgcgtatttccagcgccgcgcacaacgaactgactaaaatgggcgtacgcgtcctgacgcagaccatggtcacaagcgccgacagcgaagggctgcacaccaaagacggcgaacatatcaaagctgatctgatggtgtgggcggcagggatcaaagcgccggactttatgaaagagattggtggcctcgaaaccaaccgcattaatcagctggtggttgagcagaccctgcaaaccacccgcgacccggacattttcgccatcggcgactgcgcctcctgcgcccgtccggaagggggctttgtgccgccgcgcgctcaggctgctcaccagatggcgacctgcgcgctgcacaacattctggcgcagatgaagggcaagtcgctgaaagagtatgtctataaagatcatggctcgctggtgtcgctgtcgaacttctccaccgtcggcagtctgatgggtaacctgatgcgcggctcgatgatgattgaaggccgcatggcgcgctttgtatacatctcgctgtaccgtatgcaccaggtggcgctgcatggctatttcaaaaccggcctgatgatggtggtcggcagtattaaccgggtgatccgcccgcgtctgaagctgcactgacagaccatgccccgcttcgcggcgggcgttcagcatatccttctgcccgacagggctatgtggtcagacttctctgaatcaccgcatttccccgcacaataccccgcaaacttcctgaattctgattggcgtacgctgcctttgattgcaaaattgttaccaatagcaaaaaagggagatgatcctgtgaataaatcaatgttagcgggtataggaattggtgtggccgctgctctgggtgtggcagcggttgcaggccttgatgtcttcaaaagcggcccacaatatgcgcaggtcgtctcagccacaccaatcaaagaaacggttaaaacgccgcgtaaagagtgccgtaacgtgacggtaacgcatcgtcgccccgtgcaggatgaaaatcgcctgacagggtcggtgctgggcgctgtcgcaggcggcgtgattggtcaccagtttggcggcggtcgcggtaaagatgtggcaactgttgtcggcgcgctgggcggcggctatgccggtaatcagatccaggggtcactacaggataatgacacctacaccagcacgcagcagcgttgtaaaaccgtgtatgaaaaatcggaaaaaatgctcggttacgacgtcacctacaaaattggtgaccagcagggaaaaattcgtatggataacgatcccggcacgcaaattccgctggatggcaatggccagctgatcctgaacaacaaagcgtaaaaaagaagttctgcattaattgactccccaatcgctcaggctggggagtccttttttatttctgccttataccgcagtatcgcgactctgcttcaccagcagacctgccgtaatcaataccgagacgaaagcgaaaagcactgaactgccgcacaacaaccacagactaaacaacaatgtaattactattagcactttgagtaatggtaatagcaaaaccatttcattttccttctgcatgtgaacagccataaatcgcgtcttcatgacctgcaagcgtctcccgttgtgatactgctaatcattagcagaaaaataatcacaataagaatagcaaagcgaagcggaaaacagaaaggcctgacctattgctgcaaaaggtcaggccaatcaaacgaaagaaggggattacagtcaggatttcagcaattcaggccacagtcgcagggtggtgtgggtgatttgcagcagtttttccatgcaggcgccttcacgcgcgctcacggacatgccctgcagaatacagctcagaaactgtgccagcgcgaccacatcgcggttggccgggatctcgccccgcgcctgtcgctgctgtaaaaacttcaacagcgtctgctcctggagggcgtggcgggatttgatcgtccgggcgatttcgtttgaggaggcggcgagcgtcgcggaggtgtttatcataaagcagcccgccggggtatccttgctggtaaagcaggtggcgacagaggtgaagtagtcccgcagcgcctgctccaggggtttttcctcgcacaacagttgcgcgtcatgctgcgccgtgaagcgagcgatatagcgatcgagcacggcgcggaacagcccctctttgttcgtgaactctgcatacagcgtcggcgctttggcgcctgtcgcctcaaccagatccgctaacgaggtggcctcatacccgtgctgccagaatagcgtcatggctttatcaagcgcggcgtcccggtcgaaggttttcggtcggccacggctttttttagtaccgcaggtcacgtcgttggtcatagcgccgcctgaataatgatgtttgttgaacgatcattataaaaattaccggcaggcattacaaactttgcgcaacctcctgatgttccgtgacatctaccggcattccggaacgaacctgcatcacttcatccatcagcgcggtattcgtttgcgcatcggctttaaaggattccattgcgctgctcagtacaattggctgggttttcggatcgtcgttaatggatttagacagcggctgatgcacctccaccaggcgacggccgtccggctcgacagaggccttgatcggcgtattgatgatgttcactctggtgcccggcgtgacctttttaaacagcgtggcgatatcgccatcccgcagacggatacagccggagctgacgcgcatgccgatgccaaaatctgcgttagtgccgtggatcaggtacacaccgccgtaggccgccagacgtatggcatgatgccccattgggttatccgggcctgccggcaccaccgcaggcagatcgataccctgcgctttatagcgggcgcgaatattcgcggtcggcgtccaggtcggatttgcgcgtttgtccgatacggtagtcaccatggtgggcgttaaggtatcgcctcccagctggccgatgccgatagggtagatcgtcacttcgcttttacccggagggtaatagtaaagacgcagctcggcaaggttaataacaataccctcgcgcggtacgtccggcagcagggtttgcagcggaatggtcagtacgctgcccgcgcgggggacgtaaggatcgacgccggggttcgcctgtaacagcgcaaggaatccgacattgtattttttggcaatcgcttccagcgagccgccatcgttttccacgagatggaagcggttttcaccgaccacccggcttcccgccgcgggcagcggccaggtattggcctgagcgggaagggcgagcgccagagtcgaggcaacggcaataaaagccagccaacgggcaaaacgcgaggttttcattagtatcatcacccacaggtatattcaggttattgttattcaacataaaccttaattatggatggtgggcgtgtcgggaaatgcaggggaagtgcaaagagtttgtaaaggctggcgcaccgcctgaagacggcgcgccagtgagatcaggcgacggcgttttctgccagtttctgcataaactgacgcacccactcgatacgggttttccgctcgccgagatcctggaagaacttcagtcgtgtcggcccgtcgaggcggaaatgctgcggctgcttttgcagcaaaccaatcagccacaccggatccacatgattcttctcggcgaactcaatagtgccgcctttgtcgttaccttcgatcttgcgaatgcccaggtgctgcgcctgttgacgcagtaacgccacctcaagcagggtacgcgccggatccggcagcaggccgaagcgatcgatcatctccaccttaatttcatccagctcgttctcacttttcgcactggccacccgtttgtagaacgacaggcgcgtattcacgtcaggaatgtaatcatccgggatcagcgccggcatacgcagttccacttccgtctgctggctggtgagatcttccagagaaggctcgcgcccggctttcagcgcatcgaccgcgttttccagcatctccatgtacagcgagaagccgatggtttccatctgaccgctctgatcttccccgagcagctccccggcgccgcggatctccagatcgtgggtcgccagcgcaaagcccgcccccagatcttccagcgaggcaatggcttcgaggcgtttctgcgcatcggtggtcatggctttcggatgcggcgtcagcagccacgcataggcctgatgatgcgaacgcccgacgcgcccgcgcagctggtgcagctgcgccaggccaaaatgatcggcccgctcgatgatgatagtgttggcggtgggaatgtcgatcccggtttcgattatggtggtgcacaccagcacgttaaaacgctggtgatggaaatcattcattacgcgctccagctcgcgctcgcgcatctgtccgtgaccgattgtgatacgcgcttccggtaccagatttgccagacgttgcgccgccttctgaatgttttccacatcgttataaagataatacacctggccgccacgcaggatctcacgcagcatggcttcacgtaccaccagatcgtcatactcgcgcacgaaggttttcaccgccagacgacgggcgggcggggtggcgataatcgacagatcgcgcatgccgctcatcgccatattcagcgtgcgcgggatcggcgtcgcggtcagcgtcagaatatcgacgtcggcgcgcatcgctttaatgcgttctttatggcgcacgccaaagcggtgctcttcatcgacgataagcagtcccaggtcacgcatcttcacatcgctttgcagcagcttgtgcgtgccgaccagaatatcaattttaccctcggcgacctgctccaggatctgcgcctgctctttggcgctgcggaagcgggagagcatctcaatgcgcaccggccagttggcgaagcggtcgcggaagttatcatagtgctgttgcgccagcagggtggtcggcaccagcacggccacctgcttgtggttttccaccgcaaggaaggcggcgcgcatcgccacttcggttttgccaaagcccacgtcgccgcacaccagacgatccatcgccagcggctgagacatatcgctgagcaccgcattgatcgcctgcgcctgatccggcgtggtttcaaaggggaaaccttcgcagaacagctgatactgttcacgatcgtgtttgaacgcgaaaccgcttttcgccgcgcgctgggcgtaaatatccagcagttccgccgccacatcgcggactttctccgccgctttctgccgcgcccgtgaccaggcatcgctgccaagtttatgcagcggggcattatcttcagcgccaccggcgtagcggctaatcagatgcagggacgaaaccggcacatagagtttggcgtcaccggcataggtgagcatcaggtattcgcccttgatgccgccagcttccagggtggtcattcccgcatagcgtccgacaccgtgctccagatggacaaccggctggccgggatgcagttcggcgaggttacggatcagcgtatccgggttaatggtgcggcgattatcctggcggcgacgggacacgcgctcgcccagcagatcgccttcacagatcaaggcccggttgcgcagggtgtcgataaagccgcgctccgccgcgccaatgatcagataacgcccgttaccggtcgcttcatccagacgctgaatgcgcttcggcgcgatcttgatgcgtgccagcagttcgcctaacgcctcgcgacgcccctcgctttccaccgagaacactaccgggccgctgaaggattcgataaatttacgcaacgcgtcgagcggcgatttctgctgcgcctgcaccgccagatccggcagcgtctgatagcccagattggtgttggcggctttgtcagccagcttgtcggttttcagctgaatgcgcggccagcctttcagcgcgccgaacagttcgtcagcgcgcagccacaggcgggacggcggcagcagcggtcgcatcggatcgacgccgcggttttcatagcgcgcctgggtgtcgttctggaaacgctccgcgctgctttccagatcgccggtattcacaatcagcgtattcgccgggaaatagctgaacagcgccggcagcggctcgctgaagaacagcggctgccagtattcaataccggtcggcagggtgcctttgctcacctgctgatagatgtgctccgcatcgcgcttcacgtcaaaattatcgcgccactggctgcggaacagctcgatggcagctttatccgtggggaattcgtgggcaggcagcagattgatggcctccacttcctccagcgtgcgctgcgtgtcggcgtcaaacagacgcagactgtcgatttcatcatcaaagaaatcaatacggtaaggctgctcgctgcccatcggatagagatccagcagcgcgccgcgggtggcatattcaccgtgcgccatcacctgatcgacatgccggtaacccgcgttatccagctgcgcgcgcagcgcatcccgtgacagccgctggcctttgttcatcaccagcgcgtgaccgtgcaggaagctgtgcgggcaaacgcgctgcatcagggtgttgaccggcatgatcagcacgccgcgctgcatggcgggaagctggtacagcgtcgacaggcgcgatgagatgatttcctgatgcggcgagaagctgtcgtagggcagcgtttcccagtcggccagattcatcaccagatgatcggtaaactgcctgatttcatcgtgcagacgcagcgcgttttgcatatcgggcgcgatcagtaccaccgggccggtatgacgttcaacgatttcagccacttcggtggcacaggcgctgccagtaagttcgcccagctgacgctggtcgcccgctctggagggcagggcataacggaattgttcaggcatagcggatgtcatgatctcttaagggtacgcccccgatatgggggcatgccactgaaacacaatgcagtttattatcctcgatcatgccattttagcaaaggcaaccgtcaccgggcggctactgccggacgtaaatccaccggcggtgagaagaacagatcgccaaacagacgcgtcgagagtttgcgcaccagcagtcccgccgcggtgcaaatcagcagactgataaagggatacaccagcagcagcgccagttccaccattggcggcagccgcgcctgattaagcagcgggatcagcgccaggctgaagccttcaatcagaatacggtgagtggtgtaaatagcgatagtattagaacccactacattaagcagattgttttcacccggcgggaatcgctgctccagctgcaaaaacagcttcatgatcagcacaatggagaacagtgacagcagcagcggcacgtttttaaaccacagcagcaccgacgccaccagagcgatccccagccacagcgcatagcggcgcagcggcacgtttttaatgatgtccatcaccgccacgccataccacgcgcccaggctgtaatagatcatattgcgcgccacgctgttcagcccccaccagggcagcggcaggaaattaatggcgacggagaggataaccagtaagcccattaccggcgctttccagcgttgcagcgccttgcagagcacgaaatagaccagcagcgcatacagataccacaggctggtgctggcagtaagcataccgtgcaggaagccggtaaaggatccggcataggcggcgttggcggtggcgctgagatcccgctccggcgccagccagtcgtttaacgcgccaatcgccagccactgcaccacgccccacagcgccagcacatagaaaatactccacagccgtttatcgatgcagccttcccactgcacctcttccacataccggcggatcaggtagccggagataaagaaaaacaccggcatacggaagggggcgaggtacaaattaaaatagatccagcacttggacagggtctccgacagcggatgttgcagcccttccaggtgcggataaaacgtaattaccgagtggtaaatcaccaccagacagatacacaaccctttgatctggttaatccatactgctttttgtttcatgcttaccacgtgcctgttatatccaagttcaggcgttaattgtgatgatgagaggagacagcggtaatgcgtaaaggtctggatttggacgggctggcgcaattttcggaacaatattaaacgtaactttgcagccactgcgcgcatttaatggaatagtggtttgatttttcagaactttttaagtgcattcgcgacaattcttcacgtttaagcgatttaccatccccggtttcgcttatatactcccaagtctgctcatagctaccagacggatttcatgtatcaacctgtcgcactattcataggccttcgctatatgcgcgggcgtgcagtcgaccgcttcggtcgctttgtctcctggctttccaccattggcattacgctcggcgtgatggcgctggtaacggtgctatcggtgatgaacggcttcgaacgtgaactgcaaaacaatattctggggctgatgccgcaggccgtgctgagtgccgatcatggctcactggatcctgaaaaagtgccggaaagcgccgcccgtctgccgggcgtcaaccgcaccgcgccgctgaccaccggcgatgtggtgctgcaaagcgcgcgcagtgtatcggtgggcgtcatgcttggcatcgatcctgcgcagaaagatccgcttacgcccttccttgtcaacgtacagcaaaacgatttgcagccgggcaagtacaacatcattctcggcgaacagctggccgggcaactgggcgttaaccgtggcgatcagctgcgcgtaatggtcccttccgccagtcagtttacgccgatggggcgtctgcccagccagcgcctgtttacggtgatcggcaccttcgccgccaacagcgaagtggatggttaccagatgctggtgaacattcaggacgcctcgcgcctgatgcgctatccggcgggaaatatcaccggctggcgtctgtggcttaacgagccgctgaaagtcgacgaactcagccagcaaacgctgccccagggcaccgcatggcacgactggcgcgatcgcaaaggcgaactgttccaggcggtgcgcatggaaaaaaacatgatggggctgctgctgagcctgatcgtcgctgtcgcggcctttaacatcattacctctctcggcctgatggtgatggagaagcagggcgaggtcgccattctgcaaacccagggcctgacgccgcgccagatcatggcggtgtttatggtgcagggcgccagcgccgggatcatcggcgcgctgctcggcgcgctactgggcgcgctgcttgccagccagctcaataatctcatgccgatcattggcgcattgctggatggcgctgcattgccggtggtgatcgagccgttacaggtgatcgttattgcgctggtggcgatggccatcgcgctgctgtccacgctttacccttcctggcgcgccgccgccacccaacccgctgaggctttacgttatgaataagatcctgttgcaatgcgacaacctgtgcaaacgctatcaggaagggaacgtgcaaacggatgtgctgcacgatgtcagcttcagcgtggggcagggcgaaatgatggcgattgtcggcagctccggctccggcaaaagtaccttactgcatctgctgggcggcctggacacccccacctccggcgatgtgatttttgacgatcagcggatgagcaaactatcgtccactgccaaagccgagctgcgtaaccgcgaactgggctttatctatcagtttcaccacctgctgccggactttaccgcccaggaaaacgtggcgatgccgttgctgattggcaaacataaaccggcggaaatcgagcgacgcgcccgggaaatgctggccgccgtggggctggaacaccgtgcgaaacaccggccttccgagctgtccggcggtgagcgtcagcgtgtggctatcgcccgtgcgctggtgaatagaccgcgactggtgctggcggatgagccgaccggtaaccttgatgcgcgcaatgccgacagtatttttgccctgttgggtgagctgaatcagacgcagggcacggcctttctggtggtaacgcacgacctgcaactggcgcgtcgtatgacccgccagctcgaaatgcgcgatggccgcctgactgctgacctgacgctgatgggagcgcagtaatggcctcgcctttatcccttctgattgggctgcggttcagccgcggccgccgccgcagcggcatggtatcgctgatttcggtgatctcaaccgtcggtatcgcgctgggcgtggcggtgctgatcgtcggcctcagcgccatgaacggcttcgagcgcgaactgaataaccgcattctggcggtggtgccgcacggtgaaatcgaagcggttaaccagccgtggaataactggaccgaggcgctgacaaaagtcgaaaaagtgcctggcatcgtggccgccgccccttatattaactttaccgggctggtggagagcggcgctaacctgcgcgccatccaggtgaaaggcgtcgatccgcagcaggaaacgcggctcagcgcgttgccacgctttgtgcagaacaacgcctggtctggctttaaagccggtgaacagcagatcatcatcggtaagggcgtcgccgacgcgctgaaggtgaagcagggcgactgggtgtcgatcatgatcccgaacgccagcgccgatcacaaactgcaacagccgaagcgcgtgcgtctgcacgtcagtggtattttgcagttgagcggtcagctcgaccacagctttgccatgatcccgatgaaggatgcgcagcagtatctggatatgggtgacagtgtcacgggcatcgccctgaaagtgaacgatgtctttaacgcgcaaaaactggtgcgcgacgcaggagaggtgaccaacagctacgtttatatcaaaagctggatcggcacctatggctatatgtaccgggacattcagatgatccgcgccattatgtatctggcgatggtgctggtgatcggcgtcgcctgtttcaatatcgtctccaccctggtgatggcggtaaaagacaagagcggggacatcgcggtgctgcgtacgctgggggcgaaagacggcctgatccgcgccattttcgtctggtatggtctgctggccgggctgttcggcagcctgtgtggggtggtcatcggcgtactggtgtcgctgaatctcacgccgatcatgaatggcctcgaacgtcttatcggccatcagttcctctccggcgacatctattttattgatttcctgccgtcagagctgcatgcgctggatgtggtgtacgtgctggttacggcgctggtgctgagcctgctcgccagctggtatccggcccgtcgcgccagcaacatcgatccggcgagggtgctgagcggccaataaccaacaaggagtggcgatgtattacggatttgatattggtggtacaaaaattgcgatgggcgttttcgacgctgaccggcggttatgccatgaaacccgtgtcgccacgccccgtgaaggttatgacgcttttcttaaagcggtaacgtcgctggtgctggaagccgatgaacgctatggcgtcaaaggctccgtcggcatcggcatccccggcatgccggaaaccgcagacggcacgctgtacgccgccaacgttccggccgccagcggtaaacccctgcgcgcggatctctcggcgctgctggcgcgtgatgtccgtctggataacgacgccaactgctttgcgctgtcggaagcctgggacgatgaatttaagcaatacccgctggtgatggggctgatcctcggcaccggcgttggcggcggtctggtgctgaacggcaaatccattacaggacgcagctatatcgccggtgagttcgggcatatccgtctgacggtggatgcctttgatgtggtcggcttcgacttcccgctgacccgctgcggctgcggcaaactcggctgtattgagaactatctttccggtcgcggctttgcatggttgtaccaacacttctacgatcaatccttatcctccccggaaattatcgcgctctatgagcagggggatgccagggcgcgcgcccatgtggcgcgctacgcggatctgctcgcggtgtgccttggcaatatactgacgattgtggatcccgatttgctggtgataggcggagggttatcgaatttttctgcgctgaccacccttatcgccgaccgcttaccgccgcatctgctgcccgttgcccggctgccgcgtattgaacgcgcgcgtcatggcgatgccggtgggatgcgcggagcggccttccttcacctcaccgactagcctaaagaggttgctatgcagtcgcgccggttacatcgtctaagccgttttcgccgtaacaaacgtcgtctgcatgagcgtttacgccagcgaatttttttcagagacagagtggtgcccgaagtgatggaaaaaccgagagtggtggtactgaccggagcggggatctccgccgagtcaggcattcgcaccttccgcgcggccgatggcctgtgggaagaacatcatgtcgaagacgtggccacgccggaagggtttgcccgcgatccggcgctggtgcagtcgttttataacgcccgccgtcggcagctgcagctgccggagatcgcgcccaacgccgcgcatctggccctggcagagcttgaagccgcgctgggcgatcgttttctgctggtgacgcagaatatcgataacctgcatgagcgcgccggcaataaaaacgtgctgcacatgcacggcgaactgctgaaagtgcgctgcactaccagtggccaggtgctggagtggaccggagatatcacgccggaagacaaatgccactgctgccagttcccgtccaccttacgcccgcacgtggtgtggttcggcgaaatgccgctggggatggatgagatttacagcgcactggcgatggccgacgtgtttatcgccatcggcacctccgggcatgtctaccctgcggcgggatttgtgcatgaggcgcgtttgcaaggggcgcacacggtggagcttaatctggagccaagccaggtcggcagcgaatttgaagagaagcattacgggctggcaagcgtggtggtgccggagtatgtggacaagctattgaaaggtttgtgagatggtgcagcctctccctgcgggagaggctggagaaggttatcgcccggctttcagcttctggtaatactcttcataaatggcgctggcggcgccgacatcgttctgccattcgcctttactgatagtatctgcatccggatacagcgatttgtcgttcgccacgtccggggccagcagcttacgcgccgccaggttcggcgtcgggtagccgatggtttccgccacctgcttcgccacgtccggacgcagcaggaagttgattaacttcagcgcgccctcgacgtttttcgcgttagccgggatcgccaggctgtccatccagaaaatcccgccttctttcggccagacgatctgcaatggtgtgccggactgacgggcaacataagctgagccattccagaccatacccagattcacttcgccttccatgtacgggttcgccggattatccgagttgaacgccgccacgtttggcatcagttttttcagctcctgataggccgcttcgatctcttttggatcggtggtgttgccggacagtcccagtttacgcagcgccacctggaacacctcgcgggcatcgtcggtcagcagcaggctacttttgtattccggtttccacagatcgccccagccggtgatggtggcgggatcgatagcctcgctgttcacgccaatggcggtcgcgccccagatatagggaatggaatagtcgttctgcggatcgaagggcttgttcagcatgtccggatcgagattatggaagttggtgagcttcgttttatcgatcttctggatcatgccctctttgcgcattttatcgacgaaataggtggagggcaccaccagatcgtacgcgccgtctttataggttttgagcttggcatacatggtttcattcgactcataggtcgaatagatcaccttgatccccgtctctttggtgaactgttccagcaggcctggcggcacgtactcggtccagttgtagaagtaaagcgtattgttgtccgcgtgagcagcgctcattcccattgccagagcgcccgcagcgagcaggtggcgtgaccatttgatcattttaacgtcccctgagatttggttttatcacgtgcaataagctggctggcgatcaccagaaccagcgagagtactaacagaatagtcgccagcgcgttcacttccggtgacacgccgactttcaccattgaatagatcttcagtggcagaatttcatagccaggcccggtgacgaaagacgaaacgaccacgtcatccatcgacagggtaaagctcagcacccagccagccgccaccgcaggcattgccagcggcagaatgattttgcgcagaatggtcacttcgctggcaccgagatccttcgccgcctccagcatccgcacatcaaaccctttcagccgcgaatagacggtgaccaccacaaacggcaggcagaaagtgatgtgggaaaacagcagcgaccagaagcccagctgaatgccgataagcataaagagcaccagcagcgaaatggccatcacgatgtccggcgacatcattaccacaaacagcatgccgctgacgaaaggcttgccgcgaaaacggtaacgatagagcgccaccgccgtcagggagccaatcagcgtggcaaaggtagccgacagcaccgccatggtcagcgagtggcgggcggcctgtaacaggctgtcattgttcatcaacaggctgtaccagtcggtggtgaagccctgccagttgatgccgaagcgcgcctggttgaaggaattgacgatcagaataatgatcggaatataaagataagcgtaaatggcggtcataaaaccgccgcgcagcaggcgaccgatcattccagctccacctttttattcagaaaacgcatcgcccgccagtaaaccagcagcatcaggcccatcaccaccgtcagcgtaatgctggtggcggagccgaacggccagtcgcgaatgttcaggaactggcttttaataacgttaccaatcagcaggtttttcgcgccgcccatcagatccgagacgtaaaacagccccatcgccggaagcatcaccagcagacagcctgcgataatgcccggcatggtcagcggaataataatgcggataaaggtttgcaacttactggcgcccagatcgcgggcggcctccagcagcggtttgtcgagtttttcaatgctcgaccacagcggcatcaccataaagggcagcaggatatacaccagcccgatgatcaccgcgcccggcgtgaacatgatacgcagcggcgtatcaatgacgcccagccacagcagaaacgcattcagatagcctttggtgctgagaaacagtttcaggccataaatgcggatcagggagttggtccagaaaggcacgatcagcaaaaacagcagcagcgggcgcaccttctgcggcagcttggccagaaaccaggcaaagggatagccgagcgcgaggcaggcgagggtggcgatcaacgccatattcagcgagtgcaacagcacatcgaaatagagcggatcgagcagacgcgaatagttgtccagcgtaaacaccagactgacaaaggaggcgtcatcgcgggttaaaaaactggtgacgatgatcatcaggttgggcagaaaaacaaacagcaccagccagccgacgacggtcgcgatcaccacattctggaatttactggtgctcttcatcaggcagtacgacctcccagctttccacccagttgatggccatcttttgatccagcgagtggtcaaaatccggatcgtcttcgttaaagaattcgctgaccatcaccattttgccgttttccagctccaccaccgactccagcgtcatacctttgtaattgcgctcgcgaacaaagccaatcagaccgtccacctcgcggctgtcgttgatctcctccacgcgcagatcttccgggcgcagcatcacgttcaggcgctggcctttttctaccgggaaatggacgtggatattgcattcgcggccttcgacgctggcgcgcacgcgctgttcgtccagacgttcgatcaccgtggcgttgaacaggttgatctcgccgatgaagcttgcgacaaacaggttttttggctcttcgtagatttcacgcggtgtgccgtcctgctcgatcttaccctcgcgcatcaccacgatgcggtcggacatggtcagcgcttcttcctgatcgtgggtgacgaacacaaaagtgatgcccagtttacgttgcagggctttcagttcgttctgcatctgtttgcgcagtttgtaatccagcgcggagagggattcatcgagcagcaacaggcgcggtttattgaccaccgcacgggcgatggcgacacgttgctgttgcccgccggatagctgatgcggtttacgttcggcgaagctgtccagttgcaccatgcgcagggcttcggtcacgcggggagtaatttgatcggctggcgttttttgcattcgcaggccaaaggcgacgttttcaaaaaccgtcatatgcgggaaaagcgcgtagctttgaaaaaccgtattgacgtggcggtgttcagccggaacctgggtgatgtcctgatcttcgagatggatatgaccggcatcgacattttccagtccggcaatcaggcgcagcactgtggttttaccgcagccagaggggccaagcagtgtcagaaattcgccattattgatggtgagattaagatcggaaatgacatttttaccatcaaagcttttccgaatccccgccaggtgcaccagcggcgaaagcgaacgcgtttgtgtattcaattttttactctgtcccgtgtagacgcaatggatggcttaccattgcggggtttgtgattaaccaccttagggtttgacacattaatgaggcctggcattctacggcaaaccactgaaatcgccaatccttgtgagatattccctttcagaggtggaatttctcaaccatgcttaggtctggggtcgcgaaagctaaaaaattctcgtttgcacgggtaaaagtgacctgacgcaatatttctgttttcacgcttatcaataatgttgtctcaaatagtgagggtggcccgcatggataaattactagagcgttttttgcactatgtttcgctggatacacaatcaaaaccgggcgtcagacaggttcccagtaccgaagggcaatggaagctgttgcagctgctgaaagatcagctggaagaaatggggcttgttaacgtcaccctgagcgaaaaaggcacggtgatggcgtccctgccggctaacgtgccgggcgatattccggccattggttttatttcccatgtcgatacctcgcccgatttcaccggtaaaaacgtcaatccgcagattgtcgagaactatcgcggcggcgatattgctcttggcgtgggcgatgaagtgttatccccggtgatgttcccggtgctgcatcagctgctgggccagacgctcatcaccaccgacggcaaaaccctgcttggggccgatgacaaagcgggcgtggcggagatcatgaccgcgctgtcggtgctgattaataaaaacattcgtcacggtgatattcgcgtggccttcacgccggatgaagaggtgggtaaaggcgcgaagcacttcgacgtcgaagcctttgacgcccgctgggcctataccattgacggcggcggcgtgggcgagctggagtttgaaaactttaacgcggcatcggtaaccatcaaaatcgtcggcaacaacgtacatcccggtacggcgaaaggggtaatggtcaatgccctctctctggcgagccgcattcatgcagaagtgccgcccgcggaaagcccggagcagacggaagggtatgagggtttctatcacctgaccagcatcaaagggacggtggatcgcgccgagatgcactacatcatccgcgattttgaccgccaggcttttgaggcgcgcaaacgtaagatgatggagatcgccaaaaaggtcggcaaagggctgcacccggattgttacattgaactggtgatcgaagacagctattacaatatgcgcgagaaagtcgccgagtttccgcacatcatcgacattgcgcagcaggcaatgcgcgattgcgatatcgaacctatcatgaaacccattcgcggcggcaccgacggtgcacagttgtcctttatgggattgccctgcccgaacatcttcaccggcggctataactaccacggcaagcatgaattcgtgacgctggaaggcatggaaaaagcggtgaaagtgatcgtgcgtattgcggagttaacggcgaaaagccattaacaccggattgggacgaccataccgttgtaggcccggtaagcgcagcgccaccgggcatcacaattcccccaggtaaaggattaccccatgtcaaattatcgtcggcattacatccccggtggcagctggttttttaccgttaacctgaaaaaccgacaaagcgatctactgattcgtcacattgctctgctgcgccgcgcaacgtcctttgttaaacatcacaaaccctttcatattgacgcctgggtgatcctgcccgagcacatgcactgcatctggacgctgccggaaaacgacagcgatttttccggccgctggcgggatcttaagaaaatgtttacccgttcgctgaacagccgcgatatctggcaaccgcgattctgggagcatacattgcgggacgaggaggatttccggcggcatcgggattacatcaatattaacccggtgaagcatggctgggtggtgcgggtgagcgactggccgtattcaacttttcatcgtgatgtgcgggacggcatttatccgctggactgggcgggtgagatagcggatttgtccgcgggggaacggcgggaagagtagtaccgccgggcggcgctgcgcttgcccggcctacgttcgaccataccgttgtaggcccggtaagcgcagcgccaccgggcatcatattcacatcttaatcttcaaagaaccagtagccgctgttcaccagcgccgcgagcatcgcgaggaaagagggatcttccagcgcgtcgcccagcgtgtcggcggtgatcaccatcttgctggcaagcgctgccagcgccggacggtgcggcgactcgatcttctcgccattggcaaagacatcatccccaatgcgcaacacccgtaagccgcccagacgcaccagtttatcgccctgttgcagcgcatcgtagatctcatccggctgatacggcggttccggcggcgcgacgtccagctcgtgacgcgactgggaaataaactcgccaaaccactgctggaaatgctccggctgattgatcagatcgagcatggtagcgcgcacacgatccagctcctgcggcagaatgtctgccgggtgttcgcgggacggcacgtcaggatcggtgtaacgaagcccacccagttcccgttgcagcacataatcggcaaagccgctgatcagctcgcggccactcggcgcgcggaagcccaccgaatagttcatcgaattttccagcgaatagccttcgtgcgggaatcccggcgggatatagagaatatcgcccggctccatctcttcatcgatgatggcatcgaacggatcgacctgtaacagatccggatgcgggcagtgctgtttcatcggcactttctcgcccacccgccagcggcggcggccggtaccctgaataataaacacgtcatactgatcgaaatgcgggcccacgccgccgccgggcacggagaaggagatcatcaaatcgtcaatacgccagtcaggcagcgtacggaaggggcgcatcagcgccgcggttggctggtgccagtgatccaccgcctgtaccagcagcgaccagttggtttcgccgaggtgatcgtagctctcaaacggaccatggctgacctgccatttcccctcctgatggctcaccaggcggctgtccacttcgctttccatagccagtcccgccagttcgtccggcgaaagtggatcgacaaaatttgcaaaaccccgcttcagcaccacagggcgtttttgccagtagcgtgcgatgaagtcgggccagtctaacgttaaatggtagtccatataattttccagggcttacgtacctgaaacggattataacggaaggatgacaggctgcgtgcagcggcagcgcttattttctgcggatgctctaattatcagcggatatgagctgctggcgggcaaaaatcacttccatgcgcgcgccgccgagcagactttcccccgccaggatcttaccgtcatactgctcgacgatttcgcgggctaccgacaggcccacgccctggccgggacgcagcgtatctgcccgctggccgcggtcaaataccatgtcacgcttgctggcgggaatgccgggaccgtcgtcttccacgatgatatgcagccgatcatcgtgctgatgcgccgaaacctccacgaactccagacaatatttacaggcgttatccagcacgttgcccatgacttccataaaatccgtctgctcgccgacaaagctgatctccggcgaaatatcgaggctgatatccacgcctttacgctggtaaaccttattcagcgccgaggtgagattatccagcagcggggcgaccgggtgtaattcacggctcagcaacatattgccgctgcgcatactggcgcgatgcaggtaatagccgatctgctgcgaaatgcggctgatctgctcaagcatcaccggttccgcttcgctgaccgtcagcttttcgctgcgcaacgagcgcagggtgctctgcagcactgccagcggcgttttcaggctgtgggtgaggtcggtcagggtggtgcggtatttgtcatagcgatcccgctcgcttttcagcagacggttgagattgctcaccaggctggtcagctcgcgggtggtttccgggttcagccgttcccgatggtgctcttccagctcgcgtacctcgcccgccagcgcttcgatggggcgcaggctccaccaggccgcgatccacagcagcgggatcaccagcaacaggtttgcggccagcacataaataaaccagctccacaccatataggagcgcttaagctcaatgggaatggtgtcgatcaccacaatggttaactgcggcatacggggcgtggcgggatagacgttaatcgccaccgagtgcgtcatttcgctgtcgctgtcatcctcacggatcgcctggagacgttgttgcgcatcgtggtcgctgctcagcagcagacgcgaagcatccacatccgcttcgatttcatgaaagccgttagcctgtaaccattccggacgaatacgtttgataagccagggcacctcgcgctgagcccacagcagtttgccgtggcggtcgtagatcagcgccatggacgggctttgcagattgagattttcagggatctcaatgctgaactgattattttcccagcgggagagggtatagaacagattgctttcgccgcgtagcaggcggaaggtggttttatcgaagctgacgctgtaacccaccagcgccaccatgccgtaggccagcgacagcaccatcaccacggcggcggtagccagcagaaaacgtacccgcagcgagagcggtaaaaggcgacgcagcagttttctcattcgcgcagttcgaacaggtagccctgaccgcgaacggtagtgatcacatcctccgggtactgcacctgaattttcttgcgcagacggcccatcagcacgtcgatggtgtggctttcgcgcagctccgcatcggggtacagctgcaacatcagcgaatctttgctcaccactttgccgctgttgcggatcagcgtttccataatggtgtattcaaaggcggtaagtttgatcacttcgccattcaccgacagctcacggcgggagagatccacctggaaaggcggcatggagatcacctgcgacgccagcccgctgttacggcgcatcagcgcctgcatccgcgccgccacttcttcaatatgaaacggcttggtgacatagtcatccgcgccggcgctcagcacttcaactttatcctgccagccttcgcgggcggtcagcaccagtaccggcagcgacacttcattgctgcgccagcggcggatcagcgacagtccgtcttcatccggcaggccgaggtccaccagcgcaatatcgggaatatgctcgtttaaatagtaatccgcttcttttgcatcttcggcatcgtcaacctgatggcccagttcctgaagctgaactttaagatggtgacgcagaagggcattgtcttccacaacgagtacgcgcattgtctggcctcgcttttgtctttgataagatgagtttaacgcggattatgttacgcaaggcataaacatttactaaacagccccctttccgggcgggaagggggcgaagggcagggaaattacttcagctcatcaaccatggtgacggcacgaccgatgtaattggccggggtcatggctttcagacgggttttctcgtcttccggcagttcgaggctgtcgataaactgcttcatgccttcagcgtccacgcgtttgccgcgggtcagctctttgagtttttcatacggcttctcgataccgtaacgacgcatcaccgtctggatcggctctgccagcacttcccagttatgatccagctcgtccagcaggcgctcgcggttcacttccagtttgctcacgcctttcagcgtcgactgataggcgatcaacgcatagccgatacccacgccgaggttacgcagtacggtggagtcggtcagatcgcgctgccagcgggacaccggcagtttgctcgccagatgctgcaacagcgcgttagacaggcccaggttgccttcggagttttcgaagtcaatcgggttcactttatgcggcatggtggaggaaccgatttcaccggcgatggttttctgtttgaagtggttcagcgccacgtagccccacacatcacggtcgaaatcgatcaggatggtgttaaagcgggcgatacagtcaaacagctcggcaatgtagtcgtgcggctcgatctgcgtggtgtacgggttccactgaatgcccagcgaggtcacgaactcttcgctgaactggtgccagtcaacttccggataggcggcaatgtgggcattgtagttacccaccgcgccgttgattttgccaaggatctccacctgcgtgagctggcggtactgacgctccatacggtaggcgacgttcgccatctctttacccatggttgacggcgtggccggctggccgtgggtgcgtgacagcaacgggatatcacgatactgcaccgccaggtctttcaccgcgtcgatcagtttacgccagtatggcagcaccacttcttcacgggcggtttgcagcatcagggcgtgagacaggttattaatgtcttccgaggtacaggcgaagtgaatgaactcagacacggcatgcagttcagggatatccgccactttctctttcagaaaatattccaccgcttttacgtcgtgattggtggtgcgttcgatggttttaatgcgcgcggcatcggcttcattaaattcagcgacgattttatcaaggtaaccgtttgcgtcggcagcaaaagctggaacttccttgacagctgcatgcgcggccagcttttgcagccagcgaacttctacctgtacacgaaacttcagcaaaccgtattcgctgaaaatcccgcgcagcgcgctgactttatcgccgtagcgtccatcgacaggggatacagcggtcagtgaggataattccataggtcacaactccgggagttaacaatgagcaagaatttgtttagcctgcgtggacaggcgattacgggaaaacattaattgcagacggccgccgccaacctggtgccacagcaccgcggcacggatcccggccagcagggcagcgcgcactttcgcctgcacctgcgaactttgcagcaccgccggggaaccggtaacctgaatgcgcgggccgaggggactgatcacgtccacatagatagcggccatgctgctcagcagggtgtcggactgcaaatcgaaatgatcgagctggcgctgtaagccgtcgatgcggcttcccagcgtgtccatcgcgcctttactggcggccagtttacgctccagcaccatcaggctcagggtatagcgcgtcagttccgcattcagtccctgacggctgccggcattcagcacgccgagcagggtttcaaggccgaggcgcaggttggcttcgctgccgccaaatacgccgagcgtggagtccgggcttaaatcaatcacgctgttgagcgacacatgcagcgcgtcggcatcgcaatgcccgtgatgtgcaagctcctgcaccaggcgggctgactggcaaattcccgccagcgctatcgtgatgtcataataattttttgccaccttgtctccttactttcgctttaatcaggcgttaaacgggcagcggcagacgctgctcaatgatgccgccgccaaggcacacgtcgcccaggtaaaataccgcggactggccaggggtaacggcagcaacaggttcgtcaaagcgaacgtcaatcctgtcttcatccagcgccgtcaccgtgcagggaatatccgtctggcgatagcgcgttttaacggtgcagtgcagcgtgccggttaacggctgacgatccacccagtgcagctgttgggcaatcagacccaccgacatcagacgcggatgatcgtggccctgagcgacaatcagcacgttgttttcaacgtccttgtcgaccacgtaccacggatcttcgctgccttctttggtgccgccaatgcccagacctttacgctgacccagcgtgtgatacatcaggccctggtgctcgccgatggtgtcaccgtcgacggtcacgatcttgcccggctgggcaggcagataacggccaaggaattcgcggaatttgcgctcaccgataaagcagataccggtggagtcttttttcttcgcggtgatcagccccagctcttcagcgatctgacgcacctgcggtttttccagctcgcccaccgggaacaggctttgcgcgatctgttcgtggccgagggtgtagaggaaatagctctgatctttgttgccatccagacctcgcagcagacggcttttgccatcgacatccgcgcgacgcacgtagtggccggtggcgatataatccgcgcccaggtcttcagcggcaaattcgaggaaggctttaaatttgatctctttgttgcacagaatatccgggttcggagtgcgcccggctttatattccgccaggaaatgctcgaacacgttatcccagtattctgcggcaaagtttacggtatgcagctcgatgccgagtttgtcgcacaccgcctgcgcatcggcaagatcggcggcggcagtgcagtattcctcgccgtcatcttcttcccagttcttcatgaacaggccttccactttgtagccctgttgttgtaacaggtaagcagagacggaagagtcgacaccgccggacatgccgacgatcactttttttgggctatcagacatagaatactcacgacattgaacttcaaggcggcgtattctatcacgcgttagcgactcaggcatcccctgtaaacggccagttaaattcaccgatcagcgccagcgggtggcgctgcccggtctgccagctacgaatactttccgcaaccagcggggagcgcaggttgtcggcggtgaggatctcctctgcgctgacccacaggcagcggtcaatatcgctgtcatggggttcagtagcgcacagagtgtcaagttcaatggcgaaaagaaaacgcaggaaaggcgtgcggtcaggggcgatccactgatgcatgcggataaagtgctgcgggtcggcaacgatgccggtttcttcatagagttcgcgttttgccgcctgcaccagggtttcatcggcttccagatgcccggcgggctggttccaggtggccttgcccctgactttttcttccaccactaaaaatttgccctgcgcatggacgacgcaggcgacggtaacatgtggtttaaacatagtgttgtccttattcggtggcgtcgcgccactcgccattagcaagagaatccagcgtgtatccacccatcgcataacggatcagccgcagcgtggggtggcccacatgggcagtcatacgacgcacctgacggttacggccttcatagagagtgattttgagccagctggtgggaatggctttacgctcgcggatcggcggattacgcggccacagccattcaggctcagccactaactccacgcctgcggccagggtagggccatcgttaagcgtcacgccgttgcgcagcgcggccagcgcctcgtcattcggttcgccttcaatctgtacataatagattttgccggtgcgtttaccgggttgcgtcagctgcgcctgaagcgcgccatcattggtcagcaccagtaacccttcgctgtcgcgatcgagacgaccggcggcatagacgcccgccaccggaacaaaatccttcagcgtgcggcgtccggcttcgtcggtgaactggggcaacacatcgtagggtttattgaacaggatgacccgtttcggcccgctttctgtagggcgcttagcagtatgtcgtgagctgaatcgcttaacccggtgatttctattagaagttttcagcatggtattttcagaagttatcaattgccgcattataaccgaagaacgagtgcctttcatgaaacccaacaatcagttagtattgacaggctcattacaattcattaacaaaaaatcagtcataaccagaagcgctcgaaggagaggtgaatggaaagcaaagtagttgttccgacggaaggtcagaagatcaccctgcaaaacggcaaactcaacgttcccaataatccgattattccgttcatcgaaggcgatgggatcggtgtggacgtgaccccgcctatgctgaaggtggttaatgccgctgtggaaaaagcctacaaaggtgagcgtaagatttcctggatggaaatttacaccggtgaaaaatccacccagatttatggccaggacgtctggctgccaaaagagacccttgatctgatccgcgaataccgcgtggcgatcaaaggcccgctgaccaccccggtaggcggcggcattcgctccctgaacgtggccctgcgccaggagctggatctgtacgtgtgcctgcgtccggtacgttattatgaaggcgtgccaagcccggttaaacgtcctgacctgaccgacatggttatcttccgcgaaaacgctgaagacatctatgccggtatcgaatggaaagcagacagcgccgaagctgaaaaagtcatcaaattcctgcgcgacgaaatgggcgtgaagaaaatccgcttcccggaacattgtggtatcggtgtgaaaccgtgttctgaagaagggaccaaacgtctggtgcgtgcagcgatccagtatgcgatcaccaacgatcgcgactctgtgaccctggttcacaaaggcaacatcatgaagttcaccgaaggcgctttcaaagactggggctaccagctggcgaaagaagaattcggcggcgagctgatcgacggcggcccgtggcagaaaatcaagaacccgaacaccggcaaagaaatcatcattaaagatgtgattgccgatgcgttcctgcaacagatcctgctgcgtccggctgaatacgacgttatcgcctgtatgaacctgaacggcgactacatctctgatgcgctggcagcccaggtgggtggtatcggtatcgcgccgggcgcgaacatcggcgacgaatgcgccctgttcgaagcgacccacggtactgcgccgaaatacgcaggccaggacaaagtgaacccaggttccgtgatcctgtccgctgaaatgatgctgcgtcacatggaatggttcgaagccgcagacctgatcgtcaaaggtatggaaggcgcgattgctgccaaaaccgtaacttatgacttcgaacgtttgatggaaggcgctaaactgctgaaatgttcagagtttggtgacgcgattatcagccacatgtaattcgccaggcgggttatatgcacaacgggagccgaaaggctcccgtttttttttgccacaaataaaacatcactattgagcagcgttgcgtctgcggcggcaataaaaaaacattacaaaggttgaaaaaattatttgtcggcacgcttgaaaaaccgccagcagatattatttttaatcacggacaagcaatgcttgcctgaacattaaacttttgaacaggaattcgggagattaatcatggcactcagaactttgtcagcatttccaacattagctgattccctcttttccgatcgctttaaccgtatcgacaggctgttcagccagcttaccggtgatacgccggtggcggcagccccgtcctacgacgtgaaaaaacgggatgccaaccactatattatttcggtaagcgtgcccggctggaaggagagcgaactggaaattgaaacggtcagtggaaacctgacaatttccggtaaacgtgaagaagagtcctccagcgaacaggagagctggatccatcgcggcatctatcggcaggatttccagctgagtttctctctgccggaacatgccaaagtcagtaacgccagcctggcggacggggtgctgacgttagatattcatcaggaaatccctgagagtgaaaaaccgaaaaaaatcgccatcggaaacaatcaaaaagtgctcgaacacaaagcgtaattgttagccttgtttttacgttggcccgctaatgcgggcctttttttcgccgctttaatggctttaaaacccgtcattttctgatttctggacgccatcagggaagataacctaagctttataacaggttaatcttagttagatgagagttctggcatctgatgtgtgcggaacagtattaaaggagtagcaagcgatgaaacaagaagaactgacacgtaaagctgaagaagagatttccgcgctgatagctaaaaaaatcgctgagatcaggaagaaaaccgagaaagaggtttctgagatagaatttgttccccgcgagacgatgaccggactcgaaggttatgacgttaaaataaagctgctgtgagctgcagccaacgacgccacaggaattgccgtaataacgggaacataccgttcccgtttattatttaaccggctcaattaattccgtcccctggtttctgatattgcccaccgcacgggtaaccggatgccagataaattcttccgccggtatcgcaccatcagcggcaatatcactggcttcgctgccgctaatctcctggcgcatccactccctggccgcgtctggcgttaacaccagcggtcgacggtcatgaatatccaccagccctttatccgccgctgcggtgacaatcaaaaagccttccgcttcatcgccgcgctcaaagggcgtgctgccgatggcggccataaagattggctgaccattagcacgatgaataaaataaggctgttttctatcgccttcttttttccattcaaaccagccgtccgcaaagcagatcgcccggccatgcagccagagcggtttaaacattctgctggtggctgcggtttcgacacgggcattaataagcggcgctttgctccaccagccgggcgcgtacgaccacagcacaggatcgagatagagcttttcgtcgcgctcgctcatcagtaaaacctttgttcccggcgcgacgttataacgacctataggttgtggatcgaaggcaatgtcgcgctccgtttcctccaccagaaaggcgaggtactcttcccggctctgtgcctgggcaaatcttccgcacataaacttctccggtgataacaacgtgcccggcggcgctggcttgccgggcctgattaaatacaaaacaaacaccccggctcagggccggggcgtttatttttaaatatcagtgtgcgcctcagaaccagtggtatttggacgatagcgtcataaccagtgcggcagcggcaagcaaattaagaagaacggcagttctgctggaaatattcatcttcgcatccttcacgtgacaacgtggatgttggtaatacagtaaggccaaaacaacttccctgagtgtagtgaggactgacgattttgcctcgtcaaatagtcttattttttgtcggaaaagaattttcggacaagtttgatgactatcaatcttcagaggcgtcagattcgtcttatctgttatcatcaccggcgcctgaaattacataaaacggagaacagacgtgaccatttttgacaccctgctggcgtacagtcttgccgccacgttactgacgctgacccccggtctggatacggcgctaattctgcgcacggcctccgtcgagggaaaaagagcggcgtttaacgcggctatgggtattaacgtaggttgttttatctggggagcgatggtggcctttggcctcggcgccctgattgcggtgtcggaactggcgtacaacatccttaagtattgcggcgcagcctatctttgctggctggggatctctatgttgctgcgtccgggtagcggtttacccgtcagcgaaagtggcaaaaccacgcataactggtttctgaaaggtatgctggggaatgtgctgaatccgaagatgggtgtgttttatgtctcgttcctgccgcagtttattccccacggacagccgctcattgcctggaccttcgggctggtggcgatccatgtaatgatcggtatgagctggtcaacaacgctgatcctggcaacgcgtccgctggcgagcttcctgaagcgcgaaaaggtttcccgctggatggatcgcagcacaggcacgctgtttattctgtttgccactaagctggcgctgagtaagcgctaagcaaaaacgggcgcgcgatgcgcccgttcctgacattatgctgcgctatcacgcagcttaaacacctgcaccatctccagcagcctgtgcgcctgatcctgcatggcgtgcgccgcggcagaagactcctgcgacagcgtggcgttctgctgcgtggcggtgtccatatgcgtcattgcgatatgcacctggtcgatccccacgctctgctcattgctggcaattgaaatggtgtccaccagttggctcacgcgctcgacgctgcgcacgatctcctgcattgcgctaccggcgttattcaccagtttattgccgtcgctgatccgatttaccgagcgttcgattagctcaccgatctctctggcggcagtagcagagcgctgcgccagggcgcgcacttcgctcgccaccaccgcaaaaccccgcccctgattgccagcccgcgccgcttccactgccgcattgagcgccagaatgttcgtctggaaggcgatgctgtcaatcacgccgataatgctgctgatctcgctggcgagcaggttaatatcgcgcatggtatccaccactttctccaccacgttaccaccctggcctgcggtggcgcaggcttcgcgggtcagggtgctggcgatgcgcgagttctcggtgttgtttttcaccaccgaagtcagctgttccatcgacgccacggtctgctccagcgcgctggcctgcgcttcattgcgggccgacagctccaggctaccggtggcgatctgcttcgaggcgctggcgatagtctcggtgccattgcgcacgccgttgacgataccggtcaggttatcgttcatctcccgcagggcgcgcatcagcagggcggtttcatcgcgtccgctgacggcgatagtggtttgcaaatcgccggcggccacgcggcgcgccacggatacggcctgcgccagcggacgagtaatgctgcgtaccagccaccaggtgatcatcagaccggctatcagcgtcagggccatcgccagcaacaacagatatttagtttgctgatacagcgccatgttgcgatcgtgcgtctgctggcggatgcgatctgcctgtttgagcgtggcggctaccgtctcgtcgatcatgcgcgtcggttcccgatcaatgccggacaccagcttatccacccgctgcgcgctggaaggatcctggatatcgtactgggtcagcgcagcgagataatgcgcctcaagctcgctatgcagctggcgggttcgttccaccagcccggtatccagcccgatttgcggcagcagggtagcaagttccgtcagcagcgcctgggttttctggctctgggcgacaaatgcatttttatatttatcgaagctgtcctgtccctgaccgccgcgcagcagcgtatttttccactcctgcacctgaattttgaactgtacctgtgcatttcgcgccgtatcgatactttgcgtcacacgtttttccgtcgccataatgtgctgattctgcgtcagcccgtcggcgttaatcactaatcctctgctgccgataaacagcgtcgccagcagcagtaccgcagccagtaaaccgagccgctgcccgatagtaaggtggttaagtttcattgtatctgtagttcctgaggtcaagggtgccatcggaatgacgagcacacaggtatcgacccggcggcgacgggctttaatggcgggagtgcggtaaaaagcagcaaagtggcgttaatcggttgatatgcaataactatataattttatgacatatttatgacaggcggcaaaatagccaaaagccgcctgtttaacccgctacaggaaattgcgcagcgacgccacgtcaagaggactggcttcggtgagccatgcggggattgcctctggcggcaccgggcgcgagaaaaagtagccctgcgcttcgtcgcagccataggactgcaacagcatggcggtctctttatcttccacaccctcagccagcaccagataattcagatccttgagcatcataatcacgtgacgggcgataatgcggctgccgggatcggtggtcagctggctaatcagcgaacggtcgagcttgataatatcaatgggaatacggcgtaagtagctgatattactgtaacccgcgccaaagtcgtcgagcaggatcttaaagcccttcattttcagccgatccagttcacagagcgcctgctcgctctccagcactttttctgtttccaggcattcaatgcgaatatcctgcgccaccaggcctgcctcaaggatctgctgctccagcatatcggcaaaaccggggcaggaaaaatcgctgaccgtcacgttgatggataccggcagcagaatgcccgccgccctccagcgcctgagctgagcgatcacggtgcggatcacccagtgggtaatgtcgttcatcaacgtggttttctccgccagcgccacaatggtggcgggggaaatattgcccagcacaggatgctgccagcgcagcagcgcctcgcatccttcggtgaaaccggtgtgcagggatattttcggctgatagaccagataaaactgatccggcgctttgatggcctcgctcaaatcgtaaagcaatttaaaatcgctgttgcgcttctcatcgaacgcgcggtcgaagggcaggacaggaatatgctggcgaatcgcttcatgcagtgcgctgatcccctggcgtaatatctctttcggatcctcaataccgggccggaaattcacgtagccggtaaagattttcaggcgaatgtcgatgtcgccgcgaattttcgcctcaatgtccggcaggttttccgcttttttgatcaatgtttttgcgtattcgctgtcaattaacagcgcaaagcgtcccggtgcgaaagcatataacggcgtggtggccggtaattttaaccgcaggcgtaaaagtggcccgaagccgcgcagcattttctccacggcgctcagcccaagatagcgtgaaagctcgtaggcctgtggcatatcaatgcagtcaaacaggataagcgtagagggacgatgagcggtctccagccctatgcgctccatctctttcagtaaaaactgccggttgggcaggccggttaacgcatccacccgccctaaagagtaccaggcttccagataggtgcaggccagcgaagcgatacgcaggaaattttccgtttgctgtgcatcaggttcaagcggcgtcggatggctgacgcacagcgtgccaagcacgaacccctctttggtctgtaatggcgcagcggcataaaaaataacgtgaccgttcagcgacagttcatgatcgcgaaagcgatcgtcaaggcgcgtatcgttacagataatggcattgcagctttttactgaatgctggcacatcgaatctacaatcggcattttcagcggaatagccggattgtttttcacaaatttaatgtactgatgctgatcatcaaaaatagtaacaaaacagccatcaacgcccatgatttcactggcgagacaggcaaattcgcccagcgcagcatcacgggcgctgtcctgttccttaagtaacgccagggccgccagtcgtttggtttcatttttattcaggccggtgaacataaggcgctcctgctcagaacggtgctgagtctggggaagaatttttgcagggaagagttatttttagcgtatggcggggatcaccaccagccgaactgggatccggcaacggcggcgatagcaataatcagcataataatggtggtttttctcacgtaagtctcccgaaaggcgctgctggccggacaatgtacataatggcaatcagtattttcttatacgataacggattactgcgccgcgttaaatgagactttcattgccagcgtgaaaaacccggcccggtggcatcctgaggggagggtgacagaacggccttcgccagggtaaacttcgttttcggatttatcttaaacatctttaacgaagcacgagagcagcatgtacttgttaaaaccgggcagccaggccttaatcattggcgcgcagacccctgtcggtcgtcgtaatattggtaaatcggtagagctgttcggcctctgccagccgggtgagcgttttctcaaccccgtgaatggggtgatgacgcagatgccagataacgcgccgcgcgcgctgtggctggtgatcggcgatgtctttacctttgacggccagcatggtttcgcctttgtgcgcgccgaacacctgatgccgctgctgccggatgccatgcctcaggaagccgacgcccggattatgtattaagcacatagcacctctcacttttaaggtgttgtgatagcgataaaagatcattattctgatgttccttatgttacccataaattgcacaacatagggaacccccatggaccacctgcctgtcaaagaaaccctgcgtatcgctctcgtcggtgattacaatcaggacgttattgcccaccgggctattccgctggcgattgatgatgccgccgccgtacaaaacatcactgctgattatgactggctggccacgaccgacatcaccagcgccgaggacttggttggctacgatgccatctgggtggtgcccgccagcccttataaaaatcctgaaggcgcatttatcgccattcgctacgcccgtgaaaacagcatcccgttcctcggcacctgcggcggttttcagcatgcgatgatcgagtacgcgcgtaatgtgctgggctggggagataccgcgcacgcggaaaccgacaccgaaggccggatggtgatatccgccttacagtgttcactggtggaagaaacaggggtgattgaactgcgcccgaacacgctgatcggcaaggcctatggccgcgacagtattgaagagggctatcactgccgcttcgggatctcacccgaatttgccgatgccctcagcagcagcgattttcgcgtcaccggctgggacgaagagggcgagatccgcgcggtggagctgatcagccatccgttcttcgtcgccaccctgttccagcatgaacgcggcgcgctggccggacgcccggtgccgctggtgcacgccatgctgcgcgcggccagcaactaactttcctgatagtcgcggggtcagccagcgttgatctcgcgatcctgtccggcaaaagcgccgaataccgccatcgccaccgctaacagcgcacaggcgagcagcggaatatgccagtcgccgctggcatcatgaattttccccatcagcggcggcccgcaggcggccagcagataacctaccgattgcgccataccggataaagccgccgcctggtgcgctgaactggcgcgaaggccgataaacgtcaggccgaggatcatggttgcgccggatccgaacccaaagatcaccgtccacagcaccgcctgcgccgggaacagccacagcccgacggcgctgaaggcgcacagcagcgagacgatagcggcgatgccgcgttgatcgcgcagacgatgcagcaccagcgggatcagaatacccggcgcggcggtcgccagttgcaacagaccatgcagcgatcccgcctgcgcctcgctgtagccgtggctgatcaaaatcgcaggcagccagccgataatcacataataaatcagcgagttaatgccgaggaacagcgtgacctgccaggcaaggcgcgagcgccagataccgcgatcgtgcaggccgggcgtgctgctgagtgcggcaggcgcgctggcgcgcaactgcggcaaccacagggcaagggcgagcagcggaaacgccatcagtgccagcagtgcgccgcgccagccgaaaccgtgcagtgcaatgggcaccaccagcgccgagccgagcgccgccgccgcgcccatggtcagggaataggcgccggtcattttcgccacctgaccggcgaaatcacgtttgatgatccccggcagcagcacgttacccagcgcaatgccgcagccgatcaccgccgtgccggtaaacagcagcgccgccgagggcagggagcgcacggcgataccggcgcaaatcaataccatcgccaccagcagactgcgctccatgcccagacggcgcgcgatgcccgccgccagcggggacaccagcgcaaaggccagcagcggcagcgtcgtgagcaggccggtctgcgcggtggtgaggccgtagtcgtcacgaatagcccccagcaacggggccgcgccggtgaaagtgacgcgtaacgtggtggcaatcaacaggatcccggtaaacagcagcaatccctgccttgtgcgaagtgaaatagcggtagtcattatattctctgttttctggcttattgagccgcgtcagtctaatcccagaacgtccacccgccaaatctggcagcgcatcatgccgatgattttctgcttgtcagaccattcttaaggtgtggttattccgggtttatgctgccggaaaggaaattataagaggatcctttcgtgcaggcgtttttcataacttttttcgatatgtaatgcactttttgatatttgtctgtgcggggagagctgtgtgaatttagcagcaatttcaataacaacggatcaccattagcatggcaactttcgcacagaccaaaaaaaccgtcgcgctgactgcgctggcgctgctgaccacgctctcctttgcggcgcatgccgataaactggccgacatcaaagccgcgggcgttgttaaagtcgccacttttgatgccaacccgccgtttggcgccatcgatgcaaaaacccacgacatcgtgggctacgacgtggatttcgccaaagcgcttgctaaaagcctcggcgtgaagctggagctggtggcgacaaaccccgccaaccgtattccgctgttgcagtccgggaaagtggatctgattgtcgctgacatcaccatcacgccggagcgcgcgcaggtgatcgatttctccacgccctattttgtgaccggacagcaattcctcgtccccgctgacggcaaagattcgctggatgcctacagcaaagcccgtatcggcgcggtgaaaggcaccaccggcgagcaggcgctgcaccagcgtttcccgcaatcccgcgtgctggcctatgacgatatcccgctggcgctgaccgcactgcgtaacggcaatgtgcaggcgatcacccaggatagcaccattcttgccggtctgctggcggaagcgccggacaaagcgaagtttaaaatcctgccggatctactgtcgaaagaagaaatcggcgttggcgtcagcaaaggcgaaaccgcgctgctgaaggcggtgaatgacgaactggtgaagcttgagcagagcggcgatgccgcgaaaatctacgacgcctggtttggcccgcaaaccaaaaccccgcagccgcgcagctttaaaatagaagcgaagtaattatgtttgcaggtttattttccacctccgtggcgtcggccacggaggcgtttgccgtgcaaaaaggtacggtcgaattccgtcaggtgagcaagcgttacggcgatcatcaggtgcttaagaatattgatttgcaggtgcgcgccggggaagtgcttgccgtctgcgggccatccggatcgggaaaatcaacgctcattcgcctgatcaaccagctggaaactctgaccagcggcgagatccttatcgacggcaaccccaccagcgggctgaaaggccgcgccctgcggcagatccgccgccaggtgggattcgtgttccagcaattcaatctttacgcccatctcagcgcgctggataacatcaccctggcgctgacccgcgtgcatggtaaatcggcagtggatgcgcagcagatcgccctcagcctgctggagcgcgtcggtctgctggataaagcccatcatttcccggcgcagctctccggcgggcagcaacagcgggtggcgatcgcccgcacgctggcggccagcccgcatattattttgtttgatgagcccacctcggcgctggatccggagatgatcggcgaagtattacaggtaatgaaatcgctggcgcacagcggcatcacgctgatcgtcgtcacccatgaaatgcagtttgcccgcgaaatcgccgaccgggtgatctttattgatgacggtgaaatccttgagcaggcggccccggcgcagtttttcaccgcgccgcagcatccccgcgcgcagcggtttctgcaaaaggtgcttaacccgctacatgcagaaagcagggacggctgatgaactttcatcctgactgggccggcgtgctgaccggccagccggcgcagtggatcctctccggttttttgaccacggtgtgggtaacgctggcgggtatgctactcgcgaccttattgaccgtgctgttgctggcgttgcgtctgaccggcgggcgcgtggggcgggacgtggtggcggtgtgggtgtcactgttccgcaatacgccgctgctggtgcaactgctgttctggtatttcgctgcctggaatctgctgccactggcatttcgtcagtatgtgaatgacgagcacgtcttctcggtgctgccgggggacgtatggtggtttacgccggagtttctcagctcagcctgggcgctggggctgtttaccgccgcctttctggtggaggagatccagtccgggctgcatgccgtgccgcgcggccaggtggaagcggccaccgcccagggttttagtccgctggcgctgttccgctggatcttactgccgcaggggctgaaaaatgcctggcagccggtggtcggccagtatctcaatctgatgaaactctcctcgctggcgaccggtattggctttgcggaactgacctaccagacacggcagattgaaagctacaacgcccatgcgctggaggcgttcgccatcggcagcgcgctctatttgctgctcggcctggtgatgagtctgctgctcaatgcccctgtctggtggcgggcgcgtaaggagaaaacacaatgatcgccagtattacggtcattaccgacaatctggattatctgctgctcggacgtaccgcgcagggcgagccgggcggcgtgctgctgtcggtgctgatgacgctgggggcggcggcgctggcctttcccggcggcatactgcttgcctgttgcgcctggcgtttcaaaggctggccgcgcagggcgctctttttctgggcggagctgatccgcggcattccgctaatcttcgtcattttctggctgtggtttttactgcccgcgttgaccggtgctgatctgccgggggcggtgaccgtcacgctggcgctggcatggttcacctcggcctcggtgatgtattcgaccctcgccgccctgggagcgctgccgaaagggcaatatgaggcggctgtcgccgggggattcagcagtctgcaactgttgcgctgggtgctgctgccgcaggcgctgcgcaatgcgctgccgtcttatgtcggcctgctcatcgccctgctgaaagatacctcgctggcgtttatcgtcaatgtgccggaactgaccaccgtcgcaggccaggtaaacagccgcgtacaggtctatccggcggcgctgtttatctttaccggcctggtttattacctgatgtgcagcctgctggagcagtcggtgaaacgctggcagcggcgacgtttactgccgtccaattaacagcgacaccaggcctgcggcgatcagcgggccgacgggcaccccacggaacagcgccacgccgagcaccgtaccgaccagtaatccggccaccagcgacggctgcgagctcatcagcgtgacgccacgcccgccaagccaggagacaaaaacgccaaccgcaatagcgatcagggatttccagttggcgaaggagtgcaacagggtggaaggcggcaggctgccgctggcaatgggggccatcacgccgatggtcaggatgatgatgccgatggtcagcccctgtttttcgatccacggaaaaaaggcgttgagcggcgtcacccgcacgataatcagcaccagaatggagatcgccacggtggtgttgtggctggcaaaacccagcgcggcgagggcgagtaaaataaacagcgtggtatcgaacatggcggcatcctgaccagaaaagttagcctgcttactttacgcgcatccgcgtgaagaaacaggcgttttttagttcagatgattttcaactttgtaccagcaaatccaccagcgggctgttttcccgtacgaataccggaatggtttcaagggacgcatcaacggtgatttgctgctgcccctgataacgctcgccgttaagcgccacccagccgtggacgcccggcagccagacgtcacgctggcgctgaccggcatgcatcaccggcgccaccagcagatcctcgccaaacagatactgatcttccacctgccagctttgcggttcgtcaggataatgccagaacagcggccgcatcagcggatcgccatgctggtgggcgttgtcaaacagcgcatcgacatacggacgcagcgattcacgcaccgaaagccagtgctgcataatggcgaaattctcctcgccatagctccacagctcgttcggcgaaccgctgttacactgcggaatgccgttgcggtagctttccggcggctggatctgcggctcgcgatagccgtgcatacgcagtaccggacagaagactgcccattggaaccagcggatcagcagttcatggaacgccggatcgttcacgttgccgccctggaaaccgccgatatcggtggtccaccagggaatacccgccagccccatattcagcccggcggccagctgattgcggaaggcgtggaaggacgagtgcacatcaccggaccaggccagcacgccaaagcgctggctgcccgcccaggaacagcgcaccagattcacaatctccgtttcgccgttagctaccagcccatcataaaagccctgcgcaaaatcgcgcggatactggttgccgacttccagtaccggcccggcgtggtagcggtagttatcgaagtcataggcgcggtattccggctcggcttcgtccagccagaacagcttaatgcccagatcgtagtaatttttcttcaccgtctcccagacaaattcccgcgcctgtgggtgggtggcatcaaagaaggtggtgttgcccataaaatcgagattcacctgtacaccgcgatcgctggtcaccagccagcctttggctttcatcaccgggaacagggggctgcgcgcttccaccgtcggccagaccgacaccatcagttcgatgcccagcgatttcagttccgcgaccatcgccgccggatcgggccagtccacaggatcgaagcaccaggtgccctgatttggccagtggaagaagtcgatgaccatcaccgacagcggcagatggcgacgacgatattcacgggccacctccagcacttcctgctgggtgcggtagcgcagtttgcactgccacaggccgctggtgaatgccggggcggacggcggggtgccggtggctttcgcgtactggcgggtcagttgtacgatgttgtcgccggcggtgatccagtaatccatctcctgagtaacccgcgcctgccattcggtgtggtttttcgcaaagctcgcctcgccgatggccggattattccacagcaggccgtagccgaggctcgactgcatgaacggcacgctggcctgggagttacgctgggccagctccagcacacagcctttcagatccagccacggctgttggtactggcccatgccgtagattttttcgtcattgcgcgattcaaagcgcacggtgagctgatatttgccgccgggcagcggtttgaattcccgaccgtccagcttcagggcgctgacgtatttatcctggcttttctcgctggccccaatgccgacggtggagcgctgccgccacatctcttccagcagcagctcgccgcgctggttgtaaaaggccagctgacccttcaggttcagcaccgcggtgatattaccgttgcgcagcgtcagggtttccgcgctggcggtgatctcacttgcaccggcgtcgtttcgtggcagcagggcatgcagattatcggtgaacgccggggcgcaggtggcgcgcacgcgcaggctgtgttcaccccagggttccacgcgcaggatttgtcgctcaaagcgccattcgatgctgtcaggatgttggatcagttcgctcataaataatgcgtccttttatgcagccgtttgcttagctaaatggatggatttcatggtgttgtcgtcgagcttgtaccagcgcagcatggcgaaggcgcacagggagagaacgcccggcaccacggtaaagagcgcgacaatgcagtacatggcggtgctgttctgcgtcggggcattagcgacataaccgctgaagcccagcgtccagccaacgatagcgccgctgatcgccatgccaagtttcagtaccgcgaggaaggtggagaagatcacgccatccatgcgtttgccctgcaaccattcgccgtagtcagcgacgtccgccatcatcacccacatcagggtggtggtggcctggtagagagtggagacgataaaggtcagcggcaccagcaccagtacggatttaggtgcgaagaacagcgcaatactcagtacgcccgccagcaccgcacagtaaccaaacatctgcactttgctgaaattacgcgtcagacgtttcgccagcgcgctgcccgccgctttgccgagaatatgcgcccccagcatccacataaaatagctggcgctgccaagataataagtgacgaaatacatcatcgcgccaagacgtaccaccccaaatccaatattggtcagcaccagcacggcgacaatgcgccactgatcgttttttaataaatcgcgtaattccgcgagataattattatgcgtggcgggagcattgatacgttcacgggtattggtaaaacagatccagaacatgatcaccgccgccgcggccataatcgccattgccgcacggtagccgagtaatttgtcatcgccgccaatatattctgccagcggcatcataaagaaggtcgacatcgcgccgccgagggtggctaaaaagaaacggtaagactggagtgaaatacgctcttcgttattgggggtgatcaccgcgcccatcgaacagtagggaatattaatggcggtgtacatcagcatcatgaaggtataggtcacggaggcaaagatcattttccccgtcagggtgagggattccggcaccgcgtaggtcagcagacagctcgcgccaaagggcagggccagccacagcatccacgggcggaacttgccccagcgggttcgggtgcggtccgcaagataacccatcgccggatcgataatcgcatcggcggtacgcgccagcaaaaacatcgtgccgacaaaggccgccggtaagccaaccacatcggtgtaataaaaggtgagaaatataatgacattatccagcccgacatggctggccatatcgcccagaccataacttattttttctttacgggtgatcttttcctgcatcttattcacctgtctctgtaagggtattttgtcgatagttcagagactattgttgatgcatgttgtcaggcttaacaattgcgagatttactaatggggttatggaaacgcattttcgtgataccggtaacaataatggcggtaatttccatattttaagtgcttttagtccatatcctaaaagcaggaaataacgcagcgcaggaatcgtttcagcggaataatattcatattaatacaggaaaaacgacataaatttgtcatgcgcgctggctgataatggcgcatcgtccgtaaaagcgacaggtgtgacaatgaacgatcccatgctaatggaaacgctgattatcacctccacttttttagccattatcatggtgctggtggcatcagtactgattctggagcgttccggctgaagctgccgggcgggaaaagaaaaagccgccacgggggcggcaaaaaggtaacgtgtttcttagttattgtttctgtaataagtagctgttttcgtaacccggtacgacgccaatgacgtcaaagccccggaagtaacctccggcacgcagcagatccaccgcaggacccacttccggcgaatactgatgatcgcgatagtcatcaaacacaatgtagccgccgctgatcaccgttggcgaatagagcaggaaatccatcagcacatggcgtcccaggtgaccgccgtcgatatgcagcagcaaggttttcgggttgaatgccagaacgcgctcaatgctgtgctctgaataaccgcgtaccagattcacttccgggaacaggcgctcgtgatagaagcccagttcattagcctgattcggcaactccatcggatcgacgctgatgattttgcgtttacgtttacacatttcgttcatgaaagcgctggatttacccttccacacgccaatctcaatgatgtcgccttcggctttagaattttccagcagccagcacagatagccgaggaatttcacatgcgtgtggaaagaaagctctttgcgcggcatcgccagttccggcggcagcgcggcctgcgcttcaaccatggctgcgccaaccgaatcccagacgtcatcaatgacccgttgtaattcaggatcttctaaaaataatttcaggtctgaaatttcgagcatcagggcggtttccttcgtgtagtgagttggtggtatttacctgacgttaaatttgccacagaaggcgcgggtacaaggcgggaaatagctggcattttgccgggcatttaggcggatagcggaaatgaaaaagccggtggactgaagttcaccggcttttttgcaaaaaacatcaattatgggcgtcgctggcctgtttgtggaacagctcgcggaacaccgggtaaatatcatcctgatcgcgaatatgctggatagcgaagttatcgaagcttgcctgtaaatgctcatattcacgccacagcgtctgatgggcgcggcgggtgatctcgatataactgtagtaacgcaccaccggcaggatcttcttcgccaggatctcatgacacagcggtgagtcatcggcccagttatcgccgtcggaggcctgcgccgcgtaaatgttccactgcgccggatcgtaacgctccttcaccacctcatccatcagcttcagggcgctggaaacgatggtgccgccggtttcctgcgagtagaagaattcatgctcatccacttctttggcctgggtgtgatggcgaatatacaccacttccacgttcttatacgttctggaaaggaacagataaagcaggatataaaaacgcttcgccatgtctttggtggcctgatccatcgagcctgacacgtccatcagacagaacatcaccgcctggctggacggctccgggcgcttctcatagttcctgtaccttaaatcaaaggtgtcgataaaaggtacacgttcgattttcgcccgcagttcggcgatctcccggcgcagctgttcctcttccagtaattgcgccggttcgctgttcgccacctgttccaggttttcttccagctcgcgcagctgacggcgcttgcccgcggtcatcgccgtacggcgcgccagcgaattttgcagtgaacgcaccacgctgatatttgccggtacaccgttcgcggtatagcccgcacgatgggttttgtattcgttaagctggcgatgctgattctttttcaggttcggcaatgccagatcttcaaacagcagatcgaggtattcatctttggagatctgaaagacgaattcgtcctggccttcaccgtcctggctggcctgaccctgaccgctgccgccgccaccgccgcccccctgcggacgttcaatgcggtcgttctgcacaaagtgatcgttgccgggatgaacgcggttacgcaggccgccgcgtccctgatgaaacataggttcgttaatatcttcagacgggatggaaacggactcgccgctgtccacgtcggtgaccgagcgcttgttgatggccccggaaatcgactgcttgatttgcgatttataacggcgcaagaagcgctggcggttcaccgtgctcttgtttttgccgttaagacgccggtctataaaccaggtcatacgccctccgtactgccaactgttcgcaggatctgtaggtgccgggctacgcggaggcaaccccggcctacggagtattattgttggcccggcgtgcgccgggcggctgtcaggacgatttacgcacgcgcagataccattcgcacagcagacgaacctgcttgcgggtatagcctttttccatcatgcgatcaacaaaatcgtcgtgtttcttctgctcgtcggttgaggttttggcgttaaaggagatcaccggtaacagctcttcggtattggagaacattttcttctcgattaccgtgcgcagtttttcatagctcgtccagttcgggttgcgaccgctgaagttcgccctggcgcgcagcacaaaattgacgatttcgttacggaagtctttcgggttgctgatcccggcgggcttctcgattttctccagttcggcgttcaacgattcacgatcgaacagctggccggtatccggatcgcggtactcctgatcctggatccagaaatcggcgtaggtgacataacggtcaaaaatgttctgtccgtattccgaataggattccagatacgcggtctggatctccttgccgataaattcggcatatttcgggatcagatagcctttgaggaactccagataacgctccgcctgttcctgcgggaactgctcgcgctcgatctgctgctccagcacgtagaacaggtgcaccgggttagccgccacttcggtatgatcgaagttaaagacgcgggacaaaattttgaacgcaaatcgggtcgacagaccgttcatgccttcgtccacgcccgcgtaatcgcgatactcctgataagatttcgccttcggatcggtatctttcaggctttcgccatcatagacgcgcattttggaatagatgctggagttttccggctctttcaggcgcgagaggatcgagaagcgggacagtgtttccagcgtcccgggtgcgcagggcgcatgggccagctcactgtgattgagcagtttctcgtagatcttcatctcttccgagatgcgcaggcagtacggcaccttgacgatatagacacgatcaaggaaagcttcgttattcttgttgttacggaacgtcacccattcggattcgttggagtgcgcaagaataatgccgttaaacggcagggcggaaatcccctcagtaccgttatagttaccttcctgtgtcgccgtcagcaggggatgcagcaccttgatgggcgctttaaacatctcgacgaattccattacgccctggttggcgcggcacagcgcgccggaatagccgtaggcgtccggatcgttctgcgcgtggttttccagtttacgaatatccaccttgccgaccagcgccgaaatatcctggttgttttcatccccgggctcggttttggcaatggcgatctgctccagaatcgacggccagactttcacgacgcggaatttagtgatgtcgccgccaaactcgtgcagccgcttcgccgcccatggcgacataatggtgccgagataacgccgcggtacgttgtactctttttccagaatttgcgcatcttcctgcggattgaacaggcacagcgggtggtcgttgaccgggctgcgctcgccgttagcgctcagcacgtaaatggggacgcgctgcattaaggatttcaggcgctcggccagcgacgatttaccgccacctaccgggccgagcaaatagaggatctgtttcttctcttccagcccttgcgcggcgtgtttgagataagaaacgatttgttcaatggcttcttccatgccatagaactcttcaaaagcggggtagcgtccaattaccctgttcgaaaacagacgggaaagccgtggctccagagcagtatccaccatcactggctcaccaatggccatcaacaggcgttctgccgcattggcataagcactgcgatcctgccgacatatggaaagaaactcctgcagtgtgaactcttcgtccttggcagcttcatagcgctggcgatagtgatcgaatatattcatggcatgccgtcctttcgttttttagcacaggttaagagccgttcatatgaattgtggaggctcccggaagaggtaggttgaacgttgctgatgagtaccaacaacccgcgtgccaggtgacaggacgcccggcgctcgcgtgctcgcgatacaccttcttaaaattaagcgtagatggcatttgcaaaacttgcatgccaccgcaaaccaatttcaatgacatatcaataactcatctgatgtttttctgtttcgtgatataggccgcgccagcgcttcatcgcagcgtcatatcattgcaaacgcgctgtcattatcagaccgcaagatgatgtgttgagttttgtaatattcgggtaaaaaaatttgggaagcacggcgcggacagttacacttcactggccccattatttgacgataggaaagaaaggattgtgaccaaattcaaagttctggcgctgggcgttctgaccgccatcacagccacttcagctctggctgacaataatttctcggtaggtgccggtgttggtgtccttgaaacgccgtataaggactacgatcgcgatgtggttccggtaccggttatcacctatgaaggggatgacttctggttccgcggtctgggcggcggctattacctgtggaacgatgagagcgacaaactctccatcaccgcctattactctccgtttgaattcaaacctaaagacagcgacaactggcagctgcgtcgccttgataaacgtaaagcgacgctgatggcaggcttgtcctacgtgcacaacacccagtacggcttcctgcgcaccagtctggcgggcgatactctggataacagcaacggtatctcctgggatctggcctggctttatcgctataccaacggcggcctgacgttaacgccgggtatcggtcttgagtggagcagcgaaaacatgaacgaatactactacggcgtttccggtaaggaatcccgccgcagtggtctcgatcgctacgatccggacagcgactggagcccgtatctggagctgagcgcgagctataaactgactgatgcctggagcgtttacggcgttggccgctacacgcatctgtccagcgaagtcaaagacagcccgatggtggataaatcctgggcgggcgcattgtccgcaggggttacctacagcttctgattgtgcaatgacattgtgcattcagtgaataacagggcgcttttgcgccctgtttgcattggagtggaacaacactcacaggagacgagcatgagcgataaaaccgtgatgtttgagcgcgaactggccctgcccgccatcgggcagggcacctggtatatgggggaggacgccagccagcggcaaaaagagatcgccgcattgcgtgcaggcattgacgctggcctgacgcttatcgacaccgccgaaatgtatgccgatggcggcgcggaggaggtggtcggcgaggcgcttcagggcttgcgggagcaggtatttctggtctcgaaagtctatccatggaacgccggagggcaaaaagccattgccgcctgcgaagccagcctgcgccgtctgcaaaccgattatctcgatctctatctgctgcactggcgcggcaattattcctttgtggaaacggtcgaggcgatggaaaggctgatccgcgagggcaaaattcgtcgctggggcgtttcaaatctcgattatgacgatatgcaggaactgtggagcgtgacgggcggtcaggcctgcgccactaatcaggtgctctatcacctgggatcgcgcggcattgaatttgatctgctgccctggtgtcggcaacagcagatgccggtgatggcctattgtccgctggcccaggccgggcggctgcgtgatgacctgttcaacagtcgcgccgtacaggaggtggcccatgcgtatcaggccacgcccgcccaggttttactggcgtgggcgatccgcgagcaggggttgatggccataccgaaagcctcaagcgcagaccatgtgaaagagaatgccgctgcgctggcgctgaacttatccgccgaagccattgccctgctggacaaggcgtttccggcaccggggcgcaaaacgccgcttgacgtggtgtaatttttcccctctcgcagggagaggggagatgtcttagcgtttaaccacgcgaatggtctgcgccaggcgggacggtttttcttccgtggctttctgggctttagtggcgcaggcagtttccacgcatacaaaagtcttatagccgtcgtccggcatatcgcccatgctggcggagagcgccgggccagggttccagccaaccacgttacagtgatgatggtggatcacttcaatggtgcggttcagcgcgccgtcgttgatgatgctgcacgcttccggattcaggtagacgcgatcggtacggtccgggaaggtttgcacgccgtcagtcagcacgtcttctttcgcgccgttcactttatcaataaagcgatcgccgaggccgctaactttcaccgcgctgatatcgccaacgttgaaataggtgtgcagggcagagaaggtttcgaattcgccatgggcttccagctcgatttcacaggttttgccgagcttaaagcgggcatagagggtgaagtcatgcggccagtactgacgggtggcatcgctgctttgcagttcaaaagtcagcaccacgccgttatcgtcttcgttatgggctttcagcgtccacggcaggttacgggcgaaaccgtgtgccggcaggccttccttcgccgccgggccaaaccacggccagcagatgggtacgccgccgcgcagcgccacgccatttttgaacggcgtagtatcgctcagccacagtacttcttcagcgccagcgggtttccaggagagcagatgcgcgccctgcagggcaaaggaggctttcacctgcgggtgatcgacaacaatgaggtccagatcgtccagcacgcggcgggaaagggcggtggtgaactggtcaacgaccggaagagcaaaaattttagtaatcatcatgatattcctcaatcctctgtcttcaatgcaaaaaaaagagcgaccgaagtcgctcttttggatcagattctcatctcaacttatttggagatgtgagcgatcaggtccagaactttgttggagtagccagtttcgttgtcgtaccaggaaaccagtttcacgaagttgtcgttcagtgcgatacctgctttagcatcgaacacggaagtgcacacttcgccgttgaagtcggtagaaacaacgtcgtcttcggtgtaacccagaacgcctttcatttcgccttcagaagcggctttgatggctttcttgatttcttcgtaagaggctgctttttccagacgaacggtcaggtcaacaacagatacgttcggagtcggaacgcggaacgccataccagtcagtttgccgttcagttccggcagtactttacctacagctttagctgcaccggtagaggacgggatgatgttctgtgctgcgccgcggccgccgcgccagtctttgtgagacgggccgtcaacggttttctgagtagcggtggtcgcgtgaacggtggtcatcagaccttcaacgataccgaagttgtcgttgataacttttgccagcggagccaggcagttggtggtgcaggatgcgttagaaacgatgtcctggccttcgtatttgtcaaagttagcaccacgaacgaacatcggggtgttgtctttggaaggaccagtcagaaccacttttttcgcgccagcggtgatgtgcttacgagcagtttcgtcggtcaggaagataccggtagcttcagcaacaacgtcaacgccgatttcgccccatttcaggttagccgggtctttttcagcggtaacacggatggttttgccgttaacaaccaggtggccgtctttgacttcaacggtgccgttgaaacgaccgtgtgttgagtcatatttcagcatgtacgccatgtactcagcgtccaggagatcgttgatgccaacgatttcgatgtcagaacgttcctgcgcagcacggaaaacaatgcgaccgatacggccaaaaccgttgatacctactttgatagtcatatattccaccagctatttgttagtgaataaaaggttggctgtaaaattacaaaaaccttacgcagcgtcaagcggaatcgtgtcaatcattgcgacaaatcaatcctgtgcacaacctttgcgcgactgagtcgcctcacttttccaatgggctgctacccacatggggccgccggctggaattttaaaggccatgcaagataaatatgtgaatcagatcacaattacctggctgcgatttcgcaacgtctaagtttagaacaaaagtcgacgcctgcctgttaatgttttgttagaatcaaagaaaagatgtgaatgtactcaacgcgagaagtaagcatatggctaatgatccctctcaggacgacctgaaaaaaaacctcactgaaatgcagttctatgtcacgcaaaaccatggcacagaaccgcctttcaccggtcgtctgctgcacaacaaacgcgatggcgtataccactgtttaatctgcgatgcgccgctatttaacgcccagagcaaatacgattctggctgcggctggccgagcttttatgaaccggtcagcgatgaggccatcaaatacctgaatgactactctcatgggatgcagcgcaccgagatccgctgtggcaattgcgatgcgcatctggggcatgttttcccggacggtccgcagccgaccggcgagcgtttttgcgtgaattcagcctcactgagcttcaccgatgacgacagcggcgagcaaatcaagggttaaagaatcgattcagcaaattattccatgcggagacaagaaatcgtgaatgtggatgagcttgttaacagtttaacgccggaagtgtaccagcgtctggtcacggcggttgagctgggcaaatggcccgacggcgtggcgctgaccccggagcaaaaagagaacagcctgcaactggtgatgctctggcaggcgcgccataacaccgacgcccagcatatgaccatcgataccaatggtcagatggtgatgaaaagtaagcagcagctgaaagaagagtttggcattacgccaaaatccattgccacgctgaaagtgaattaacaactctttgtaacaggccgggaagcgcgcttacccggcctttcaatgttttatggtttactgaccagcgattcagccagctgtttcgctaactggttattatcatccgcgccatactcccagaacatcgccccggccagtccttttttcttgatgtaatccgccttgattgccactgagcgcgggttttcgtaactcagcgcaaagagcgcttttccatcggcagatttcaccgacagccagggcactttcgcctcctcatcccagtgttccgtaaaacgcttctgcggatcgttgagcagcatttttacaatatcgttgtattttacgtaggtatcttttttaagatcgaatcccagggcgttgaaaagcgccacttcccgttcgccaaagtaaggctgtgtaacgggatttttctgcgcgtcaggtttgctccagtcgatgccaggctcaacggcgcgcttcggcacgcgtccataaaatccaatgcccagattcatttgccgcgccttcacgcctgccgccagatagttattgaccacaaaatcaacgctgtatttatccgcggcggcaacggtcggccaggccgtggagtcatacagattggcattgaaatactgggtgccgtaggccatgtcgtaggtcatcagattgatgtaatccagcaatggcgcaacggctttcatatccacccagcttttcggactttcggcgttcgcgccgacggcgatagtcaccagctttttatcgccaaaggcctcccgcagttctttgagtaaggtggtgaagttatcccgatcggcaggctggctgtcgaccagtccccatgcgccgtttaccgggtactcccagtccagatcgataccatccagcccatagcgggtgacaatatcctgagccgaacggatgaacaccgcgcgcgcttccggtgtcgcggcgacagcggaaaatccacgcgcgccccagccgcccacggatagcagcactttcagctcaggattttgtttgcgcagggtgggaatcaacgccagatcggcggcgacttttggggaaagccaaatctgatgccgcttagagggatcttttaacgcgtcgttagtttcgcctttttcgtcgttatagatcaggccaaatgagtaattcaggtgagtaatctgacgaacatccagggtgtttatatctccgccaggcccggcggtaacatctccaccgccgttaaaataaccgacagacatcagagaactggctgaggcgagcggggcgcagagcaggggtaacgctgccagcaaaggcaaaagtttcatggtagttcctctttgacaaaaaaataaagccaggcaaaagcttggcgaaaaaacaacccgcatagcctggcatagtcgttgcgctgatactgcgaagaacttcactttatgtcgttgaaggggaacaaaaagaacgggcattgatgatcaatacccgtgtagaacgttaagcgtgtgtttctacccagtccgccagcgtatagagcgtcgcgcccgctgccgccatctccataaacgcatgcgcgctgtcctgagcatggagattcacgccacggcagccatcggtaatgacatccacgctgtagcccagcgtcagcgcgtccagcacggtaaacttcacgcagtaatccgttgcaagacccagcacgatcagctcgttaacgtcatgatgtcgcagccattcatcaagctgcgttttttgccggtggccgttgtcaaaaaaagcgctgtagctgtcaatcgccgggttttcgcctttatgaaacagcgcatcaatggcctttgcgtttaacagcggatgcagcgccgccccttcggtgttctggacgcagtgatccggccagaaggtctggggcagcccgtccagtaatccttcagaataaggctcgacatgctgctggcttgcaaaactgccatgatccgcagggtgccagtcctggcttgccaccaccgcgtcgccgcgcgttttgcaccagtcgatcatggcgttagcaatatctaccgtactgtcgccttcggcgaccgccagcgcgccaccggcgcaaaaatcgttctgaatatccactaacagtaatgcccgggccatagtctgctccttattcgtccggcgtcagttcgccgcgcaaattgacggccatcgcctcgcggatggcctgcacatccagatcctgacttaacagataatgcagtttagtcagcgttgcttccaccgtcatatctgcgccgccaatcacgcccgcgtgcgccagcgcgttacccgtagcgtaaccgcccatattcactttgccggacatgcactgggtcaggttgatcaccacaatgccgcgctcgctggctgcctgtagctctttcagaaactcgccgttttgcggcgcgttaccgacgccataagagcgcaggatcaaggccttcaccggctggcgcaggaagttacgcaccacgtcggcagaaatgcccggatagatagtgaccacgccgatcggctgtggggtgatgggatgcacaatcagctccccatcgccatggggcgcagggggcgtgccgagacggcgaatatggatcccggcttccagcaacggttgcagattaggggaggcgaaggcatcaaagccatcagcatgcgccttggtggtgcggttgccgcggaacagacgattgttgaagaacagcgtcacctcgttaatcgggtagttcgccgcaatgtacagggaattgagcaggttgatctgcccgtccgagcgcagctccgccagcggaatttgtgaccctgtcacaatcaccggcttgccgaggttttccagcataaacgacagcgccgaggcggtgaacgccatggtgtcggtgccgtgcagaatgacaaaaccatcgtagcgatcgtaattcgatttaatatcttccgcgatatgctgccagtcctgcggcgtcatgtcggaagagtccatcaacggatggtattcatgaatggtgaagtcgggcatctcctggcggtgaaactccggcatcagcgccagctggcgttgcaggtgcccggaaaccggaatgtagccctgctcggagcgctgcatgccgatagtaccgccggtataggcgacgtaaatcgatttcttttgcatggtgttctgtttcatagccataaaaaaatcccctcatggctgaggggatggattatcagcgaacgttagcgcaggtcaggcaaaacgcatagcggttttgcggatcgttaaaggccgccagcttatcgctttccgctttcactgcaccggcgaccggagccagcggcgcgggcagataagcctgtaacgccgacggcatcgccgcgcggacgctggcggacatgctggtgatcacctgatcaaagaaggtcggctcatcctgataataatcaatgtgccactgcttgagcttcgccagttcagccgctttcgccaccgcatcatcgaaatcgcccagcgcgtccaccagcccgtttgctttcgcgtcctgaccggtccagacgtggccctgagcaatctggtcgatctgctccggcgtcttgttacgcgactgagaaacaatcgacaggaagcgcttatagccgctctcaatgctcaactggatcatctgctgcacttccggcggcagggctttggtcgccgccacgtccgccagcggcgaggtcgccacgccatcggtgtgcacgcccacgtaatcgaggctgttttcaaaggtgttgatcaccccgaagatgccaatcgagccggtgagggtgctcgggttcgccacaatgtagttagctggcgttgagatccagtaaccgccggacgccgccatgccgcccatggagaccaccaccggcttaccggcggctttcgcggcggcaagttcagcacggatcacctcggaggcgctgacgctgccgccagggctgttcacacgcagcacgatagctttcactttcggatcgagacgcgcatcgcggatctgcgaggcggtggtgtcgccgccgacgttacccggggtttcttccccgtccatgatcgcaccgttagcgaagatcaccgccacgctgtcgccgttttcgctcggttttttcagggcgtagtcgtagtagctgatggcgctgtagtttttatcagcgtcgctccagccaaactgtttgctgagcgctttttcaacttccgcgctggacgccagctgatccaccagtttgttatccagcgcgtacttcgccgtatcgccacccactttggtcagcccttccagcatcgcctgggcgccagggaaaatctgctgcgccggtacctgacggttggcggcgatggtgttcaggtagttctgccacagctcgccgacccagcggctgtcagcctcgcgcgcggccggggacatatcgtcgcggataaacggctcgacggcggatttataggtgccgacgcggaaaacgtgcgtggagacttttagcttttccagcagcgatttgtagtacagcccgttagtggcaaagccatgcagatccaccacgccctgcggcgagaggaaaattttattggcgaagctggcaaggtaatactgaccctggctgaagttatcgcctaccgcatagaccggtttgccactgtcgcggaattcgcgcagcgctttaccgatatactgcatcgacggctgatcggcaccggcgaagtttttcagatccatcacgataccggtgatattgcgatcctctttcgcctggcgaatggtctcgacaatatcaaacagcgagttttcctgtaagcgatcggagctggcgccaaacagctgacggcccagcacgcccagcttgctgctgctggaaggcttatccaccaccacaccggcgatatccagcaacagcgcgccacggttgctgtgctcggcattgctgctcttcacctgcatccagatgccgacgcacaccacgattaaaaagataaagaaaaggttgagcaccagttcacggacgaaattgagcaatcgccatgtccatttaaaaaaaccagcaatgaaacgccaaagggttcgcatgtattcttcctgtcctgattaacaacccccgctaccctgagcggaatgtgcggttatcctaattacccggcggcaacttgtcagcaagatccgccgccgtcgctgtaacaaaatctcctgtcgtgttaattttatgcataaatttgatgacaggagttaactaatggatgcacttgaactgctcgttaaccgtcgtagcgcctcccgcctcaccgaaccggccccggcgggcgatcagctgaaaagtattttacaggcaggtatgcgcgccccggatcatggcacgctgcagccgtggcgcttctttgtcattgagggagaagggcgcgagcgcttcagccagttgctggagaaaggcgccattgccgcggggctggatgaaaagggcattgaaaaagcccgctccgggccgttccgcgcgccgatgattattgccgtggtcgccaaatgcgaagatcatcctaaagtgccccactgggaacaactggtttccgctggctgtgcggtgatggcgatgcagatggcggcgctggcgcagggctttaacggtatctggcgcagcggcccgatgactgacagcccggtggtgcgtgaagcgctggagtgccgtgaacaggatcatatcgtcggttttctctacctcggcacgccgcaactgaaggcctccaccaccatcagcctgcctgataccacgcctttcgtgcgttatttctgaacctcgcccgggcgcttctgatcttcgcagaagcgcctggctagagagaatagtacccgcctaacgccttttttaaggcgttaataatttgtcgcttccagggcgtcgttgacgtgcggtactgaaaaaacacgtttccttccgcctgaaacccgttgagcggcagggtataaatgccttcacggtcgaccagggcggcaacccagggggcgggcaccacggccagcaaaggcgcacggcgtaacgcaggggcaagctggctgtaatcctgacagacaaatgacaggtgacgggataaacctgcccgggcaagctgtctgtccagctcattggctgcctgcggccaggggtggcagtagaagtgctcaaactgatccagctcgctgaactcaacgctggttttatccctgaactgttgccgcagcggcgcgccataggcgaccaccagccgtgcgctgccgatccgttcgtaatgcagggcactggagcctttttgatgatcgcccacggcaatcagtaaatcgattttcttcgcaattaactcctcacgccactcacggcgctcaaacgcatgacactcaatgacggctttcgcctgatgcccccggtgcgcaagctccgaggtaagcaacacatttaacgctggcggcaacaccaggcgaaaccgacgatcttcaccggtttcactgccgaacagttcttcatttaacgaaacgaaaagcggcgcgagcctgtcctgaatatttctggcaaagggcgtgggaacctgctgattgccttcacggcgaaacagcggatcctgtagcgcttcccgcagcctggtgagggcatggctgaccgcagacgcgctgatccccagcttttgcgccgtcaggctggtggagcctgtcatcagcatgacatgcagaattttaagaagattgagatcgaattgaaggatattcattaagtggcagcgcaattgcacaaaactaaaaaggcgctcagtatactccgcctcctttgctaaaggagaaaatatgaatcgctctgccatgcttttaacctgcctgatgatcttgagcacccccgcggtattcgccgcgctggatcccattcccccgggcagtcaataccgcgacatggcggagaaaggcgataaatacgcgcagtattttcttgcggatacctggtttagcgcaggggatatgaagcaggcgcagcgctgggcggaaaaagccgccgccgccgggctgccggatgcctgggcgctgctggcaaacatcagcttacagcattccggtaaggcgcttttacaggcgaaacgatacgccgaaaaagccgccctcgcgggcagtgaagcgggaaaagtgatccttgcgcggattttacttcaccgttctgcggagcaaaaagcgtgcgcgcgggcgctgagtctgctggagcaggctgccggcaatatgcacgatgacgcggcggtggatgcgcaaatgtggctgggtttactttatgcgggcggaatatgcgttaaagaagatcatgcaacggcagcgtactggttaaaacgcagttcggcattgtcccgtaccggctacgccgaatactggacgggcatgctttttgcgcaaggggaaagcggcattgtgaaaaaagatcccgcgcgggcatcctactggttcgccagcagttgtcacgagggatttgacagcggatgtgaaaaagtgcctgcgataagaccatgaatagtcttaaaaataagtgtgctggccgccggaatgacagtctgacgcagggtgccggtgtttatgtcataacagaaggcggatgcacagtagcggcttgcccgattgagcgctaccatagccgcattgcaatgacaggagatgtccatgagcgagcaagctattcgtttaacgcagtacagtcacggcgcgggatgcggctgtaagatttccccgaaggtgctggaaaccatcctgcacagcgatcgggcgaagtttatcgatccgaacctgctggtcggcaacgaaacccgtgatgacgccgcggtttacgatctgggcaacggcaccagcgtgatcagcactaccgacttctttatgccgattgtcgacaacccgttcgactttggacgcatcgccgcgaccaacgccatcagcgacattttcgccatgggcggcaagccgattatggccatcgccattttaggctggccgatcaacaccctggccccggagatcgcccgtgatgtaattgagggcgggcgttttgcctgccagcaggcgggcattgccctggcgggcggtcactccatcgacgcgccggagccgattttcggcctcgccgtcaccggcgtggtaccaacggagcgggtgaagaaaaacagcaccgcgaaggcgggctgcaaactctatctcaccaagccgctgggcattggcgtgctgaccaccgccgagaaaaaatccctgcttaaaccggagcatgtcgggctggcgacggaagtgatgtgccgcatgaacctcgccggtgccggatttgccagcattgacggcgtcaaagccatgaccgatgtcaccggcttcgggctgctcggccacctgagcgaaatgtgccagggcgcaggcgtgcaggcgcagatccgctatcaggatgtgccgaagctgccgggtgtggaagagtatattgcccagggcgcggtgccgggcggtaccgggcgtaatttcgccagctacgggcatctgatgggcgacatgccgcaggcctggcgcgatctgctgtgcgatccgcaaacctccggcggtttgctgctggcggtcaccccggacgctgaaagccaggtacaggcgaccgccgccgaatacggcatcaccctgaccgccatcggcgagctggttgaagcccgcgcgggccgtcctatgattgagatccgttaagtcaatgcggttgtttattgccgaaaaacccagtctgggccgcgccattgcggatgtgctgccaaagccgcaccgcaagggcgacggctacattgagtgcggaaatggtcaggtggtgacctggtgtatcggtcacctgctggagcaggcgcagccggatgcctatgacagccgttatgcccgctggaatctctctgacttgccgatagtgccggaaaagtggcagctgcaaccacgcgcctcggtgacaaaacaaatcaatgtcatcaagcggttgctggcacaggccagcgaagtgatccacgccggtgacccggatcgtgaagggcaactgctggtggatgaggtgctgaactacctggatctgcctgcggaaaagcgccgcaacgtgcagcgctgcctgatcaacgatcttaacccccaggcggtggaacgggccattaaccgtctgcgcgccaacagcgaatttatccccttaagctcgtcggcgctggcccgctcccgcgccgactggctgtatggcatcaacatgacccgcgcctatacgctgctggggcagagcgccggttatcagggcgtgctgtcggtgggacgtgtacagacgccggtgctcgggctggtggtgcgccgtgacgaagagatcgaaaacttcgtggcgaaagactttttcgaggtgaaggcgcatatcgtcacgcctaaggaagagcgttttaccgctacctggcagccaagcgaagcctgcgagccgtaccaggatgaagaagggcggctgctgcaccgcagcctggccgatcatgtcgtaaaacgtattaccggccagcccgcgctggtcaccagctataacgacaaacgggagtccgagcctgcgccgctgccgttctcgctctccaccctgcagattgaagcggcgaagcgctttggcctcagcgcgcagaacgtgctggatatctgccagaagctgtatgaaacccataagctgatcacctatccgcgctctgacagccgctacctgccggaagagcattttgctgggcgtcaggcggtgatcaacgccatcagcgtacacagcccgtcgctgctgccgcaaccggcggtcaataccgatatccgtaaccgctgctgggatgataaaaaagtcgatgcacatcacgccattatcccgacggcgcgcagcagtaaggtgaacctcacggataacgaagagaagatctacagcctggtggcgcgtcagtacctgatgcagttctgcccggacgcggtcttccgcaaatgcacgattgaactcgacatcgccaacggtaaatttatcgccaaagcgcgttttctggcggaagcgggctggcgcgccttgctgggcaataaagagcgcgacgaagagaacgacggcaccccgttgccggtggtcgctaaagacgatgaactgctgtgcgagaagggcgaagtggtcgagcggcagactcagccgccacggcatttcaccgacgccacgctgctgtcggcgatgaccggtattgcgcgctttgtgcaggataaagatctgaagaagatcctgcgcgccactgacgggctgggcaccgaagccacccgcgcggggatcatcgagctgctgttcaagcgcggtttcctggtgaaaaaagggcgttatatccactccagcgacgccgggcgggcgctgatccactcgctgccggaaatggcggcgcggccggatatgaccgcccactgggaatcggtgttgacgcaaatcagcgaaaagcagtgccgctatcaggattttatgcagccgctggtggggacgctgtatcagctgattgaccaggcccgcagcacgccggtgcgtcagttcagagggttagcggcgccaggcggggataagaagaaaagttttaaagggcggggtaagaaaaagccgcccgcgagtccggctccggcggcgtagcgcaggtcgccgggtaggttgaaatgtgccgggtggcggctgcgccttacccggcctacaaggtaaccccaggcccggcaagcgcagcgccgccgggcatccggattcagtcagcatgtaagcccggcaagcgcagcgccgccgggcatcacaaccgcaaatcagaccacgccctgcgccagcatggcgtcggcgatcttcacaaatccggcgatattcgcgccgcgcacgtagttggtctgcttgccatctccgccgtactccacgcaggcgtgatgaatatccagcataatatggcgcagacgcgcatccactttttccgccttccagctcaggcgcgcggcgttctgcgccatctccagcccggacgtcgccacaccgcccgcattcgccgctttacccggcgcgaacagcacccccgcttcgaggaacagatcggtggcttcgatggtggtcggcatattcgcaccttccgccaccgcttttacgccgttggcgataagcgtgcgggcggcgtcggcatccagctcattctgggtggcgcacggcagggcaatatccgccggcactgaccatggctgtttgccttccagatataccagcccgaactcgcgggcataatccgccacgcggccgtcgcggctggctttgatttcacacaggcgcgccagtttttctgcgttaaagcccgcttcgtccacgaccgtgccgccggaatcagaggcggtgatcacccgcccgcccagttccatgactttttcaatggtgtactgcgccacgttgccggagccggagaccgccacgcgctgcccttcgaaggccagaccgtgacgtttaagcatcgcctcagtgaaatagaccagtccgtagccggtggcttccgggcggatcaaactgccgccgaacgacagccctttgccggtaaatacgcaggcgctgttattggagagctttttcatcataccggccataaagcccacttcacgaccgccgacgccaatatcaccggcaggcacatcggtatccggccccaggtggcggtacagttcggtcatcagcgactggcaaaaacgcatcacttcgccttcgcttttgcctttcggatcgaaatcgctgccgcctttaccgccgcccatcggcagggtggtaagggcatttttgaacgactgctcaaagccgaggaatttcaggatcgataagttcaccgacgggtgaaaacgcatcccgcccttataagggccgatggcggagttaaactgcacgcgccatgcgcggttgacctgcacctgattacgatcgtcgacccataccacgcggaactggatcacgcgttccggctcaaccagacgttccagtaacgacatctgccggtaacgcgggttctcttcaataaagggccacagcgtggtcatgacttcgcgaaccgcctgggcgaattctgtctgatggggatcgcgttgttgaatacgggtaaggaaggtttccagagagcaagactgatccatcgatataacatcctcttatgacagtgggtctgaattttattgttggttgttaccgcattgtttgcgttttcgactataacaccggaaaagcggcatcaggcaagcgattaagaaatatgcagggaaattaataataggcaggaggtcataattaaaaacgatgaccgtgcacgttaaaggttcggcgatcttttaccgttatagttattaccaccacctaatcaggaaaaaaaacgatgatccgacacgctttattaaccgccagcctgctggcgctgctgaccgcgacggcacaggcagaggtgcggtacagtaccggcggcgttgatgtgaacgtgccgccggaagtcttctcctccggcgggcaacgtccgcagccctgtaatcagtgctgcgtttatcaggatgaaaactactcggaaggggcggtggtcaaagctgacggcattttattgcagtgccagcgtgacgaacgcacgctgagcaccaatccgctggtatggcgtcgtgtgaagccctgaggcttacagatcgaagcttgcccacacaggcgcatgatcggacggtttttccataccgcggatctcgtaatcgatcccggtgtcggtgcagcgggttgccagcgcactgcttgccagcaccaggtcgatacgcagcccgcggttatcgtcaaaaccttttgaacggtaatcaaaccaggaaaaacgatcctgtgcgtccggattggcggcgcggaaggtatccaccagcccccagccctgcaaacgggccatccactcgcgctcttccggcaggaacgagcatttacccgcgcgcagccagcgtttgcggctgtcttcgccgataccgatgtccagatccgtcgggctgatgttgacatcacccatcaccagcaccgggctgtctttgctgatttcgttttccagataatcctgcagatcctgataaaacttcgctttcgccgggaatttggtcggatggtcgcggctttccccctgcgggaaatagccgttgatcaccgtaatattgccgaggggagacgctaattccgccatgataatgcgacgctgcgcttcttcgtcatcgcccggaaaaccgcggcgcacggacaccggtgtatcgcgggttaacagcgccaccccgtagtgacctttctgaccgtgataaaacacgttgtagcccagtttcgccacatcttcgagagggaacatatcgtcatggacctttgtctcctgtaagccaatcacgtcaggctgatgcttatcaatgatcgcttgcagttgatgaggacgggcgcgcaggccgttgatattaaaagagacaaatttcatagtcgctgccacttagcaataaagagtgcagcgatggtagcagaaaatggccggcgttacgccccggcgctgcgcttttctgcgcatggctgcaacaggcgtcgccaatggtgcttaccatgccccgctgcggtgcatcccgccctgaaaaggggcgcggggcgcgatcaccttccgcgtaagatcacaattccagaattatattttagcaatgcataaaatttcctgccgatccgcccggcttcgctaatagcgcaaaaattattcactttttatgcaataaaagtgaatagtgacagattgtaagttactgatatttaaaatcctctccggcgttatgcacttttatcgctggctggcacgaagcgtgcaatctacattagcagcgcaaacactcataattattaacatatcaacaacctttcatttaccggatgaggtcgctatgtcccactctattacgcgtgaaaactttgatcactggatgctgccggtttacgccccggcgtcttttattccggttcgcggcgagggttcccggctgtgggatcaggaagggaaagagtatatcgactttgccgggggtattgcggtgaatgcccttggtcatgcgaacccggcgctgtaccgtgcgctcagcgaacaggcggcgaagttctggcacaccggcaatggctacactaacgaaccggcgctgcggctggcaaagcgtcttatcgacgccacctttgctgaccgcgtgttcttctgtaactccggcgcggaagccaacgaagcggcgctgaagctggcgcgtaaatatgctcacgaccatgcaggcccacagaaaagcggcatcgtggcgttcaaaaacgccttccatggccgcacgctctttaccgtcagcgcaggcgggcagccagcctattcaaaagattttgcgccgctgccgccggagatccgccatgcggagtttaacaatctggaatcggcccgcgaattgattaatgacgatacctgcgcggtgatcgtcgagccgatgcagggcgagggcggcgtggtgcctgcggatgcagccttcctgaaaggcctgcgcgagttgtgcgatcgtcaccaggcgctgctgatttttgatgaagtgcagaccggcgtcggacgtaccggcgagctgtatgcctatatgcattacggcgtggagccggacgtgctcaccaccgccaaagcgctgggcggcggcttccccatcggcgcgatgctgacccgcgacgcttttgcggctgtgatggtggtcggcacccacggcaccacttatggcggcaacccgctggcgacggcggtggcaggtgaggtgctggatatagtgaacaccccggcgacgctggacggcgtgaaacagcgtcatcaatggtttgtcgaacagttgcaggcgatcaacacccgccatgcgctgtttcgggagatccgcggcctcggcctgctgattggctgcgagctggcggcggaacatgccgggaaagccaaactcatctctcaactggcggcggcagaaggcgtgatggtactgattgccggtgctaacgtgctgcgttttgcacctgcgctgaacatcagcgaagaggaagtgcgtcacggcctggaacggctggcgcgcgcctgtgaacgttatctggcaggagaaagcctatgatggtgatccgcccgattgagcgcagcgatctcccggccctgatgcagctggccggtaaaaccggcggcgggctgacgtcgctgccggcggacgaagccacgctctccgcgcgcattgagcgcgcgcgcaaaacctggcaggacgaactgccgccgggtgaacagggttacgtgttcgtgctggaagatatccagagcggcactgtcgccgggatctgcgccattgaagtggcagtggggctaaacgatccctggtacaactaccgcgtcggcacccaggtgcacgcctccaaagagctgaacgtctacaacgcgttgccgacgctgtttctcagtaacgatcacaccggcagcagcgaactctgcacgctgttcctcgacgccgactggcgtaaagagggcaacggctatctgctgtcgaaatcgcgctttctgtttatggccgctttccgcgatcgctttaacgaaaaagtggtggcggagatgcgcggggtgatcgacgaaacgggctactcgccgttctgggaaagcctcggcaaacgctttttctccatgccattcagccgcgccgatcacctgtgcggcaccggacagaaagcctttatcgccgagctgatgcccaagcatcctatctatacccatttcctgtctgaagaagcccaggcggtgatcggcgaagtgcatcctcacaccgcccccgcccgcgcggtactggaaaaagagggcttccgctaccgtcactatatcgacatctttgacggcggcccgacgctggaatgcgacatcgatcgggtgcgggcaatccgtaaaagccgtctggtggaggtggccgaagggcagcccgcgccgggcgagttgcccgcctgtctggtggctaacgaaaagtaccagcaattccgcgccatgctggtgaatgccgatcccgataccgaacgtctgctgctgagcgccgcccagatggacgccctgaaatgtcgcgccggggaaaaggttcgcctggtccgcctgtgcgcagaggagaaaacacaatgaatctttggataaatggcgactggatcagcggtcagggcgaacaacgggaaaaaaccgatccgctcacccgtgagacactctggcaggggcgtgatgccgacgccgcgcaggtggccgaggccgggcgcgccgcacgcgccgcgtttccggcgtgggcgcgtcagtccttcagcgcacgacaggagattgtcgagaaattcgccgcgctgctggatgcgaacaaagccagcctgacgacggtgatcgcccgggaaaccggcaaaccgcgctgggaagccgccaccgaaattaccgccatgatcaataaaatcggcatctcggtgaaggcgtatcacacccgcactggcgagcagcacaccgccatgccggacggcgccgccacgctgcgccaccgtcctcacggcgtgctggcagtattcggcccctacaacttccccggccatctgccgaacgggcatatcgttccggtgttgctggccgggaatacggtgatcttcaaacccagcgagctgacgccctggagcggcgaagcggtggtgaaactgtggcaggaggcggggctgccgccgggcgtgctgaatctggtgcagggcgggcgcgacactggccaggcgctgagccagcttgccgatctcgacggtctgctgtttaccggcagcgccagcaccggttttcatctgcatcgtcagcttggcggtcagccggagaagatccttgcgctggagatgggcggcaataatccgctgatagtggaagatattgatgatgttgacgccgcggtgcacctcaccattcagtcggcctttattaccgccgggcagcgctgcacctgcgcgcgccgtctgctggtgaaacgcggcgcgcagggcgatgcctttctcgcccggctggtggaggttgccggacgcattatgcccggcgcctgggacgcggatccgcagccctttatcggcgggctgatttccccgcaggcggcagagggcgtgtataccgcctggcaggcgcaggaagcgcggggcggcaaaacgctgctggcgccgcggctgatcaaacccggcacctcactgttgacgccgggcattatcgagctgaccggcgtggctgacgtgccggatgaagaggtcttcggtccgctgctgggcgtgtggcgctatgacgagtttgacgaggccattcagcttgctaatgccacccgttacgggctggcctgcgggctggtcaccccgtcacgggagaaattcgaccggctgttgctggaggcgcgcgccgggatcgtcaactggaataaaccgctgaccggtgccgccagcaccgcgcctttcggtggtgtgggcgcgtccggcaaccatcgcccgagcgcctggtatgcggcagactactgcgcctggccgatggccagccttgaatctccggcgctgtcgctgccggagagcctcagcccggggctggattttggtcgggaggagacgcgatgaaagcgcgcgaagtcaattttgacggcctggtggggctgacgcaccattacgccggtttatcctttggtaacgaagcctccactgcacaccgtttccgcacttctgacccgaaactggcggcgaagcagggactgctgaagatgaaagcgctggcggatctgggctttccgcaggcggtgatcccgccccacgaacgcccgaatataccggtgttacgccagctggggtttaccggcagcgacgagcaggtgatcgccagagccgccgcgcaaaccccggagctgctgtcggcggccagttcctcgtcgccaatgtgggtggccaacgccgccaccgtctgcccgtcgtcagatgcccttgatggcaaagtgcatctgacggtggcgaacctgaacaataaattccaccgcagtaccgaagcgcccaccaccgaagcgctgctgcgcgccatcttccgggatgaagggcgtttcatggtgcatggcgcactgccgcaggtggcgcgttttggcgacgaaggggcggcgaaccataaccgcttcagccaggcgtacggcgagccgggcgtgcagctttttgtttatggccgggaagaaaacggccacgccgcgcctgagcgttatccggcgcggcaaacgctggaagccagccaggcggtggcgcgtctcaatcaggtggatccggcgcgcgtcatcttcgcccagcaaaacccgacggtgatcgatgaaggggtattccataatgatgtcatcgccgtgtcgaacggtacgctgctgttctgccatgagcgcgcctttgtgcagcagcgcgggctgatgacccgcctggcggaacaggtgccgggctttcaggttatcgaagtgccgcaggcgcaggtgtcggtcaaagaggcggtcagcagttatctgtttaacagccagttactgagccgcgacgacggcagtatgttgctggtggtgccgcaggagtgtcgcgagcaggcgaacgtctggcgttatctgaatgacatgctggcgcaggataatccggtgaacgagctgcgggtattcgatctgcgcgaaagcatgtccaacggcggcggtccggcctgtctgcgtctgcgggtggtattaaatgaggccgaacagcaggcggtaaatccggcggttatgatgaatgaccggctgtttgccgcgctgaacgactgggtggatcgctactatcgtgaccgtctcacccaggccgatcttgctgatccgcagctgctgcgcgaaggccgcgaggcgctggacaggctgacacagttactggatctgggatcggtctatcccttccagcaataaggatcgacgatggagaattttcttgccctgaccctgagcggccgtgcgcccgaaaacccgtgggggcaaaacgaccagctccgctggcactggcgggcagaggggatccttgagctgatcccgcatcagcccacggataaatcgctggtgctgtcggcgggcattcacggcaacgaaaccgcgccggtggagatgctggacaagctgctgacagggctgatacagggcgccacgccgctgcgctggcggatgctggtgatcctcggcaacccgcccgcgctgcgggccggaaaacgctatctgcacagcgatctgaatcgcatgttcggcgggcgctggcagcagtttgcccacagtgtggaaaccgtacgggcgctacagctggagcaggcaatcagccgcttttatgccgcgcagcccggcgacctgcgctggcatctggatctgcacacggctattcgcggctcgcaccatctgcgctttggcgtactgccgcagcgcgacacgccctgggaagaggactttctgcgctggctgggtcaggccgggctggaagcgttggtgtttcaccagtcgccgggcggcacctttacccattacagctgcgaacgctttggcgcactggcctgtacgctggaactgggcaaggcgctgccctttggcgaaaacgatctgcggcagttcgccgtcacgcttgacgccatcgcagcgttgtcagcggataaaccggccgcgggcagtgatgtcgcgccgctgcgctatcgggtcgttcagcaactcacccgccacagcgctgctttccggctgcatatgtccggcgagacgcttaacttcacgccttttgccgccggaacgctgctggcggaagacggcgaaacgcgttatctggcgcaggccgcgacggaatacgtgctgtttcccaatccacaggtagccctgggactacgcgccgggctgatgctggagcggctgccctgatgcgctggcgattatttttatcgcgattaacgcttttctggaaaatataaaaaccgatgatgtcaggcgatacggaattatctgacatcattgctttattattatacgccgctcaggtatcattcttcataatctctttaaaatcatcatcctgtataattcctgttgcaactctccacgctttatccttattttcttcataattggcgataatttgttttttacgctttcaatgctttactgttgctctgattatttgacgaaaaagaccgtaaagtgaatctcgtcaacacggcaatacgccgcaagaataactgaaagaaggaatacattatgcgtaaattgaccgctctgtttgttgcctctaccctggcgatgggtgctgctaacctggcccacgccgctgataccaccgctgcgccggcagacagcaagccgatgatgcaccataaaggcaagccgggtatgcatcatgacatgatgtttaaagatctgaacctgaccgacgcgcagaaacagcaggtgcgtgacatcatgaaaagtcagcgcgaccagatgaagcgtccgaccgtggaagaacgccgcgccacgcacgacatcatcgccagcgataccttcgataaagccaaagccgaagcgcagattgcgaagatggaagagcagcacaaagcccgtatgctggcgcacatggaaacccagaataagatttacaacatcttaaccccggaacagaaaaagcagtttaatgccaattttgagaagcgtctgacagaacgtccggcgccggaaggtaaaatgcctgaatccgctgaataacacagcgccccttattaagaccgccggacttgtccataaacgccttcaggctgtgggcaagcccggcggttttttcttttcttccctctttgacccccgcctgcgacagggtatgctctgataccttattacgcgaaactacctttttatcaggctgttaaaaaaattcttccaggatgcagcgtcattgctaaggcattacctgtccgctgccgataacctggtggcaaggtaaacagattataacaatgtggtgcggctttccggctgcgcaggcgcgcgtgatgcgcccttcaggagtggtgatggaatattttgatatccgcaaaatggcggtgaatctgtggcgcaacggggcgggcgaaacacgggagatttgttgttttccggaagccacgcgggatttccactggcgcgccagcattgcgtctcttgccgctaacggcgagtttccgcagtttcagggggtggatcgcgttatcacgctgatagaaggcggggaagtgaccctcgacgggggaaatgccttttgccataccctgaaacggctgcaacctttctctttttcaggtgagcagccgatcaaggtacagctgaacgacgggcagatgtcgatggatttcaatatcatgacccgccgcgatcgctgccaggcgaaagtgcgcatcgccgatcgcaccttcaccaccttcggctcgcgcggcggggtggtcttcgtactcagcggcgcgtggcaactgggggataagctgctgaccgcggatcagggggccagctggcaggaaggtagccataccctgcgcttactgaaagcggaagggcagctgctgttcagcgaaatcacctggctgccggggcattaaacctgcgtaccggcagacgcctgccggttcagggggcggtaaagggcagctcgtgaatatccatgatccccgccatcagcggcttgcagagaattttatagccatcctgatcgaaaccggcaggcgttttcagcagtgacgacgcctcgtccagggaattgaccgagcccaaccagaaccagttgtgaataatatgatactgggtcatttcaccgctgctttcccgcagcgccaccgggccgcgccacggccagcacaccagctgcatgcgggtcatggcgtcacgcagacgctgatggtgcgcctcgacgctctctttcccgcaacaggcgcccgcgcagcgattcagcgctgaacggaaacaggcgcgaccgcgactgagggattccagcccgagcaggccgtagcagagtttgtgctcatcggcgatagattgcagggtttgcagcgcagcgtgtcgattggcaaacagcccgtacagcccctgctgcgaagaaaaatccacctctttggcgtagatcacttctggcttgtcgctgtcaaagcgcagggaacagagctgacggttgcggcgcaggcgtttattaaacaacggctgctgttctttaatcagcctggcctccagcaataacgcgcctatctccccggcagtaaggatccaggtgatacgccgcgactggcgcagcatggacgcttcgtccggggtgcgcaaatgcgacaatacgcggctgcgaatattgatgctcttgccgatatacagcggcatggtgtcgctgtcgccatgaaagaaatagacgccgggatgcttaggcaatgcctccagccacgggcgcagatgttcgggatattcataaatggccgccgcttcaaaatgcaggcgcggggctgattgacgccttaccacacatagactcctgatactgtttacttatccagtgtagcaggcaaatcgtggcgaaaaaagaggcggcttgagccgcctggtgagattaaaccctgattgtgagcttttgccgggtggcgctgcgcttacccggcctacaaatcaaggagttgctattttttccagaaatcgtcaaaaaccgtcaccggcaggcggcgtttatgttcggttttcagataccagccttcgatggtacgcgcatgggtttcatcaatggttttgccttccagataatcgtcgatcatctcataggtgacgccaagggcgacctcatccggcagggcagggcgatcgtcttccagatcggcggtcggagcctttttatacaggtgctccgggcagttcagctgcgccagcagctgttttccctgacgtttgttcaggcggaacagcgggttgatatcggtgccgccatcgccatatttggtgtaaaagccggtcacggcttccgccgcatggtctgttcccacgaccacgcctttggtcattccggcgatgctgtactgcgctttcatacgctcacgggctttttcgttgccgcgaatgaaatcgcttaattcgatgcccgcgtcgcgcagcgcctgctcgctcgccagcactgccgctttaatattcaccaccagcacgcgatccggcccgatgaagttgatcgcatcctgacaatccttttcatccgcctgtacgccgtggggcaagcgtaccgcgataaaggcgtagctttcgtcgccggtttcctggcgcagctcgctgatagccatctggctgagcttaccggcgagcgtcgaatcctgaccgccgctgatgcccagcaccagtgacttcagaaagggatgcgctttaagataggatttcaaaaaatccacgctacggcgaatttcttcttctgcatcgatgcgcggcttaacgcccagcgcctgaataatgtcttgttgcagcgtcatgacaacactctccgtctgtcgcccttgagggcagatgttaagtagcaatcttttcaaattaacccgttgtggctaaaacgacaaggcgcgacggcgcagggagcgcaaataaccaccttttgtctgtctctctttgttttattagatttttcttaaagttaagtcaatgtcgtcaggaggttgaaaaaagttattttatattccaggcttagataacgcgctgatacacaagcggataacaagaggaaggatcaatatgaacaagaaactcgcaggaattttgggtaccgcggccgtaatgaccatgctggcaggttgtactgcttacgatcgtactaaagatcaggtgaccacgccggtggtgaaagacgttaaaaaaggcatgagccgtgcgcaggtaatgcaggttgccggtaagccttcttccgaagtgaccatgatccacgctcgtggtacctgccagacctacattctgggtcaacgcaatggcaaaacagaaacttactttgttgccctggacgaaaccggccacgtgatgaactccggttatcagacctgtgcggaatatgataccgatccgcaggcaccgaagtcctgatccctttaagcctgagcaaataaacaaaccggccaccgcgccggtttctttttgtctcaaaatcttatttcttgacgcgaattatttgccgaattgtgaaggctatcatcctgccaggtcaatgagagacaattcgggttagcgacggattatcgcccccaggcgggatgctgtatattttcttcaaccagaaacaaaagtaactcaagggttcacgagttatcccagccacccacacaggtccccatgcaggcacacctgttgcggttgaaacgtaaggaaggttgtgatggaaaagaaatacatctatctgttctgctcggcgggcatgtccacctcgctgctggtgtccaaaatgcgcgcgcaggcagagaagtatgaggtgccggtgatcattgatgcatttcctgaaaccctggccggtgaaaaaggacccgaggccgatgtcgtactgttaggcccgcaaatcgcctatatgttgcctgaaattcaacgtctgttacccaataaacctgtcgaagtgattgattccatccattacggcaaagtggatggtctggctgtactgaaaactgctgtcgccgccattaaaaaagcagcaaattaattttatttcttttccccgtcaaagagttatttcacttactttcgccgcaatagtttattgcggcttttaaggacttttctatgagcaaagcaattgattcgctggagcaaatgctgatcccttttgccgtaagaataggaaaacaaccccacgtcaatgcaattaaaaacggctttatccgcttaatgccgttaacccttgcaggggcgatgtttgtattaattaacaacgtattcttaagttttggcgaaggatcgtttttttactctttaggtattcgtctggatgcctcaaccattgaaacgctgaatggttttaaggccatcggcggtaatgtttataacggcactttaggcatcatgtcgctgatggcaccattttttattggtatggcgctggccgaggagcgaaaagtcgatccgctggccgccgggttattagctgtcgccgcctttatgacggttacgccttacagcgtcggcgaagcctatgccgtgggcgcaaactggctgggcggggccaatatcatttccggtattattatcgggctggtggtggcggagatgtttacctttgtcatccgccgcaactggatgatccgtctgccggacagcgtcccggcgtcggtgtcccgctcattctccgcgctgatcccaggctttctgatcctctcggtaatgggcattatcggctgggcgctcaccgcctggggcaccaacttccaccaggtcattctcgattccgtctcaaaaccgctttccgcgatgggcggcgtggtcggttgggcctatgtgattttcaactcgctgttatggttcttcggcgtccacggttcgctggcgctgacggcgctggacagcggcatcatgaccccctgggcgctggaaaacatggcgatttatcagcagtacggctccgttgacgcggcgctggcggcgggtaaaaccttccacgtctgggccaagccgatgctcgattcttacgtgatgctgggcggttcgggtgccaccctggggctgatcatcgccatctttatcggttcccgccgcgcggattaccgtcaggtaggtaagctggcgctgccgtccggcatcttccagatcaacgaacctatcctgttcggcctgccgatcatcatgaacccggtgatgttcattcccttcgtgctggtgcaaccggtgctgaccggcatcatgctggcggcctactacacgggtattattccgccggtgacgaacatcgcaccctggacaatgccgaccggcctcggcgctttctttaacactaacggcagcgtggcggccctgttgctggcgctgttcaacctcggtgtcgcaacgctgatttacctgccgttcgtaatggtggccaataaagcgcaggcggccattgaggaagaagagagcgaagaagatattgccaacgccctgaaattttaagcctgacggcgcaggctgccgttagcctgcgccggactgacatgaggaagataagatgtttaatctggatgatgttgtggaaaccgagcttgccaccgatgaactggaagaagtggtgatggggcttatcattaactccgggcaggcgcgcagtctcgcttatactgccctgaagcaggcgaaagcgggcgatttcgcggcagcgaaggaaaccatggcgcagtcccgtaccgcccttaacgaagcgcatcgcgtgcagacgcagctcattgaaggcgatcagggcgagggccggatgaaggtcagcctggtgctggtgcatgcgcaggatcatctgatgacctcgatgctggcccgcgagttgattgccgaattgattgagctgcacgaaaaagtgcgctaatacaggagccaacgcatgatgcagccacaagtgaacgcgatggaaatcaaaaccgcacgggaacagcagttgttcaatggccggaactttcacgtcttcatctacaataaagtggagagcataagcgggctgcaccagcacgattattacgaattcaccatcgtgctgacggggcgctactatcaggagatcaacggcaaacgcgtgctgcttgagcggggcgattttgtgtttatcccgatgggatcgcatcatcagagcttctatgaatttggcgccacgcgcattcttaacgtcggcgtcagcagacagttttttgaacaacactatctgcatctgctgccgttctgctttgtggcgtcgcaggtgtatcacgtaaaaagcgcatttctgacatggattgaatcggtgatcgcctcgctgaatttccgcgataacgagttcaatgaatttatcgaagtggtgactttttatatcgtcaaccggcttcgtcaccaccgggaagaggtggtgcagggcgacattccgcagtggcttaaaaccaccgtggaagagatgcacgacaaaatgcagtttggcgaaaacgcgctggaaaatatggtgaaattatccggtaagacgcaggagtatttaacccgcgccacccagcgctattacagtaaaaccccgatgcagatcatcaatgagatccgcattaattttgccaagaaacagctggaaatcaccaattactcagtcactgatattgcttatgagtccggttacagcagtcccggtttatttatcaagacgttcaagaaagtgacgtcctttacgccaggcagttaccggaaacacctcaccgttattaactgattaaggcacgcctttattttacggtcagtgcgtaagagagatgttatgaataaaaaactgaaagtcgtcaccatcggtggcggaagcagctacacccctgaactggtcgacggatttattaaacgttatcacgaactgccgatagacgaattatggctggtggacgtggaagacggccaggaaaagctgaatattatttatgacctgtgccagcgcatgatccagaaagcgggcgtgccgatgacgctgcacaaaacgctggatcgccgtgcggcattgcaggacgccagttttgtcaccacccagctgcgcgtcggtcagctacaggcgcgcgagctggatgaacgtattccgttaagccatggctatctggggcaggagaccaacggcgcgggcggtctgttcaaagggctgcgtaccattccggtgatttttgacatcatccgcgatgtggaagagatctgcccggacgcgtgggtgatcaactttaccaacccggcgggcatggtgacggaagcggtctatcgtcataccggctttaagcgctttatcggcgtgtgcaatattcccatcggtatgaagatgtttatccgcgatgtgctgagcctgactgacgaagacgaactgggtatcgatctgttcggcctcaaccacatggtgtttatcaaggatgtgctggtcaacggcgaatcgcgctttgcggaactgctggacggcgtggcctccggcagattaacggcgaattcggtgaaaaacatctttgatctgccgttcagcgaaggactgatccgctcgcttaacctgttgccgtgctcttatctgctgtactacttcaagcagaaagagatgctggccattgagatgggcgaattctacaaaggcggcgtacgggcgcaggtggtgcagaaagtcgagaaacagctgtttgacctgtacaaggatccggcgctggcagtgaaaccgaaagagctggagcagcgcggcggcgcctactattccgacgcggcctgcgaggtgatcaacgctatttataacgacaagcaggcggagcactacgttaacgtgccgcaccacgggcatattgataatatcccggcggactgggccgtggagatgacctgcatcctcggccgggatggcgcgaagccgcacccgcgcgtgacgcattttgacgacaaggtgaaggggctgatccataccatcaaaggctttgaaatcgccgccagccaggccgcgttaagcggtgagtttaacgatgtgctgctggcgttaaatttaagcccgttgatccactccgataaggacgcggaaatcctcgcgcgtgaactgctgctggcgcatcagaaatggctgccgcgctttgcaaaaaccattgaaggctttaaacgctaaggagccagcctgtggaaaggttactgatcgtcaatgccgatgactttggtctgtgcaaagggcagaactacggcattgtggaggcctgctcgcacggcgtggttacgtcgaccacggcgatgatgaatgcagaggcggtggaacatgcggcggcgctcagccgcgcgcttccgcagctggcggtcggcatgcattttgtgctgaccctcggcaaatcgttaagcccgatgccggggctgacgcgggacggcgtgctgggcaaatggatctgggagatggcggagcaggacgagctgccgctggcggagattgagcgtgagctggcgtgccagtatcagcgctttattgactgctttggccgcaaaccgacgcatatcgacagccatcatcatgtgcatatgctgccgccgatcttcccgctggtggccgcctttgccgcggataaaggcgtcgggctgcgtattgaccgcgaggtggcggcgcttcacggtctgccagtgaacgcggcgtgcagcagcgaaggctattccagcggcttttacggcgaggcgatatcggaggcgctgtttcttgaggtgctggatgcctccggcgcgcggggcgagcagtcgctggagataatgagccatccggcctttgtcgacgacacgctgcgcgccagcagctattgctggccacgtctgaaagagctggaggtgctgacctcgccatcgctgaaatatgcgatagcggagagggggtatcggctgggatcctggcgggatttgccttaacaggttcatgcccggcggcgcaaagcttgccgggcctacggtacagtaagtaggccgggtaagcgccagcgccacccggcatttttgtatcccagaactgtaggccgggtaagcgtcagcgccacccggcacattctttccgctacgccgggatcttgctgattttgcccgcccgcgaccagacgcggtgtcccgccagctgcatcaggaaatcatccatccactcctgcgtgacactgtcaccttcggtgatgccttcttcgccctgcgcatccaccctcagcaccgctttaaaggcgcgcgcatcgccggccagcgcgatcggcttcaggtgcttataggcttccagcagataatagttagcgtcgccattgtccagcaggctggcaggattcccgcctggcaccagcacgccatcgacggtcagcgacggtgaacccgcaaaggtcgcggcgatcggcacctgcgagccatcatccgccgtcacttcgcccatacgcgaataaagcagtttagcgtgcacgccttttgcctgtaagccctgcaacagggtatacaactggctggcggagacggtgtcattcagcagtaccgccaccacgcggcccttcagcgtgccgtcaggaatggcatacagactcagcgatggatcctttttcaggccgctgacatcctgcggcggcgcgatgttgcgctgatcgtcggtcagggtgatccccaggttgtgcgccaccgcctgcgccagggtaatgtcgatatgcgccagctgatccaccacccgctcgcggatataggcccgcgccactttgcccagctcgaagctgaaagcctcgataatatgctgctgctcatgaggcgtctggctctgccagaacagccgcgggtgggcataatactcgccaaacgaagggctgcgctcgcggatcttatgaccttcgatacgctcctgatatgactcaaatcccccgcgctgcggtgcaggcggcgtttcccgcggccagttatcgttaatcgagttaggctcatagtttgccggattagtgtcgatatccatgcggtgcatgccgtcgcgctggaaattatgatacgggcaggtggggcggttgatggggatttcgtggaagtttggtccaccgagacggctaatctgcgtgtcggtataggagaacagccgtccctgcaacagcggatcgttggtgaaatccagccccggcacgatgtgccccggatggaaagctacctgttcgttttcgctgaagaaattgtccgggttacggttaagcaccattttgccgacgcgctgcaccggcaccagctcttcggggatcagtttggtgggatcgagcaggtcgaaatcaaatttgaactcgtcctcttcggcaatcagctgtagccccagctcgtattcagggaaatctccggcttcaatggcttcccacagctcacggcgatggaaatccggatcgcggccggtcagcttttgcgcttcgtcccataccatagacgctttacctgccagcggtttccagtggaaacggacaaaggtggctttgccgtcggcgttaatcaggcggaaggtatgaatgccgaagccttccatggtgcgatagctacgcggaataccgcgatcggacatcgcccacatcacgttatgcagggtttccggttgcagcgagacataatcccagaaggtatcatgggcgctttgcccctgcgggatcgcccagtgcggctccggttttaccgcatgcacaaagtccgggaatttatgcgcatcctgaataaagaacaccggcgtgttgttgcccaccagatcgaaaatcccttcgtcggtataaaacttagtggcgaaaccgcgaatatcccgcacggtgtcagccgatcctgcgccaccctgtaccgtggaaaaacgcacaaacaccggcgtgattttatccgggtcggcgaggaagctggctttagtaatgtcgcttaacgagcggtagggctggaaatagccatgcgccgccgagccgcgggcgtgcacgatgcgctcgggaatacgctcatggtcaaaatgggtgatcttttcccgcagaataaaatcttccagcagcgttggcccgcgctgacccgcgcgcagtgaattctggtcattggcaatgcgcacaccctgattggtggtcagcggaaaattttcgccgcccttacggaagctttccagcgccttgagtttttcattggaggtatccggcgctttcaggctgccgggggcagtaggctgcgccccgggcggagtcggtaacggatcggcctgatgggagttgtcttccggggcgagtgagtccagaccgggacgggcggcacggtcatcgtggaccggggcatgatgatttttgggatgactatcagaatgcgacatggaacaggtctcctgtttttgctgcggggtgttggcattgaaactggccgtttttacgtcaaattctttctaactatagaacagcacacgattttttaccctggtgcttcgcagataaaaaccccgcaggggcaggggaaaaacaggcagggcgcgacgaggagggggagtttcagctatgatgggagttgcctgtttgtggaatatgtttttagtgaatcctggcttatgaaatcattgcgtcaacaaaaccgtcggattatcagctatgtgccacgtgtcgagcctgccccgcctgaccatgcctctaaggtcgaaggttttcgcgatgtgtggctgttacgcgggaaatatgtcgccttcgttttaatcgccgagcgttttcgtcgttcgccggtcttcagcgggccggaagccgcccagcgctgggccgaacagatgcggcaggaaggggaagtggatcaggattgatacgtcgggcgggaaaataccgcccggcagactgcgtcgccgggcggttaaagcttaacgatgcgccagttcggcgttttcttcgctgttcagaatggttttgtcggtctgcttcagccactggctggtgagcgtaccggcggtcattgaaccgctgacgttcagtgccgtacgacccatatcgatcagtggctcgacggagatcagcagcgccaccagcgtgactggcaggcccatggccggcagcacgatcagcgcggcgaaagtcgcgccaccacccacaccggccacgcccgcagagctgagggtgacaataccgaccagggtggcgatccacaccggatccagcgggttaatgcctaccgtcggcgcaaccatcaccgccagcatcgccgggtacaaacctgcacagccgttctgaccgatagtcgcgccaaaagaggcggcaaagctggcgatagattccggcacgcccagacgacgggtctgcgcttccacgttcagcggaatggacgcggcgctggagcggctggtgaaggcgaaggtcagtacgggccagactttacggaagtatttcatcgggctgatgccgttcgcacccagcagaataccatgcaccacaaacatgatcgccagaccaagataggacgccaccacaaagctgcccagtttgatgatgtcctgcaggtttgaacctgccaccactttggtcatcagcgccagtacaccgtacggggtcagctgcatcaccagacgtaccagcttcatcacccagctttgcagcgtgtcgatggcggtcagcacacgctggcctttcggggcatcatctttcagcagcttcagcgccgccacaccgaggaaggccgcgaagatcaccacgctgatgatggaggtcggacttgcgccggtcagatcggcaaacgggtttttcggcacgaacgacagcagaagctgcggcacggtcagatccgccacttttccggcataatttgtctgaattgccgcaagacgcgcgctttccgcggtgccctgcaccaggccttcagccgtcagaccaaacaggttggtcaccagcacgcccaccagcgctgaaatcagcgtggtaaacagcagggtgccgatagtcaggaagctgattttacccagttgcgaggcgttatgcagacgcgccacggcgctcaggatagaggcgaacaccagcggcatcacgatcatttgcagcaactggacatagccattaccgacgatgttgaaccactgaatagaatctttcagcaccggattatcagcgccatagatggcctgtaaggcaaaaccaaagaccacgccgatcaccagaccgaccagcacttttttagccaggctccactgtttgtggcgggtttgcgccagcaggaacagcaaagccacgaacaccacgatgttcgcgattaatggaaaattcatccccaatctcctgatgtgtttttatttcaggcgtcagtacacctgtcttgttggcggaagagtagcagaagtgtgatgtggcgcttatatccaaatggaatgggttatattcaaacgcataaattcgtgggtttattgaccaatctgctcatgaataaagcggttgtactgcatttgcagggtattgatcatctgcgatgaccagcgcactgcactgttttcggtcatcgtctgcggcataaacaccgcccaggtgaacagcgccatacagagcacgcgctcaagttgattgcctttctggggcatcaggatcggcacgcggaaccgccagcggcacggccacaacagcggcacacccgcaggcgtcagcatatcggcaaggatatggctcagataacccagcaccagcccctgtaaggcatcggcgggcaccagccagctgtcgggcactttcagcataaatagcgtcagggcgataaataccgccagcagactgtgcgtaaagccccggtgaccgaaggcgcgggctatgggttttgagatccatttcagccgctggcctaaaaaagatttcgggtgatcgatatccggcagcagacaggtgagaatagctgacggaacaatatgccaccagtccccctgcgcgagcacaggggtcagctcggcgtttttggcaaacaccgcgcaggctatcgaaaaaaggaggtgaccttccgccgtcatgattgcactcgctaaactgtcgaagtatacagtatagggtttttatacagtaggcggaagaggtgacggtgtaactgtttatctcagtggatgactaacgcgccagccagccgccgtccactgccagcgtatagccattaatgtaatccgaggcgcgtgatgccagaaataccgccgggcctttcagatcttcaggcgtgccccagcgcgcggcaggaatacggttgatgatctcttcgctgcgccgggcatcgtcccgtaattgctgcgtattgttggtcgccatgtagcctggcgcaatggcattaacgttaatgttgtgcgtcgcccattcgttcgccagcaggcgcgtcaggccgagcacgccgcttttcgaggcggtataagagggcacgcggataccgccctggaaagagagcatcgaggcgatgttaatgatttttccgccgccgccctgggcaataaattgtcgcgccaccgcctgacagagaaaaaaggtggctttcaggttaaggttaatgacgtcatcccagtcctgctcgctgaagttcagcgcatccgcccggcggatcgtgccggcattattgaccagaatatcgaggcgccccatccggcttaccacttcctgcaccagcgcatcataagacgcctgctggctcagatcggcctggatcgccgtaaaacgacgtcccagcgcggtcactttctgttctgtttcatgcggatatttgcggttaatgccgacaatgtcacagcccgcttccgccagccccaggctcatcccttgtcccagccccgtgtcacagccggtgacgatggcaactttaccgcttaaattgaaggcatccagtatcatactcaccccgattgctctgatgtgtgcaggcaggcgcgcctgatggtgttgagcatagaaggaagggatttgaaaaacaaattaaagtgaaatgatgtttcagtttaattgacgcgggtaacaaaagggggcctgttacccgcaaaaagcttatccgcgcagatgcgaaacggtcagttccgccagggagtgaagcttcacatcggcaagggcgtaacggggatcgttctggttggcttcttccggcaccacgacagaacgcatacgcgcggctttcgaggcgatcataccgttaaccgaatcttccagcgccacacaggtcaggggatccacccccagcttcgcggcgcaatcaagataaacctgcgggtgcggtttactgtacggcagcgtcccggcggaggcgagggcatcgaagtaatcagtcagctcaaacatggcgagcactttttccagcatgtgcagcggtgaagccgaagccaggcctattttcaacccctgcgccttacacagcgtcagtgcttcacgcacgcctggcagcagcggacgcttttcttccaccagcgacagcgagcgggcgatgatccgttcagtcacttccccgcgatccgggccgttccacggctgctgggcataccacagatccaccaccatatcgatgcgcagaccgagcgtatcgggcagttcattacggcgggtgatatccacgcccaggcttgccatgacctccagttcagcacgatcccacaggggttctgagtcgatgagtaatccgtccatatcgaaaatagcagcaagaatttgacgcggcgtagacattaaaacctctccttattggggcgggtatcaggccattatggcctactccctatgataacgcctctaaagaacaggcgaaaatgaatatgagcgggtaaacttaggcgcaaatggaacgtctttaacaaggggaatacatgacgtatcaacaagctggacgcattgccgtgctcaaacgcgtgatgggatgggtaattttcatcccggcctttatttctactctgatctccgtactgaagtttatgtacgagcacagcgaaaagcagcccggcatcagcgcggtgatgcaggatttcgcccatgtgatgatcgagatgatgcgttttaacacgccgttcctgaatttcttctggtacaactcgccgctgccggattttcaccagcagctgaatattggcttctggatcatttatgcgctgatttttatcggcctggcgttacaggcctcaggcgcgcgcatgagccgtcaggcacgttttctgcgtgagaacgtagaagatatgacgattctggaaaacgccaaaggcgcagacggtctgtaccgcgagcagatcgaagcgcggatcgtggtgccgaatcattcaatattccgccagattttcaccctctatattttgccggtaattattatcgtgctcggctatctgttcttttcgctgctgggttttctttgacgcttgcgggtattgccgggtggcgctatcgcttacccggcctacgtaaactacgccgtcatataggccgggtaagcgcagcgccacccggcgatggcactcacttttacgccgcaaggacacgatccagcgctttctgcgccgtcgccagatgcggtccgccaaataatatcgcgcggttaaacagcgtatagagctgatagagcggctggcggtcgaggaatccggcgggcaggggcgatacggactgataaccgtcgtagatctgcggcggttgatccggatgcaggggcagcatcgccagatcgcactcacgatcgccccagtaacaggcgggatcgtaaataaaggggccgtccggaccaagcgcgcagttgccggaccacagatcgccatgcagcagcgcggcctgcggctggtgcgacgccagacgctgttttacatgctcaacgatggcgtcgatattgccgaactccagccctttttccgcggccagctccagctgccagccgatacgctgttcggcaaaaaacgttgaccagcgtcgctgccaggcgttgggctgcggcgtggtggaaaggtcattatcaaagtccagaccgaactgcggctgatcgctccactgatgcagacgggcaagctgttgtcccagcaaaaacgcgttatgcgcatccagcgggcgggcggggagataatccatcaccagaaaacagtaatcgcgatccgcgccaacggcccggacagggggaacgctgacggtctggctgcgggagagcagttcaagctgatcggcttctgccgtaaagatgggtaacagttcgcggctgtcgcatttaacaaaaaaatcgcgtcctgcgtagcgcatatgccaggcggcgtggatctcaccgcccggcagttcgtgccggaattcgatttcaccctcgccaaaggattcactcaacagacgacttatcgcttgccacatgatgtctctccccatgttatctgtcagatcataaggttagcgcactgatgcggaacaaaataagaactaacgcacacctgagccgcctgctgtgtgcaatggcacttattgtgctttttgctgctctgtttgccacgtttcccagcgggaaacggtaatttccggctgtttatccagcgcgctttccgccagagcagcggactgcgctttgacttcctcttcactcatggcggtgatcagaccaaaagtgttggtgccgagttcatgtaccttgccatcatcgtcggtcagcgtcagtaaaaatccggcgcgcgtgaaatggttgttcagttcgttaatttcactcagattgtcttcgtgaaatttgatcgtaaccacatagcgcgtaatgtcaccactgctcatcgttcacctcgttgttatcctgaaagtttttttagcatagtcgacgtgaggaatttggcgaccacaggaatggatgatttcccccgccaggcggcaggggaaaggggtattaatgacgaaccagataatcgtagattttttgcgtgtcctcatggccgcacagacgcgtaccctgattaatggtcgccgcgctgcctgccgccacgccaaaacgcaccatttccgttaaagaagcgccttccgccagcttcagggtcatggcgccgaccatgctgtcaccggcgcccacggtgctttggcttttcatcggcggcggcaccacatgcacgcactcgctgccatcaacgcccagcgcgccctgaggccccagcgaaaccaccacgcgacggactttgccgctgttcaccagctcctgcgccgctttgcgcacgtcatccggctgggtgagcgggcgatttaccagcgcgctcagctctttctggttaggcttcaccagttcaatgttgccaatctccagcgcggcggtcagggcatcgccggagctgtcgataatgcagcggataccctgctgctgggcggctttaatcaactgcacccaggcctccagttgcacgccggggggcaggctgccgcttaaaaccagcagcgcgccgctctcaatagccagcactttttcttccagtttgcggaattcatcggcgctgagcgcagcgcccggcatcacaaatcggtactgctcgccactggcctcaacatgcacatgcaggttctgacgggtccagtcctgggtttcaacgctctgtgtcgggacgttttcatctgccagcagagcggtaagatgttcgccggtcgcgccgccggccgggaaaatggccgtggctttgccgcccagatgggtaatggcgcgggcaacgttaattccgccgccgcccggctcaaataccggtgcagtacaacggagtttaccttcgggataaatttgcggcgttaaggtcgcgctgtccagcgacggggcaagcgttaatgtatagatgcgggtcatctttacctccttttagcgtgaatcttttaagcctggcaccgttccggcagatagcaacgtaaataaacgtatgatttatcttgtgaagttgaatttaatttgcgtcaggttgatatacacttaatgccggtttgagagctctcttattcaaaaaatgaaataagaattcattgctatgttaattgagcctttttataatttgttacctttctcaggacggttacgcgttgatcctgatgtaagtttccgggaccgtgatggtctctttttttgttgtacggactctttataaatgaagcttttaaagacagtacccgcagttgttatgcttgcgggaggcgtgcttgcgtcactgaatgctgccgcagatgataccgtttttactgtcatggatgacccctccactgcacagaaaccctttgaaggtaatctgaacgcaggctacctggcccagtcaggtaacaccaagagttcctcgctgaccgctgactccaccctgacctggtacggcaataccaccgcctggtccctgtggggcaacgccagcaacacctcttcgaatgacgagcgctcgtctgagaaatatgcggtgggcggacgctcgcgcttcaacgtgaccgatgcggattacctgtttggccaggccagctggttgaccgaccgttacaacggttatcgtcagcgtgatatcctcaccgctggttatggtcgccagttcctgaatggtccggtgcacagcctgcgttttgaattcggtccgggcgtacgttatgacgagtacaccgacggcgacaacaaaacacagccgctgggttatgcctcaggaacttatgcctggcagatgacagataacactaagttcacgcagggtgtttcggtatttggcgctgatgatacgacgctgaactctgaaaccgcgctgaatgtggctattaacgaacactttggcctgaaggtggcatataacgttacctggaactctgagccaccggcctccgcgccggagcacaccgatcgtcgtacggtcgtgtcgttaggttataagatgtaattgattttgggccgaaattttcggcccgctttatatatttcagattaattaatgacgcgcttaaaatatcaatatgcggttttagcttattaaaaattatgtttctccataatttctcctcatttatctcttcggacacacattcaatttatttgacaagatttgataaattattcgactgttcaaaagtgtgatccagctctaaacttactgtcatgggtcaataatgcccaaccagacgtacggtattaagttaaaaagagaagaatcattatgaaaacatttaaaactatcgcagcagcagcggtgctttcagccctgtcctttggcgttttcgctgctgacagcgcgtatacacctgccagtgacaccaccaaaccctcgactactttccaggcgaaagatatcgaagccggttctaacattcagccaggcgcaccgtctaccggccgttccgccgatgatgcttttaatgttaaaacgctggtggccggagagtggtattaatccgcttcccgctttcgttattaacttcgcttattacgattaaaaaaccggattacgacgtaccggtttttttatgtacgtaataaggtcagcaaattctccggcagctgattcgcaatcttcaacaccgcgttctgactctcctgcaaaatctgcgctttaatttgcttactggtttccagcgcgtagtctgcatccataatacgactctgagccgtttgggtggagagcgtctgttgtgacaataccgatttggctgaatcaaagcggttcatccaggccccgtactgcgcgcgatagccgcttacctttgccagcgcgttatcaagcgcgcccatggcgctactggctgactgcgccgaactcaggctggtgtcgcgaatgcccagcgttttggtgtcggctggcgtggcggtcatggtcattgcctgaatatcatcgccaaaattggcgctggtgatcacctccatcggaccactctttttcggcggtgtggcaggggtgatggtcggcgcaggcagatttccccaggtcaggttgctggtaaaggaaccgctgccaacgatcaccacgatcaggtcttcactgacgttatcgatggtcaggcgctcaaggcggttggtgccattcgagccgtcgttgtacgcgcccatgccccggtcttcataacgatcgccatcgccactgtaggtgatggtcatgccgttataattcagcgtcgcgctgccgttgaggttccaggccgcgccgccttcgataagctggctgtcgtcatacgttgcgccgctctgaaaaccgttggccgcggtcagcaatttactgtcggctttcgccgcatcggtgatgccgcggctgacccaggtataatccggatccggcccggtaaagggcgtgcccgccagatgcttgccatcacgggtaaacagctgaatgtcatcgtccagaccgagggagtcgatggtcagattgatattggtcgaacccgcgggtaaataagccagcggtaccacccctgagctaaaggtataattgctaccggcaacgggaaatttactgctgatcggcgccacgtcgccaatcagggcagggggcagttccgggttcgccgtagccagcgggtatttaccaaaaatttccgtttgttcggaaagatcgttgatcccggccagaatactttcatattcattctggatgctgctccggtcgctttcagacagtgtgtcattaacggactgaatggcaagacttttagcgcggatcaaaagatttgccaccgacccgaggcttccgtctgcggtttgtgcaagactggtcgcgtcatccagcccacgggaaatcaccgtgtcggcattaatgttcgagcgcattctgttggtaatagcaagcccggccgcgtcatccatggctgaattgatgcgtaatcctgacgacagcctggcaatggtttgcgaaaggagcgatgtggtgctttgcctcgcaaccagattcagcccggcgatcgcattatgattaatagcttgcatgtgcgtttcttaacgattctcttggccccggataacctggtcatcggcaaaatacgccatgactttaatgcaaatcttcagtattgctggcgttcttcacaggtatccgggcaagaataagtctaaaatttcgacataccagacacttagccgaagccagcgaattttatgtaaagccggaatttacataagcgctgtgaatgagtcgcccgtagcttcacgcaatataaaggctttgcttgacgccatcgctatttttcgttgagctacagccgaccagcacgattaattaaaggggtaaatgtgggaaatcaggcgaaagacgacgagttataccaggagatgtgccgcgtagtgggtaaagtggtgctggagatgcgcgatctgggccaggagccgaagcatatcgttattgctggcgtattacgtacctcgcttgctaaccagcgtatcgtccggtctgaattaactaaagtcgccatggaggcggttattaaagcgttatcgaacacggcctgacccgtatttcccctgatgagtctttaaaccaacggcatagacgtgtagtatcaggggtgagcttatccgcagagggtaagggtgcggttgttaaaccctgcacagattccgcagagtgaagcggaaagccttatctaaactgctgataattattagaaaatagttttgtatgtgatctttcgtgtgggtcaccactgcaaataaggatataaaatgccagttattacccttcctgacggcagtcaacgtcacttcgataaagccgtaagcccattagatgtcgcactggatatcggtcctggtctcgcgaaagcgtgtatcgccggacgtgttaatggcgagctggtcgatgcaaccgatctaatagaaaacgatgcgcagctggctatcatcaccgcaaaagatgaagatggtctggaaattattcgtcactcctgtgcgcacctgttgggtcatgccattaagcaactgtggccgaataccaaaatggctatcggtccggttatcgataatggcttctattatgatattgaccttgaccataccctgacgcaggaagatctcgacgcgctcgaaaaacgtatgcacgagctcgccgaaaccaattacgatgtcgtcaagaaaaaagtcagctggcacgaagcgcgtgaaaccttcgcgtcccgcggcgagagctataaagtctctatccttgatgaaaacattgcccacgatgataagcctggcttgtatcatcatcaggaatacgtcgacatgtgccgtggtccgcacgtgccgaatatgcgtttctgccatcactttaaactgatgaaaaccgcgggcgcgtactggcgtggcgacagcaataataaaatgttgcagcgtatctacggcaccgcatgggcagataaaaaagcgctgaacgcctatttacagcgtcttgaagaagccgctaaacgcgatcaccgtaaaatcggtaaacagctcgacctgtatcatatgcaggaagaagcgccgggtatggtattctggcataacgatggctggactattttccgtgaactggaaacttttgtacgttctaaactgaaagagtaccagtatcaggaagtgaaaggcccgttcatgatggaccgtgtgctgtgggaaaaaaccggccactgggacaactataaagatgcgatgttcaccacctcctcggagaaccgtgaatactgcatcaagccgatgaactgcccgggtcacgtgcagatcttcaatcagggtctaaaatcctaccgtgacctgccgctgcgtatggcagagtttggtagttgtcaccgtaatgagccgtcaggcgcgttacatggactgatgcgtgtacgtggtttcactcaggatgacgcccatatcttctgtacagaagagcaggtgcgtgatgaagtgaacgcctgtattcgtttggtctacgatatgtacagcacctttggcttcgagaagatcgtcgtcaaactttccactcgccccgaaaaacgtatcggtagcgatgaaatgtgggatcgtgctgaggcggatctggcagtcgcgctggaagaaaacaacatcccgtttgaatatcagctgggtgaaggcgcgttctacggtccgaaaattgaatttaccctgtatgactgcctcgatcgtgcatggcagtgcggtacggtacagctggacttctccttgccgtctcgtctgagcgcctcttatgtgggcgaaaacaacgagcgacaagttccggtaatgattcaccgcgcgatcctcggttcactggagcgctttatcggcatcctgaccgaagaatttgcgggcttcttcccgacctggcttgcgccagtgcaggtagtggtgatgaatattactgattctcaggcggaatatgtcaacgaattgacccgcaaactgcaaaatgccggcattcgcgttaaagcagacttgagaaacgagaagattggctttaaaatccgcgagcacactttacgtcgtgtcccttatatgctggtttgtggcgataaagaggttgaagccggcaaagtcgccgtgcgtacccgtcgtggtaaagacctgggtagcctggacgtaaatgacgttatcgagaagctgcaacaagagattcgcagccgcagtcttcaacaactggaggaataaggtattaaaggcggaaaacgagttcaaacggcgcgaccgaatcgcatcaatggcgagattcgcgccacagaagttcgcttaacaggtctggaaggcgagcagcttggtattgtgaatttgagagaagctctggaaaaagctgaagaagccggggtcgatttagtagaaattagccctaacgccgagccgcccgtttgtcgtataatggattacggcaagttcctctatgaaaaaagcaaatcttctaaggaacagaagaagaagcaaaaagttatccaggttaaggaaatcaaattccgacctggtacagatgaaggtgactatcaggtaaaactccgcagcctgattcgctttctcgaagagggtgacaaggccaagatcacactgcgtttccgcggtcgtgagatggcccaccaacagatcggtatggaagtgcttaatcgcgtgaaagaagatctgggtgaactggcagtggtcgaatccttccctacgaagatcgaaggccgccagatgatcatggtgcttgctcctaagaagaaacagtaaggccatcaagtaatcattcctgtgggccacgctcacgggactgattcgcctttgtttcgtttattaacaatgcgaagtggaagttattaaaatgccaaaaattaagaccgtacgcggtgctgctaagcgcttcaaaaaaaccggtaaaggtggttttaagcacaagcacgctaacctgcgtcatattctgaccaaaaaagctactaagcgtaaacgtcacctgcgcccgaaagccatggtttctaaaggcgatctgggtctggtaatcgcgtgccttccgtacgcataagtcgttaaccttttaactttttaagaatagatacaggagagcacacatggctcgcgtaaaacgtggtgtagttgcacgtgcacgtcacaagaaaattttgaaacaagctaaaggttactacggtgcgcgttcacgcgtataccgcgttgccttccaggctgttatcaaagcaggtcagtacgcttatcgtgaccgtcgtcagaaaaagcgtcagttccgtcaactgtggattgcgcgtattaacgcagcagcacgtcagaacggtatttcttacagcaaattcatcaacggcctgaaaaaagcctctgttgaaatcgaccgtaagattctggctgacatcgctgtattcgacaaagtggcattctctgccctggtcgaaaaagcgaaagcagctctggcataagccagtgaagagagggggcttagctccctcttttttatttgtaataccgtcattttgttgacaattcgtcgtccggccttttcaataggcagtatcggtttttccacacaaggtaacgcaagcatgaatgctgctattttccgcttctttttttactttagcacctgaaaccgggaggctagcgcgtgaaagaagaaacgaaaaacagcgccagaaagcctcctgatggaggctttttttatgcctgatttttaaaaataagagaccaccataacggtgtctgcaccgacataatgaggaaaaccatgtcacatctcgcagagctggttgccagcgccagggcagccattaacgaggcttcagatattgccgcattagataatgtgcgcgttgaatatctgggtaaaaaagggcaactgacccttcagatgaccaccctgcgtgagttgccagctgaagaacgtccggcagccggtgcggtgatcaacgaagccaaagagcaggtgcagcaggcgctgaacgcccgcaaagccgatctggaaaacgccgcgctgaacgcccgtctggccgcggaaaccatcgatgtatccctgccgggacgccgcactgaaaacggtggtctgcatccggtaacccgtaccatcgatcgtatcgaaagctttttcggcgagcttggctttaccgtggccaccggcccggaaatcgaagacgattaccataactttgatgccctgaatattccgggtcatcatccggcgcgcgccgatcacgacaccttctggttcgatgccacccgcctgctgcgtacgcagacctctggcgtacagatccgcaccatggcgaaccagcagccgccgatccgtattatcgcgccaggtcgcgtttaccgtaacgattacgaccagacgcacaccccaatgttccatcagatggaaggcctgatcgttgataccaacatcagcttcaccaacctgaaagggacgctgcacgacttcctgcgtaacttctttgaagaagatctgcagatccgcttccgtccgtcctatttcccgttcaccgaaccgtccgcggaagtggatgtgatgggtaaaaacggcaaatggctggaagtgctgggctgcggcatggtgcatccgaacgtgctgcgcaacgtcggcatcgatccggaagtctattccggcttcgcgttcggcatgggtatggagcgtctgaccatgctgcgctatggcgtaaccgatttacgtgcattcttcgaaaacgatctgcgtttcctcaaacagtttaaataaggcaggacaacataatgaaattcagtgaactgtggttacgcgaatgggttaatccggcgatcgacagcgacgcgctctccgatcagatcaccatggcgggtctggaagtggacggcgtggagccggtcgcaggccgctttaacggtgtggtagtgggtgaagtgatggagtgcggtcagcacccgaacgccgacaaactgcgcgtcaccaaagtcaacgtcggcggcgaccgcctgcttgatatcgtctgcggcgcgccgaactgccgtcagggcctgaaagtggcagtggcaaccgttggcgctgtgctgccgggcgatttcaaaatcaaagcggcaaaactgcgcggcgagccgtctgaaggcatgctctgctccttctcggaactgggtatttccgacgatcataacggcattatcgagctgcccgccgatgcgcccattggcaccgacctgcgcgactacctgaagcttgacgataacaccatcgaaatcagcgtgacgccaaaccgcgccgattgcctcggcattatcggcgttgcccgcgacgtggcggtgctgaaccaggcgccgctgatggagccggaaatcgcgcccgtagccgcaactatcaacgatacgctgccgatcgccgttgaagccgccgatgcctgcccgcgttatctgggccgcgtcgtgaaaggcatcaacgtcagcgcgccgacgccgctgtggatgaaagagaagctgcgccgctgtggtattcgttctgtcgatgccgtggttgacgttaccaactatgtgctgctggaactcggccagccgatgcacgccttcgatctgaaccgcattgacggcggcatcgtggtgcgaatggcgaaagagggcgaaaccctggtattgctggacggcaacgaagccaaactcaatgccgacaccctggtaattgctgaccacagcaaggcgctggcgatggccggtattttcggcggcgaacactccggcgtgaatgaccagacccaggacgtactgctggaatgcgccttcttcagcccgctgtccattaccggccgcgcacgccgtcacggtctgcataccgatgcgtcccaccgttacgagcgtggcgtggatccggcgctgcagttcaaagccatggagcgcgccacccgtctgctgatcgacatctgcggcggcaatgccggtccggtgattgacgtgaccaatgacgccgcgctgccgaaagcggcgaccatcaccctgcgtcgcagcaaactggatcgtctgattggtcatcacattgccgatgagcaggtcagcgacatcctgcgccgtctgggctgtgaagtcaccgaaggtcaggaccagtggcaggctgtggcgccgagctggcgtttcgatatcgctattgaagaagacctggttgaagaagtcgcccgtatttacggctacaacaatattccggacgagccggtgcaggctggcctgatcatgggtcagcaccgcgaagcggatctgtcgctgaagcgcgtgaaaacgctgcttatcgacaaaggctatcaggaagtcattacctacagcttcgtggatcctaaggtgcagcaactggtgcatccgggcgcggaagcgctgatcctgccaagcccgatctccagcgaaatgtcagccatgcgtctgtccctgtggacggggctgctgacaaccgtggtctataaccagaaccgtcagcagaaccgcgtgcgcatttttgaatccggcctgcgttttgtgccggataccacagcggatctgggtatccgtcaggatctgatgctggcgggcgttatttgtggcaaccgtcacgatgaacactggaatctggcaaaagagagcgttgatttctatgatttgaaaggcgatctggaatccgtgctcgatctgaccggcaaactgaacgagattcagttccaggcagaggccaatccggcgttgcatccgggccaggctgccgcgatttatctgaaaggtgaacgcgttggtttcattggtgttgtgcatcctgaactggagcgcaagctggatctcaatggtcgtaccatcgtgtttgagctggagtggaacaaggtcgcagaccgcgtggtgcctcaggcgcaggagatttcccgcttcccggcaaaccgccgcgacatcgctgttgtggtcgctgaaaatgtacccgcagcagatgttttggccgaatgtaagaaagttggcgtaaatcaggtagttggcgtaaacttatttgacgtgtaccgcggcaagggtgtggcggagggctataagagcctcgctatcagcctgatccttcaggataacagccgtacactcgaagaagaggagattgccgctaccgttgccagatgcgtaggggcattaaaagagcgattccaggcatcattgagggattgaacctatggcgctaacaaaagctgaaatgtcagaatatctgtttgataagcttgggcttagcaaacgggatgccaaagagcttgtagagttgtttttcgaagagatccgtcgcgctctggaaaacggtgaacaggtgaaactctctggcttcggtaatttcgatttgcgtgataagaatcaacgcccgggacgtaacccgaaaacgggcgaagatattcccattacagcccggcgcgtggtgaccttcagacccggccagaagttaaaaagccgcgttgaaaacgcttcgcccaaagcagagtaatctgaactaaccaaaaaggccgccatcgcggccttttttctttcctcattgcaatatcagcattaaaatcaaacacatcatttcaccgtatcccggacattatgcaggcacttgcccgtcttcagcaccgtcgcgatcgccgcagactgtgtatcctcgccctggtactgcttatcgcctgcaccctcagcctgtgcgccggggaccagtggatcgcgcccgacgcctggcttagcgacagcggtcgcctgttcgtcgggcaaattcgcctgccgcgaaccctggcggtgatgctggtgggcggcgcgctggcgctgtgcggggccgtaatgcaggcgctgtttgaaaacccactggcggagccggggctgctgggcgtgtcgaacggggcgggcgttgggttgattgccgccgtgctgctcgggcagggcatgctgcctgaatgggcgctggggctgtgcgccattctgggggcgctggtcattacgctgatcctgttgcgttttgctcggcgtcatctctccaccagccgactgctgctggcgggggtcgcgctgggcattatctgtagcgccctcatgacctgggctatttatttctccacgtcctttgatttacgccagctgatgtactggatgatgggcggttttggcggcgtcgactggcagcagagctggctgatgctggcgctggtcccggtgatggcgtgggtatgccttcagtcgcagccgctcaacatgctggcgctgggggaaatctccgcccgtcagctggggctgccgctgtggctgtggcgcaacgtgctggtggtcgccaccggctggatggtcggtgtgagcgtggcgctggccggggcgattggctttatcggcctggttattccccatattctgcgtctgtgcggtatgaccgaccatcgtgtgctgctgcccgcctgtacgctggcaggggcggcggcgctgctgttcgccgatattgtggcgcgtctggcgctcagcgcggcagagcttcccatcggcgttgtgaccgccacgctgggcgcacctgtatttatctggctattattaaaggccgggcgctaagacccggctatacgatctgcaaactaaggggatgttatgcaacatgatattttacataccgacgtgatcaccattgatggcgaacacacgacgcttgaacaatacgcaggtaaagtgctgctgatcgttaatgtcgcgtctaaatgcggcctgacgtcgcagtatgaacagctggaaaatatccagaaagcctggaaagacgccggattagtggtgctcggtttcccgtgcaatcagttcctcggtcaggagccgggcagcgaagaagagatcaaaaccttctgcagcaccacctatggcgtgaccttcccgatgttcagcaaaatcgacgtcaacggcgaaaaccgtcacccgctgtatcagaaactgattgcagccgccccgaccgccgttgcgccggaagcgagcggttttcatgagcgtctggccagtaaaggccgcgcgccgctgtatccggatgacatcctgtggaactttgaaaaattcctcattggtcgcgacggccaggtggtacagcgtttctcaccggacatgaccccggaagatccgattgtcatggaagccattaaggccgcgctggcgaaataatgtctgcgttgatgcaattacaggatgtggaggcgccgggccgactcggtccgctcagcggcgagatcggcaggggcgagatcctgcatctggtcggccccaacggtgccggtaaaagcacactgttggcgcgtatggccgggctgacccagggaaagggcagggtgatgtttaacgacacatccctggccgcctggcccgccacctcccttgcccgccaccgcgcttaccttgcgcagcagcagatgccgccgttctccatgccggtatggcattttctgtcgttgcatcaaccgcacaacccggacgcggcgctctgcgagtcagtcgccgccgcgcttggcctgagcgataagcttggacgcgccaccagtcagctttccggcggtgaatggcaacgcgtgcggctggcggcagtcattttgcagatccatccgcagggaaatgctgacggacaactattgttactggatgagccgatgaacagtctcgacgtggcgcagcaggctgcgctggacaggctgctcagcgcgctgtgcgcggcgggggtgacgattgtcatgagcagccacgatcttaatcatacgctgcgccacgcgcaccgtgcatggcttctgcgcagggggcagctggtcgccagtggcacgcgtgaccatgtgatgacgccggtcaatctcgaaaaagcctatcagatcccgtttcgtcgcctgaacattgaggggcatagcgtgctgatttccgcccgctaagtgaatggtaacttgcgcaggacacaacacacaggctaaatttctgctgaaataataaagtaaaggatgcgtccggtatgcgttactggtttttactcgcagcagcgttgtttctggcagggtgcagcagccatcgcgcgccgccgccaaatccccgtctttccgactcgatcaccgttatcgccggtcttaacgatcagctcagcaactggcgcggcacgccttaccgttatggcggtatgagccgtggcggcgtggattgttccggctttgtactgatgactttcagagacaagttcgatctgcaactgccgcgcgaaacccgccagcaggcaaagattggcaccgaaatcgacaaggacgatttgttgccgggcgatctggtgtttttcaaaacggggtcgggtgaaaacggtctgcacgtcggcatttatgataccgacaatcagtttattcatgcttccaccagccggggggtgatgcgctcatcgctggataatgtttactggcgtaaaaacttctggcaggcccgccgcatataaatctccccttcacccacccctaatggtgggtgaatatctcctttctcttattgtttttttcttaaccacttattccgccacggattactcctggtaaatcatcctaattaattaaactgttaatatttctaaactaatgtgttaatgaaattttcgttactggctattatagtttattcgggataagatttgccttagggcaaaggatgaaccgcaattaaaaaggaaaaaatgaaagtatttcgtcttaagccccctgggttgaatggtattaatacctttgttagcgagccgggaaacaccctaatcatgggactggcgatatgatcctgacgcttgaaagcacatggcgcaccgagctgttattacagcccgcccgtagcgcgcagggcaaactggaaggcctgcagattatcgtcaatcttattggcgtggatgggcacatccatacgcctgccggggagttactggcgcaactccccgcacagacagccctgacgctgttctcagaacagctggcgttgcttgaatcctgtaagctcttttttatccagcacagcattccggcctggattaatataacgccagtgattgccggggcgcttttaagtgatgctgaactggcggcgagcgtggaacgttttccatttctggcattctctattaatgagaattatcccgatttgaataaaggggctgcgcatccacaactttctgcgctcgcggaacgttattccctgatgctggaaaatttcggcgcaggaaaaagttccacccgggcggtatttgatggactgtttaaacaggtgattctggataaaaactttgtccatcatcgattaacctcacgctccttcgaaccttttatgcgtgccgttgttagccaggtaaaaccttattgtcagtcgattatcatcgacggcattgataatgaattttcccgccagcgtattttaccttttcatttctcagcgatgatgggggcgttatggtcgccggtgacggtggctgaactgaccactctggtacagggataaccctgaggttatcccgtgtttaacctccgcattacccactacacttaatgcaggaggaaacatgaccctttcttttactacccactggcgcgatgagctgccggagttttacaccgcactacaacccacgccgctacaaaatgcgcgcctggtctggcataacgaaccccttgccgaaacgctcggtattcctgcctcgctgttcaatactgcgcaaggtgcaggcgtttggggcggcgaggcgctgctgcctggcatgtcaccgctggcgcaggtttacagcggccaccagtttggcgtatgggcgggtcagcttggcgacgggcgcggcattctgctcggcgaacagttgctggctgatggaaccacccgcgactggcatctgaaaggcgcaggtctgacgccgtattcacgaatgggtgacggtcgcgccgtgctgcgctccactatccgggaaagtctggcctctgaagccatgcattatttagggatccccaccacgcgcgcgctgtcgatcgtcaccagcgacacgccggtgcgccgcgaaaccgtagagcagggggcgatgatgatccgtatcgcgcaaagtcacgtgcgcttcgggcatttcgaacatttttactaccgtcgcgaaccggaaaaagtgcagaagctggcggatttcgttattcggcattactggccgcagctgcaggatgaggcggataagtatgccctgtggtttaacgatgtggtgagccggacggcgtcgctgattgcgcgctggcaggccgtcggcttcgctcatggggtgatgaacaccgataacatgtcgattctcggcctgaccattgattatggcccctacggtttcctcgacgattaccagccgggttatatctgtaaccattccgattatcagggccgctatcgttttgataatcagcctggggtggggttgtggaatctgcaaaaactggcgcagacgctgtcgccgtttatcgcggtggaagtccttaatcaggcgctggaaaactatcagcaggtgctgctgcgggaatatggcgctttaatgcgcagtaaactgggcttcacgacagaacagaagggcgataacgagatactgaaccggctgttcgctctgatggcaagggagggcagcgactacacccgtaccttccgtatgctcagtcagacggagcagcagagcgccagctcgccgctgcgcgatgaatttatagatcgggccgggtttgatgcctggtttgtggattatcgtgcgcgtctgcaacaggaaggcgttgatgacgtgacgcggcaggggcagatgcaggcggtgaacccggcgatggtgctgcgtaactggctggcccagcgcgccatcgaacaggcggagcagggtgacatggcggagcttgagcgtttgcatattgcactgcgcacaccctttgcagacaggggagatgattacgtcagccgcccgccggactggggtaagcgtctggaagtgagctgctcgagctaagcgatttgcgccgggtggcggcttcgccttacccggcctacatgatgagcgcggtgtaatgcgatgcattgccgggtggcggcattcgccttacccggcctacattctggattcactgtggtatcgacagttgtaggcccggcaagcgtagcgccgccgggcatccatggaaccgccctcagaaccggctgtccacggcgctggcgagcatttccagcagcctttcgctgtcgtcccagcccagacatggatcggtgatcgactgcccgtacaccagcggctgtccggcgacgattttctgcgtgccttcttctataaagctttccgccatgatcccggcgatagccgtcgatccggcgcggatctgctggcaaatgtcttcacacacctccagctgacggcgatgctgcttctggcagttgccgtggctgaaatccaccaccagctgctccggcaggctgaactcgcgcagcgtgtcgcaggctttcgccaggtcttccgcccgatagttcggctgtttgccgccgcgcataataatgtgcccgtacggattaccgctggtctggtaaatggtcatctggccggttttatccggtgagaggaacatatggctggcgcgcgaggcacggatggcatccaccgcgataagcgtattgccgtcggtgccgtttttgaagcccaccggacaggagagcgccgacgccatttcccggtggatctggctttcggtggtacgcgcgccgatagcgccccagctgatgagatcggcaataaactgcccggtcaccatatcgaggaattccgtggcggtaggcaccccaagctcgttcacctgcaacagcagtttacgcgccagttcgataccgtgattcacgcgatagctgccgttaagatccggatcggagatcagccctttccagcccactaccgtgcgcggcttttcaaaataggtgcgcatgacgatttccagccggtgctggtacttctcacgcagcccctgtaaacgacgggcgtagtccatcgcggcgtcgagatcgtgaatggagcaggggccgacaatcaccagcaggcggcgatccgtcccgttaaggattttctcaatgcgacgccgtgaggccgtgacgtgttccgccacgcttgcggagacaggatagcgttgcgccagttcagccggcgtgaccaggctgtctatgcgcgcagtacgcagttcatcggttttattcattacatttctcagaaatttgtggcttcagcggcaggtctgccgggaagtgatgggcatcacgataaaccaatcccgtggtatttcaagtgcgggcgtgatacgcatcacaatccaaaaggtaatgataacgaaattttaaccgatgtactagcttgctagtgcacaggagtgcgccggttaatacatgcggcggttcagcttcatcatgtcgagtattttggtggcgatctcctccacggagaaattggtgctgttaagaaaaggaatttggtttttccggtacagcgcttccacttccgccacttccatgcggcactggcgcagcgaggcgtagcgactgttttcccgccgctcttcacggatagcggcgaggcgctcggcgttgatggtcagcccgaaaagtttatgctgcaacggcttaagcgcagcgggcagcaccaggttatccatatcgtcggcgataaagggatagttggcggcgcgcacgccgaactgcatcgccagatagagactggtgggagttttaccgcagcgcgacacgcccagcagaataacctgcgcctgatccagattacgcatcgaaatgccgtcatcgtgcgccagcgtataatcgatggcggcgatacgcgcatcgtacttaatcagattgccgggattaagcccgtgagtgcggtgcgcaacgggggtgggatcgagcttgagctcctgctgtaagggcgcgaccagcgcctgtacgatgtcctgacagaacccttcgctttgcataatgatgttgcgcacttctggcagcacaatggagtaaaacaccagcggacggatcccggtctgctgatagagcgcgtcgatctgctctttcaccgccttcgcgcggctttcgttttccacaaagggcagggtgatgctgttgatggcgaccggaaactgcgacatcaccgcatgccccagcacctcggcggtgattgccgttccgtcagaaatataaaaaacatgcctgtctacagaattatccatttaagccgccctgaaataatcgtaattgcataaaagcataaattaaaatcaccaggatgcgtagtcagtagtcggcaattctaaaaaatgaaatgctgtttttatttttaatgaaaagtgcatttcattttccaatgctgagcacagtgcgcgccagttctcatgaattcagatgattcagacacttaccgctaatcgggaaacagtccgaaaaagcagaaataaaatttgcttgaacgattcaccgtttttttcagcggaataagtatgccaggataattgcgttataaggtctttcttaaacccgttcatatatcacaaaaggattgttcgatgtccaacaatggctcgtcaccgctggtgctttggtataaccaactcggcatgaatgatgtagacagagttggaggcaaaaatgcctccctgggtgaaatgatcaccaatctgtccggtatgggtgtttccgtaccgaacggattcgccaccaccgccgatgcctttaatctgtttcttgatcaaagcggcgtaaaccaacgtatctatgatctgctggataaaacggatattgatgacgtgggcgaactggcgaaagcaggcgcgcaaattcgggcgtggatcatcgacacacctttccagccggaactggaacaggccattcacgaggcctataaccagctgtctgctgacgacgcagaagcctcctttgcggtgcgctcctccgccaccgcagaagacatgccggatgcctcttttgccggtcagcaggaaaccttccttaacgtgcagggctacgatgccgtgctggtggcggtgaagcatgtttttgcctcactgtttaacgaccgcgccatttcttaccgcgtgcatcagggctatgaccaccgtggcgtggcgctgtcggcgggcgtacagcgtatggtgcgttccgatctggcgtcctccggcgttatgttctccattgatactgaatccggcttcgatcaggtggtgtttatcacttctgcatggggactcggcgagatggtggtgcagggcgcggtcaaccctgacgagttttatgtgcacaaaccaacgctggaagccgggcgtccgtccatcgtccgccgcaccatgggctcgaaaaaaatccgcatgatctatgccccgacccaggagcacggcaagcaggtgcgcattgaagatgtgccggaagccgaccgcgacatcttctcgctgaccgatgaagaagtgcaggagctggcgaaacaggcggtgcagatcgagaaacactacggtcgtccgatggatattgaatgggcgaaagacggtcataccggcaaactctttatcgtgcaggcgcgtccggaaaccgtgcgttcacgcggtcaggtcatggagcgttataccctgcatgaccagggcaaaatcatcgctgaagggcgtgcaattggccaccgcattggcgcgggtccggtaaaagtgatccacgacatcagcgagatgaaccgaattgagccaggggacgtgctggtcaccgacatgaccgacccggactgggagccgatcatgaaaaaagcggcggccatcgtcaccaaccgtggcggacgcacctgtcacgcggcgatcatcgcccgtgaactgggcattccggcagtggtgggctgcggcgatgccaccgagcgcatgaaggatgacgaaaaagtcaccgtttcctgcgccgaaggtgataccggttacgtctatgccgagatgctcgatttcagcgtgaaaagctccagcgtcgacaccatgccggatctgcctctgaaaatcatgatgaacgtcggcaacccggatcgcgcttttgacttcgcctgcctgcccaatgaaggcgtgggtcttgcgcgcctggaattcatcatcaaccgtatgatcggcgtgcatccacgcgcgctgctggagtttgacgatcaggacccggcgctgcaaaaagagatccgtgcgctgatgaaaggttacgattcgccgaaagacttttacgttggacgtctgagcgaaggcatcgcaaccctgggggcagcgttttacccgaaacgcgtgattgtgcgtctgtctgattttaaatcgaacgaatacgccaacctggtgggcggcgagcgttacgagccggaagaagaaaacccgatgcttggcttccgcggcgcggggcgttacgtggccgacagcttccgcgactgcttcgcgctggagtgcgacgcggtgaaatacgtacgtaacgaaatgggcctgaccaacgtcgagatcatgatcccctttgtgcgcaccgtggcgcaggcgaaagcggtcattgaggagctggagcgtcaggggcttaagcgcggcgaaaacgggctgaaagtgatcatgatgtgcgaaattccgtccaacgccctgctggcagagcagttcctcaagtatttcgacgggttctccatcggctccaacgatatgacgcagctggcgctgggcctcgaccgcgattccggcgtggtttctgaactcttcgacgaacgtaacgacgcggtaaaagcgctgctttccatggcgatccgcgcggcgaagaaacagggtaaatacgtgggcatctgcggccaggggccgtccgatcatgaagattttgccgcctggctgatggaggagggaattgacagtctttctctgaatccggataccgtggtacaaacctggctaagtcttgccgagctgaaaaaataattaacctgccatcgtccccggaattatccggggatttttttatctttaaaacgccgttttaaggataaaaaaaagcccatcgtgggagatgggcaaagactacacacagcaattcgttgtttcactcaggggatttccatgcttataaatcaatgcgttgatttataaccgtgacctaatagtaggcatgacgaatttttgcgtcgatcagattcgtctcaatagttaaataagcgtaaagaatttgcgacagataaacgccatggcatggggaaagtaccaggaatattcgcagacgtagtgggaattgattagcagcacttaattatcggcgggtttccccgccgaatgattattttttattcgcttctatgtcttcgacaggctgcgccggaacgtctaccggtgcgggcacttcttttacccaggcatcaaacagacgccagctcaccgccagcagcaccgggccgataaacaggccaatcatgccaaaggcgataagcccgccgataacgccggataaaatcaggatcagcggcaggtctgcgcccatacggatcagcaccggacgaatcacgttatccagcgtacccaccacgcagctccacaccagcagcaccgtgccccaggtggtgtcgccgctccagtagagccagataatcgccgggatcagcaccggcagcgggccaagctggataaggcacgacatgatcatcaccacggtgaacagcgtggcataaggcacgcccgccacggcaagcccgatgccgccgaggatcgcctgcaccagcgcggtgaccaccacccccagcgcaaccgcacggatcgcctgtgccgccagcagcaccgccgcgtcgccacggctggaggccagccgggtggcgaaatgacggataccgcgcgccacctgctcgccgcgccagtacagcagggcgctgaacagcagcatcagcacacagtgcatcaggaagcggccaatatgcgccgcctggccgacaaaccaggtggtggtggtgccgatataggggcgcactttcgccatgatggcgctgccgcccatatccagcaggttatgccatccggtataaagcttatcgcccaccagcggaacactgttaagccaggccagatcgggtaaggtcatatcgcctgcggttatggcgtggatcaccgggccgctgccgtccaccagactgttcaccagcagcgcaatggggatcacaaagacaaggatcaggaacagcgtcatcaccagcaccgccagcgagcggcggcccagcaaacggcgttgcaggcgtaaaaaaagcggccaggtggcgatcacaatggtgcccgcccaggcgaaacccagtacaaacggccatacgatccacaaacaggcgataatcatcagcgctaaaaacagcaccgacagcaaaatttgcggtacatccctggcctgtcgaaaattaaccatatttttcttcatcctgttggtgcgccggaagctggcgcaaaaaatgtatttcagaatctgcgaaatatcagcgatttcagacagcgaattctgcctgtaattctgccgcgcgtataagaaaaaaatgtgatacaacgataaacgcgcaatgcaaacgattaaatactcacaactctaacagtcaggcagggtcaacagtaatgatcccacagatttctcaggcacccggcgtcgttcagctggtgctgaattttttacaggcactggagcaacaaggttttaccggagacaccgccaccagttatgccgatcggctgacgatggcgaccgataacagcatctatcaactcctccctgatgccgtggtcttcccccgatcaaccgccgacgtcacgctgattgcgcgtattgccgccgaaccgcgtttcgaatcgctgatctttaccccgcgtggcggcggcaccggcacaaacggccaggcgctgaacgccggtattgtggtcgatatgtcgcgctatatgaaccgcatcctggaaatcaaccccgaagagggctgggtgcgcgtcgaagccggggtaattaaggatcagcttaaccagtatctgaaaccttacggctatttctttgcgccggaactctccaccagtaaccgcgccacgctgggcggaatgatcaacaccgatgcatccggacagggatcgctggtgtacggcaaaacctcggatcatacgctgggcgtgcgggcggtgctgatgggcggcgatattctggacacgcagccggtatcgctggagctggcggaaaccctcggcgaggtgcagaccgccattggccgcatctacaaagccgtttatgaaagctgccgggataaccgccagttgatcatcgataaatttccaaaactgaaccgcttcctgaccggctacgatttgcgtcacgtctttaacgacgagatgacccgttttgatttaacccgcatcctgaccggctccgaaggcacgctggcgtttattaccgaagcgcggctggatattacgccattgccgaaagtgcgccgtctggtaaacatcaaatacgactccttcaactcagcgctgcgcaatgcgccttttatggtggaagcgcgggcgctgtcggtggaaaccgtcgactcaaaagtgctcaatctggcgcgggaagatatcgtctggcattcggtgcatgaattgatcaccgatgtgccggataaagagatgctgggcctgaacattgttgagttcgccggtgacgacgaagccctgatcgacggccaggtcagcgatctctgtcagcggctggacagcctaatcgccacagagcagggtggggtgattggctggcaggtgtgcggcgatctggcaggcattgagcgtatctacgccatgcgtaaaaaagccgtcggcctgctcggtaacgcaaagggcgcggccaagccgatcccctttgcggaagatacctgcgtgccgccggagcatctggcggattacatcgtcgaattccgcgcgctgctggacagccacggactgagctacggcatgttcggacatgtggatgccggtgtactgcacgtgcgtccggcgctggacatgtgcgatccgcagcaggagatgttgatgaagcagatctccgacgaggtcgtggcgctgaccgcgaaatacggcggcctgctgtggggcgagcatggcaaaggcttccgcgccgaatacagcccggcgttttttggcgaacagctgttcggcgaactgcgcaaaatcaaagcggcctttgatccccataaccgcctgaacccgggaaaaatctgtccgcctgcgggcgttgacgcgcccatgatgcaggtggacgcggtaaaacgcggcacttttgatcgccagatccccattgccgtacgtgcttcctggcgcggcgcgatggagtgtaacggtaacggtctgtgctttaactttgatgtcaaaagcccgatgtgcccgtcaatgaagatcaccagcaaccgtattcattcgccgaaaggccgcgccaccctggtgcgtgaatggctgcgtctgctggcggatcgcggcgtcgatccgctgaagctggaaaaagagctggcggaaagtcgcgtcagcctgcggggacttatcgaacgaacgcgcaatagctggcatgcgcgcaagggcgaatatgacttttctcatgaagtgaaagaggcgatgtccggctgtctggcctgtaaagcctgctcgactcagtgtccgattaaaatcgatgtgccggagttccgctcccgcttcctgcaactttatcacacccgctatctccgcccgctgcgcgatcacctggtcgcctcggtggaaagctatgcaccgctgatggcccgcgcgccgaagaccttcaacttcttcctgcgccagccctggctgcgcacgctgtcggaaaaacgcatcggcatggtggatttgccgctcctgtcggtgccgtcgctgcaacagcagctggtggggcaccgcaccgccaatatgacgctggaaaatctggaacagttaagcgacgaacaaaaagcccgcacggtgctggtggtgcaggatccctttaccagctattacgatgcgcaggtggtgagcgattttgtgcggctggcagaaaaactgggctaccagccggtgatcctgccattctcgccaaacggcaaagcgcagcatatcaagggcttcctgatgcgctttgcgaaaacagcgcagaaaacctcagacttcctgacgcgcattgcgcaactggggatgccgatggtgggggtcgatccggcgctggtgctgtgctatcgcgatgaatataaacaaacgctgggcgacaaacgcggcgagtttaacgtgcagctggtgcatgagtggctgccggcggtgctggaaaacgtcgagccgcgcgtggtcagcggcgaggcctggtatctgttcggccactgcaccgaagtcaccgcgctgccggggacgccggggcagtgggcatctatctttgcccgtttcggcgcgaaactggaaaacatcagcgtcggttgctgcggcatggcgggcacctacggccatgaagttaaaaatcacgccagttcgctggggatttatgagctgtcgtggcatcaggcgatgcaacgtctgccgcgtaatcgctgtctggcgaccggctattcctgccggagtcaggttaagcgtattgagggcagcggggtacgccatccgttacaggctttactggagataattggatgatctggaaacgtgaagcgacgctggaggcgttaaacgccatgagcgaagggaatatggtcgggctgctggatatacgatttgagcgtatcactgctgacagtctcgaggcgacgatgccggtggacagccgcacgcatcagccatttggcctgctgcacggcggcgcctctgtggtgctggcggaaacgcttggctcggtggcgggctatctgtgcagcgagggcgaacaaaatgtggtggggctggaagtgaatgccaaccatatccgcgcggtgcgcagcggccgtgtgcgcggcgtctgtaccgctctgcatacggggggacgtcatcaggtctggcagatccacatttacgatgaacagaaccgcctgtgctgcgcctcccgcctcaccaccgccattatctaatcctctgggcggttgtagacgcagccgcccactccaatctatccatcgcgtgataatttcgtagtgtgatatagtgcgcaatattgaatctctgagtggcagtgttgtctaacccagagacggtaacgcatataagcctggaaataagaatcgtggtttccttgcgcgctacttaatgtgtgtttttcaggtaatcttgtaatgcgtacttccttaaagctctcttttcttcacccacgccactggtttacatggtttggtcttggcgttctctggctgctggtgcagttaccctatccactgatcgctcgtctcggtacctcgctcggtacgctggcgcgtccctttctgaaacgccgtgaaagcatcgcccgccgcaatctggaactctgttttccggagatggatccgctggtgcgcgaagtcttaatcgaaaataatttccgctcgctgggcatggggctgctggaaaccggcatggcctggttctggccggacgagcgcgtgcgtcgctggtttgatgttgagggttatcagcatctgcaggatgcgcaggcaaaacagaaaggcgtgatggttatcggcgtgcattttatgtcgctggagctgggcggtcgggtgatgggcctgtgccagccaatgatggcgacctatcgtccgcataacaatccgctgatggagtgggtgcagacccggggccggatgcgttccaataaatcgatgatcgaccgccgtaacctgaaagggctggtcaacgcgctgaaaaagggtgaagccgtatggtttgccccggaccaggattatggtcgcaagggcagcaccttcgcgccgttctttgacgttaacgccgccaccaccaacggtacctatgtgctgtcgcgtctgtccggctctgtgatgttgacggtgacgatggtgcgcaagcctgaccgttcaggatattcattatttatcggccccgagctgaccgattacccaaaagaaaatgaattcgaagccgccagctacatgaacagggttgtcgagcgtgagattttacgcgcccccgaccagtacctgtgggtgcaccgccgcttcaaaacccgcccgatgggcgagtcttcactgtatcgttaagcttcgctgtacgcctgccttccctggcaggcgctgacccttttattttaccgttacgataacttattgatttttcgatgagtgatttgttacatgtaaaaaagggtattttatgagaaaggagtgctttaactcaaaaatacaatgggttggcgtgatactattgctgttcactgccgtacaggcagcttagaaatgctgcgctttattggatacgacaaagtgcaagtgcactgccgtacaggcagcctcaaaataaagcccgtgcaatcacatcaccgtaatagttccgcagctacaaaaagcccaggcccaattttgtcgggtggcgcttcgcttacccgacctaccgcaactgacccggcctgcaatgacaaactgcgtctcatgggcatactgcccgcatcatttgtcacgtttatattacagaattgttataaaatcctatctgataaataggcattgcctatgcatgtttcatttctccagggtgtgttaaagaccaccgcataaaaatattttatattcaaatgcttagttatcgcagacctttccggttaacccggttgtgagggtctatgcttaatagaactgtgcaaaaagagcgcttcagggaataaccctttggaatagaggttgaagtgataatcattatcactaacatagcgttatgccctatggcgcaatcacgtgaggtagacctatggaattgcaagcaggaaccttcgaccccaacgatcccggttggcagggcctgacattaacgccagccgccgcgaagcatatccgcgcgctggtggaaaagcagccagagctgctcggcgtacgtctgggtatcaaacagaccggttgtgccggttttggttatgttcttgatacggttttcgatccggtggcagacgatctgctgttcgagttcgacggcgcgcgtctctacgtgccgcttcaggcgatgccctttattgacggcaccgaagtggactatgtgcgcgaaggactgaatcagattttcaaattcaataacccgaaagcgcagcacgaatgcggctgcggcgaaagctttggggtataggcggtactatgtctcgtaatactgaagcgactgacgatgtcaaaacctggtccggcccgctgaattacaaagagggcttcttcacccggttacagacggacgaaatggctcacggcatcaatgaagatgtcgtgcgggcgatctcggccaaacgcaacgaacctgaatggatgctggagttccgcctgaaggcctatcatgcctggctggaaatggaagaaccgcactggcttaaagcccattacgacaagctggattaccaggattacagctactactccgcgccatcctgcggcaactgcgacgacacctgcgcctcgcagccgggcgcggtacagcaaaccggcgccggcagctatctgaccgacgaagtggaagaggcttttaatcagctgggcgtaccggtgcgtgaagggcgcgaagtggcgatggacgccatttttgactcggtgtccgtggccaccacctatcgtgaaaagctcgctgagcacggcgtgatcttcagctccttcggggaggcgatccacgatcatccggagctggtgcagaagtatctcggcaccgtggtgccgtcgaacgataacttctttgcggcgctcaatgcggcggtcgcctcggacggcacctttatctacatcccgaaaggggtgcgctgtccgatggagctgtccacctatttccgtatcaacgcggaaaaaaccggccagttcgagcgcaccattttgatcgccgatgaaggcagctacgtcagctatatcgaaggctgctccgcgccggtgcgcgacagctaccagctgcatgcggcggtggtggaagtgatcattcacaaagatgcggaagtgaagtactccaccgtgcagaactggttccccggcgataacaataccggcggtattctgaacttcgtcaccaagcgtgcgctgtgtgaaggcgaaaacagcaaaatgtcctggacgcagtcggaaaccgggtcggccatcacctggaaatacccgagctgcattctgcgcggcgacaactccatcggcgagttctactcggtggcgctgaccagcgggcatcagcaggcggataccggcaccaagatgatccacatcggcaagaacacccgttcgaccattatctcgaaagggatctccgccgggaaaagtcagaacagctatcgcgggctggtaaaaatcatgccgaccgccactaacgcgcgtaactttacccagtgtgactcgatgctgattggcccggactgcggcgctcacaccttcccgtatgtggaatgccgcaataacagcgcgcagctggagcacgaagctaccacctcgcgtatcggcgaagatcagctgttctactgcctgcaacgcggcatcagcgaagaagatgcgatctcgatgatcgtcaacggcttctgtaaggatgttttctccgagctgccgctggagtttgccgttgaagcccagaaattactcgccatcagccttgagcacagcgtcggttaaggaaattacatgttaagcattaaagatttgcaggttgccgttgaagagaaagagatcctgcgcggtctgaacctggaagtgcgtcctggtgaagtgcacgccattatggggccaaacggctccgggaaaagtacgctctcagcaacccttgccgggcgcgaagattatgaagtgaccggtggttcagtgcagttccacggcaaagatctgctggagctgtcgccggaagagcgcgcgggcgaaggcatctttatggcgttccagtatccggtggaaatccccggcgtcagcaaccagttcttcctgcaaaccgcgctcaacgccgtgcgcaaatatcgcgggctggatgagttagatcgttttgacttccaggatctgatggaagagaaaatcaagctactgaaaatgcccgaagatctgctgacgcgctcagttaacgtcggtttctccggcggcgagaaaaagcgtaacgacattctgcaaatggcggtgctggagccggaactgtgcattctcgatgaaacggactccggcctggatatcgatgcgctgaaaatcgttgccgaaggggtgaactccctgcgcgacgaaaagcgcgcctttatcatcgtcacgcactaccagcgcattctggattacatcaagcccgactttgtgcacgtgctgtaccagggccgcattgtgaaatccggtgattttacgctggtgaaacaactggaggagcagggctatggctggcttaccgaacagcagtaacgcgctgcaacagtggcatcatctgtttgaaaccgagggcagcgcgcgttcggaacaggcgcagcagcatctgcaacaggtgctgcgtttagggctgccgacgcgtaagcacgaaaactggaaatacacgccgctggaagggctgctcagcagccactttgtcagcacgcagacccggttatccgccgcacagcgtgacgcgctggctctgccggtggacgcggtgcgactggtgtttgtcgacgggcgctttgacgccgaactcagcgacagtaccgaaaacagcggctttgtggtcagcattaacgacgagcgcgccgcgctgcccgcgccggtacagccggaagtgtttctgcatctgacggaaagcctggcgcacagcgtcacccatatccgcgtggtgcgcaaccagcgtccggcgaagccgctgctgctgatgcatatcacccagggactggcgggcgaggagatgaacaccgcccactatcgccatcatctggatctggagcagggcgcagaggcgacggtctatgagcattacgtcagcctgaacgatcagcggcattttaccggctcgcgtctgaccatgaacgtggcggccaatgcgcagttgcatcacgcgaagctggcgtttgaaaatccgcagagctaccactttgcgcataacgatattctgctggccgccgatgccgccgcgcacagccacagttttctgctcggcggggcggtgctgcgtcacaacaccagcatggcgctgaacggcgaaaacaccacgctgcgcgtgaacagcctggtgatgccggtgaacagtgaagtgtgcgacacccgtacctggcttgcccataacaagggctactgcaacagccgtcagctgcacaaaaccatcgtctctgacaaaggccgggccgtattcaacgggctgattaacgtggcgcagcatgccatcaaaaccgacgggcagatgaccaacaacaatctgctgcttggccgtctgtcggaagtggataccaaaccgcagcttgaaatttacgccgatgacgtaaaatgcagccacggcgcgaccattggccgcatcgacgatgaacaaatgttttacctgcgctcgcgcggcattgatgagaaggccgcgcagcaaatgatcatctacgcctttgccgctgaactgacggaagccatcagcgacgaggcgctcaggcatgaggtactgtcccgtatcggtcagcgcctgccagggggcatcgcatgagtttttccgttgagcgcgtacgggcggattttccggttctgacgcgtgaagtgaatggccagccgctggcgtatctcgacagcgccgccagcgcacaaaaacccaatcaggtgattgatgccgaagcggagttttatcgtcacggctacgctgccgtgcaccgcggcattcataccctgagtgccgaagccacccagcgcatggaaaacgtgcgcacccaggcgtcacggtttatcaacgcccgtacgccggaagagctggtgttcgtgcgcggcaccactgaaggcatcaacctcgtcgccaacagctggggcaacagcaatgtggcggcgggtgacaacatcatcattaccgccatggagcatcacgccaatatcgtgccctggcagatgctgtgtgaacgcaccggcgctgaactgcgcgtgatcccgattaatcaggacggtaccctgcaactggacgcccttgccgggctgctcgatgaccgcacgcggctggtggcggtgacgcacgtctctaacgtgctcggcaccgagaatccgctggcggcgatcatcgcacaggcgcatcaacagggcgcaaaagtgctggtggacggcgcgcaggcggtgatgcatcacgcggtggacgtgcaggcgctggactgcgatttttacgtcttctccgcccataaactgtatggcccgaccggtatcggcattctttatgtaaaagaggcgatcctgcaggcgatgccgccgtgggaagggggcggggcgatgatcgccaccgtcagcctgacggaaggcaccacctgggcgaaagcgccgtggcgcttcgaggcgggcacgccgaataccggggcgattatcggttttggtgccgctattgagtacgtcactgcgctgggactggacgccattgccgaacacgaacgcggactgatgcgttatgcgcttaacgcgctggcggaggtcccggatctgacgctttacggcccggcggatcgtctgggggttatcgcctttaatctggggaaacatcacgcctatgacgtgggcagttttctcgataattacggcgtcgcggtgcgtaccggacatcactgcgcgatgccgctgatggcgttttacaatgtgccggccatgtgccgcgcgtcgctggtgatgtacaacacgcaagaagaagtggatcgtctggtagccggactgaaacgcattcatcagttattaggctgacagggggacgagatggccgctttacccgataaagaaaaactgttgcgcaactttacccgttgcgccaactgggaagagaagtatctctacatcattgaactgggccagcgcctgccggaactggcagcggaggcgcacagcccggaaaatgttattcagggctgccagagtcaggtatggatcgtcatgcagcgccgggatgatggcgtgattgaactccagggcgatagcgatgctgccatcgtcaaggggctgattgcggtggtgtttattctgtatcagcagatgaccgagcaggatatcgtcgcctttgacgtgcgcccgtggtttgaaaagatgtctctcgcccagcatttaacgccttcccgctcgcagggtctggaagcaatgatccgcgcaatacgtacgaaagcagcaaacattagctaaactcaaaagacagcgactatcctgttatgcggggcagatttctgcctcgctggtttatcagccttctggcgcactgccagtgattacaggagtttaagcatgaagcgcgcgtctctaataacattaagccttatcggcgcttacagcgtcattcagagtgcctgggcggccgattatccattaccgccggcgggcagtcgtctcatcggtcagaatcagacttatgtcgtgcaacctcaggatcgtaatttgcaggccatcggccgtcattttgacaccggcgcgatgctgctcgtcgaagccaacgataccatggcgcctgtccccgcccctggcacaaccctgaccattccaacgcagatgctgctgccggacagcccgcgggaggggatcatcgtcaacctggcggagctgcgtctctatttttatccgccgggaaaagacattgtgcaggtcttccccattggtatcggccagcaggggctggaaacgcccatcgccgagacacgcgtcagccagaagatccccaatcctacctggacgccgcctgcgggcatacgtgcgcgttctaaagcgaagggcattgagttgcccgccgtggtgccagcaggcccttataaccctctggggcgctatgcgctgcgtcttgggctgggcaacggcgaatatctcattcacggcaccaacgctcaggacagcgtaggcctgcgcgtcagctccggctgtattcgcatgggcgcgccggatatcgaagcgctgttctcccaggtgaacaccgggacgccggtgcgcatcatcaacgaaccggtcaaatactccgtggagccggatggccgccactatatcgaagtgcaccgcccgctggcttccacccttgaggagaacacccagacggtgccgatcacgctgaccgccacctttagcgattttattcgtcaggcgggcggggatcagacggcgattgataaggcaatggtgcgccgtgccggttacccggtggcgatccctgccgcaaagaacgcgcaggcaaacccgacagccgtactgtcagcaaagaatggtgatccggcggtggcgaacgagaacgggaaagtgatgacgcagtaacggaaggtaaatcgcaggcaaaaaaaatggcgcacaatgtgcgccattttattacaggaactcttacttacggtaagagtgagcctggttgtccagacgctggttagcgcgagctgcgtcgtctttagcagcctgaacgtcagaacggattgcgttcacgtcgttgctcagctggtcaactttagcgttcagagtctgaacgtcagaagacagctgatcgattttagcattgctggagcaaccagccagcagagtagaacccaggattaccgcgcccagtaccagtttagtacgattcattattaataccctctagattgagttaatctccatgtagcgttacaagtattacacaaacttttttatattgagaatatttttttgttgggaatacccttaaatttgactgttcgctcaaagaaacaccgactttgcgggcgcacagaaaaaaactgtgtgaaaacagaccgctttcatcggattcatcttagaaaaaagtcagttaaatagtgcatttcgatttgcacttattgaaaatcgttattggatgaataaaaaaaagcgccacaagggcgcttttttaatcagattaatttgtacggcaattattacagcacgtgcacagaagcagtattggttgtgccgcttggaaccagcgcgccggaaaccattaccacaacttcacctttctgagccaggccgctttccagcgccacttctttacccagacggtagaaatcgtccgtggaggagatctctttcaccagctgcgcggtaacgcctttgctgagcaccagctgacgggcagtgacttcgttagtggtcagcgccaggatggtggcatccgggaagtatttacggatagcgcgcgcagatttaccgccctgggtcgctaccacgatcagcggagcagccagtttttcggcagtttcaacggcaccacggcacacggcttcggtgatgcgcagtttacggctgtcgttggtaaactccagacggctggtcatcacgcggtcagtacgctcgcagatggtcgccatgatggagacggcttccagcgggtatttacccttggcagactcaccagacagcattacggcatcggtaccgtccaggatggcgttagccacgtcgcctgcttccgcacgggtcggacgcgggtttttgatcatggaatccagcatctgggtcgcggtgatcaccactttacgggcgcggatacatttttcgatcatcatcttctgcgcgaagatcacttcttcaaccgggatctcaacgcccaggtcgccacgcgcaaccatgatgccgtcagaggcttcgaggatttcgtcgaagttgttcaggccttcctggttttcgattttggagatgatctggatgtgctcgccgccgtgcgctttcaggtgctcacggatttccaccacgtcagaacgcttacggataaaggatgccgcaacgaagtcaacgccttgctcgcagccaaagatcaggtcttgtttgtctttttctgccagcgcaggcagggcgatggaaacgcccggcaggttaacgcctttgttctcgcccaggtcgccgttgttcagcactttacagataactttgttgccttcgatggcggtcacttccataccgatcagaccatcgtcaaccagtacggtgttgccaacggacaggtcattggtgaagccttcgtaagtgacagcaacgatatcgctgttacccacaacggttttgtccgtggtgaaagtgaaggtctgacctgctttcagggagacgtcattaccgccttccagcttgatggtacggatttccggacctttggtgtccagcaggatggcggctttcttgccggttttgctcatcacgttgcgcaagtttttgatgcgctgaccgtgttcagcatagtcgccgtgagagaagttcagacgcatcacgttcatgccggcgtccagcattttggtcagcatctcttctgattcggtttttgggccgattgtgcaaacaattttggtctttttcatgacagtcttagtctttaagttgagaaggatatggaaataacgctccgggggcgcaccgccgcggagtcaaaccggtgttgcgaaagttttgcgatgtcacgtcataagaataggtgacatcaaaaaaagcgtgcagaggaatatgtgcttgtgtatcagcccaggggggaatgagtcgctgtgatagttgaatattacagttcaatgagctgaaaccattcaagagtcaattggcgcgcattatacgatgaaaaacagtcaaaaggaaaatgaaaacagcgtttcaaaatgcatctgtgcagattcacaacgaagtgttatcaaggtgttaagtaaagacagaaataatttcaggcacttaataaaattaacaggcccgagggggtaaaacccgacgggcctgttgcgctcaccttaaactttcaccagccttgagaccagcgccacgcccaccatggcgatggccaccaccacaaaagcagcgctcaggctgctgtgatgcgcaatcccgccgatacttgccgggcccgccagcacgcccatgtagccgagcgtagtgacggcaggcaccgccagcacctgcggcatggctgtctgacgtccgattgccgaaaacatcaccggcacgatgtttgcgcaacccagaccgatcagcgcgtaacccgtcagcgacagcacccaggcatcagacgccaccgtcagtaacaggccagcggcggccagcagcgcgccgacaaagaccaccggctgctggccgagacgggcgacaacgcggtcaccggttaatcgccccagcgtcatggtggcggcgaagcaggcaaaacccagcccgccgcgtgcttccggcagcccgcggtattcggtgaggaacaccgcgctccagtccagcaccgccccttccgccagaaacaccacgaagcagataccgccaagcagcagcacgataccgtgcggcaccgcaaaggccggaccttcctgcggattcgcgtagctgagaaaaccgcgcacgcacaccagcagtaacgctatcacgataagggtggtggcaagactggccgcctgggcggaaagccccagcgacatcatgccgctcatcgcaccggcaccggcaatccctcccacgctgtaaaagccgtgaaaaccggacatcagcggacggggagacgctttttcgacaatgatcgcctgtacgttcatcgcgcagtcagtggtgccgataccaataccgaacagcagcagcgccagcgccagcagtcgcgcatcctgggttatcgccagcagcggcagaatggcgcagaaaatcagcaccgacaccaccataacccgacgacagccaaagcgggcggtcagcgcgccggtaaggggcatagccaccagcgcgccgccgccgagacacagcagcagcaggcctaacgtgccgtcgctgacgccggtattgtatttggcgaagggcaccagcgccgcccaggccgcggtggcaaagccggccataaagaagacaatgcgcgttgcccgttgctcgtttctgccgggcagtgcgcgcgacgcaccgccggtagcgggtaattccagggctgcgtttttattgctcatagacatcctgtaaaaccatcagctgttaagaattttcagcgcttcgtcatgcagacgcgggcagccggacgccagaatgcggccaccggcttccgggcgatcgcccgacagcgtggttactacgccgcccgcctgttcgacgatcggaacgaaggccacaatatcgtaaggttgcagggcatattccagacaaaggtcgatttgcccggctgccagcatcgccatcgcatagcactcaccgccgtagcgggtcatcagggtcgcgctgtgcagcgccgcaaagttgacgtccgggctgtgggcaatcggctccggagaggtggtatgcaaaatcgcctggttaagcgacagtcctttgcgggtggtcatgacaccgctgccctgcggaccgctgcgccaggcctgtttcccgtccgcccagaagcgttcgccggtaaagggctggcccatcatgcccagctgaccgcgaccttccaccgtcaggccgatcagcgtgccccacaccggcagaccgcacagaaaggggcgggtaccgtccaccggatccagcacccattgcagcgggccgtcgccggtggtcccaaactcttcgcccatgatggaatgggaagggtagcgttcgttgataatggcgcgcatcacccgctcggcttcgcgatcggcatcggttaccggatcaaaacgaaagccctctttgggtttggagccgacatgcagatttaagccggaacgaaaacgcggcagcgtctcgttatcggcggcatcggcgagttcatggaggaaagcgacatcgggcagggaatagttcatgtttcgatccttttaagcgtgaacaacggcagggcgcagaaaatctttctgcttggttgtgctcgattatgcgcgatcgtgtgcaagagtacaaatggctctgcgtattatttttgttcagccggcgaggatcacgtccagttttttactgcgcagcgctttcagcgcctgttcgctcacggcgtcatcgatcaccagcgtcgtgatctcttcgctggtggcgacctgataacgggcaagagtggcgattttatcggcggtcagggtgacgatgatgtcgctgctgcgcgtcaccagacattttttgaattcggcatcgtcatactcaaacaccgtcacgccttcgtccgcgtcaaaagcgcaggcgccaagcagacactgatcgaaaaacattttttcaatgtggcgcagggtatcaataccggtcgcgccgcccgtctctttattgatccgcccgccggggaagatgatttccaccgcctcgtgatgcatcagttcagcggcgattaacggggaattggtgacggcggtaaggataataccgggaggcaactggcgggcgatggcgagatttgtcgtcccggcatcaaaaaaaacgcagctttcgggtttgatcagcgataccgcgcggcgggcgagctgttcttttttatcgctgttaaggttttcgcgcttcagaaaattaccggaagggggaagcacgctgaccgcgccgccataaacacgcttgcacaggccaagattcgccagctctttaaggtcgcggcgaatagtgtgttcggagacgttaagctcaggcgcgagctgggcgcacacgactttgccgttaagggctaaaagctgctttattttttcctgacgctgctcgggaaattcggcgtaatcaaacatagtggcccactgaaatcatcacaggtacgcataagcgagcatgatgggataaagcggtcagggagtcaaacaggaagaaaagggagagtattgctgaatggtgcgtccgagtggactcgaaccaccgacccccaccatgtcaaggtggtgctctaaccaactgagctacggacgcactgtacagaaagaatggtgcgttcaattggactcgaaccaacgacccccaccatgtcaaggtggtgctctaaccaactgagctatgaacgcattgttgtgctgacaacggggacgaatattagcggcagggcgcggccgtggcaagcggaaaaaagcaattttcattctgatttcacgcgattgcggaacaactgcgcaaaatgttgagaaagtagccgcccgcaggcggctacactgtacttaacgcgccgcgcgggcgaggatcacccctgaaggctgacgttgcaggtaacgcatgcgcagcatcatcaggatggctgccgaggtcaggccgatgataaagcccatccagaaaccggcaggacccatgcgatccaccaccagatcggtcagcgccagcacatagccgctcggcaatccgagcacccagtaggcggtaaaggtaataaagaagatggagcgcgtatctttatagccacgcagaataccgctgccgactacctggatggaatcggaaagctgatacaccgccgccatcagcattaactgcgaggccagatgcaccacttccggattgtcgttatacagcagggcaatatcttcccgcagcgcgacggtgaagatcgcggtgacgaccgccatgcagacgcctaccgccagcccggttcgcgcggcggtttgcgcatccagcgtcgagccctggcccaggcgatagcccacgcgaatggtgaccgctgccgccagcgacatcggcaggacgaacatcagcgagctgaagttaagggcgatctggtgcccggctacatcgacaatgccaaggggcgacaccagcagcgccaccacggcgaacagcgtcacctcaaagaacagcgcgagggcgatgggcagccccagttgcgccaggcgcagcagcacggcgggatccggtttgccaaaacgcatatcgttacggatgtcgcgcatggagcgcgcgcgcttaatgtaggagaccatgcagacgaacatcatccagtacaccgttgccgtcgccacgccgcagccgacgccgcccatctcaggcataccgaaatgaccataaatcagcacatagttgatggggatattcaccagcaggccgagaaaaccaaacaccatgccgggcttggttttcgccagcccttcacactggttacgcgccacctggaagaacagatagccaggcgcgccccacagcagggcgcgcagatagcgcaccgctttgtccgccagttcgggatcgatattgtgcatcgcatgaatgatatgacccgcgttccacagcacgatcatgatcagcaccgacacgccgcccgccagccagaaaccctggcgtacctggtgggcaatacggtcgcggcggccggagccgttcagttgcgcaaccgtcggcgtcagcgccagcagcagcccgtgaccaaaaagaatggcgggcagccagatagaggtaccaatagccaccgccgccatgtcggtggcgctgtagccgcccgccatcacggtatcgacgaaacccatcgcggtctgggcgatttgcgcaatgatcaccgggatcgccagtgctaataactgacgcgcttcaagaaagtacttctgcacgtgaacacctgttgaattgtagttatatgaaaaactgaatagccgccgttactggcagcaaaagatttgcaggagaaataaccagtacattgtagcggggaactgcgattaatccagagaaaaaacagcgtaataagtcccgagactggcaacctcatttttcacctgttattgtgctggtataaacacggttaaccgaattaatgatacaggagcaccaggcatgtttaccggtattgtacagggcacggcaaaagtggtgtccattgatgagaaacccaatttccgcacgcacgtcgtggagttgccagacaccatgctggatggcctggagacgggcgcgtccgtggcgcacaacggttgctgcctgaccgtaacggaaattaacggcaatcatatcagtttcgacttaatgaaagagacgctgcgtattaccaatctcggagaattaatccccggtgattatgtaaatgtcgagcgtgcagcgaaattcagcgatgaaattggcgggcatttaatgtcggggcatattatcactaccgcggaagtggttaagatcctggcgtcagaaaataatcgtcagatctggtttaaagtccaggatccgacgctgatgaagtatattctttataaaggatttatcggtattgacggtattagcctgacggtaggcgaggtgacgccgacgcgcttttgcgtgcacctgatcccggaaacgctggagcgcaccacgctcagcagcaaaaaactgggcagccgcgtcaatatcgaaatcgatccccagacccaggcggtggtggacaccgtcgaacgcgtgatggcggcccgggtggtggtggtcgagcgcgacgagtaaatcccacaaaaaaccccggcaagccggggttttttatcaacgcgccacgcgcaggccgttttccacgccccggctgaacaccacctgccagagctgaatatcccgcgcgcggaacgcccccgcacaggcattgagatagtagctgaacatccttctgaaacggtctgaataattgccggcaatctccggccaggcggcctgaaaacggctatgccaggccatcagcgttttatcataatccgaaccgaagttatgccagtcttccatcacaaaatgcggctcgctggcggtggcgatctgccgcaccgacggcagacagccgttagggaagatgtacttattgatccagggatcgacgtggtggtcggttttattcgagccgatagtgtgcagtaaaaacaggccgtcaggtttcagattgcgatcgacaacctcaaaataggtggcgtagtttttaggaccaacgtgttcgaacatgccgacagagacgatgcggtcaaactgctcgttaagatcgcgataatcctggagcaaaatagtcacatcgagatcctgacagcgttcctgcgccattttttgctgttccgcagaaatcgtcacgcccaccacgctgacgtcataatgctgcgccatgtactgcgcaagcccaccccagccacagccgatgtcgagcacacgcattccgggctggagctgtaacttttcgcaaatcagttttagcttggcaagctgggcgtctgccagcgtcgtggcatccttccagtaggcgcaagagtattgcatttgcggatccagcatgcggctgaacagatcattacccaaatcgtaatgctctttgccgacgatccatgcccggcgcttgctctgcaaattaaataatctggcgcccgctatacgcagcgtatctttgagatggtgcggtagctggttttcaagaccggcgcgcagaacgttgttgaagaaaatgtccagccgctcgcaatcccaccagccgtccatataactttcacccagccccagcgatccttcctgcagcacgcgtttaaaaaaatgaggatttttgacctgaatatctaccggggacgaaccgttgattgtgatccccgcccggccaagcagttcgcttacgatacgaaaccagtcatcatcccgtatgttaacgtcttctatgcacgatgaactcatagcttctccatcacctgtatgtgatcagaaccttcaaacagcgtagtcgctttttagggtttgtgagaaatctcacggaatggtccgcgagccagaaatccgacgtagaacagaggaagggagattacccttgccgtaaaggccgtccgtggtgagagaggcgtcatcctgcgcctgttactgcataatatttatcgtaattatatgtgccggaaatgagtataggcctcagatccggcagatacaatagtaaattcttagcaacctaatcactgatttgtaacatagttgcacggtgaactatgcagaggcggtttcagcattcgcgtctgttacaccatgacgctgcatccggtaaccggcagcggccagtaacacggtgatcagcattacgctggtggtggtcaacagcggcgtgccgataagcgcggacactaccagactggcaaggaaacagagccccagttgcagggtattttgcaacgccgccgcgcgtccggtcgcctgcgggaacgggcgcagcgcctgggccaccacaatgggatagatggcgccgttcgccattgccatcacgcagaagggcaccagcagcgccgtgagagattgacccgccaccagcccggctatccaggtacccgccacgctcagaccgtagaacaccagcagccacggcagtaactttttaccctgccacttttgcagcgccgcgcggcatccatagccgccgatcagaaaggcgatggtttgcggtacatagctcaggccaatggccgccgggccgtagcccatttcgctgaggataaagggcgagccggtcagccaggcgaagaagctggcggagcaggcggcgtagatcagcacgttaccgcggtaatcccgggaacggagcagggtggcaaaggtcagcggcacgtcgctgctggtggttttttttaccaccggcttcaggcgcagcgcgggcagcatcagcaccagcgtaatgacaaacagcgtcataaaaatcatttgccaggaaaaatgcgcgaggatccagctgcccagcagcggcgcaagggccggagagagacccaccagcggcataatggtggcgaagatacgattagtgcggtgcgccggatagtgatccgtcaccagcgcctgccaggtgacggcggcagcgcagacgccgatcgcctggataaaacgcagcaccagcagccaggtggcgtcgcgcacccacagcatgcccagacagccgacggcaaagagcgccagaccgcttaacagcaccgggcggcgaccataagtatcggacagcggaccccacgccagttgcgcaaccgcaaatccggctaaaaacagactcaggctggcgctgacggcagccgccggggtttgtagatcattctgaataacggcgaaggcgggtaaatacatatctgtagccagaaagcccagtacgcttaaccccgccagccagactaaaaatccttttccaggtttcatgtcacgttctcttgttttggcaggtgagcagagcggcagagtgtagggagtgcaatgacggttgtgaaacgctaatatttgcacattgcattcaaaaaatttgcaggcagaacatgtggtcagaatattcactggaagtggttgatgcggtggcacgaaccggcagcttcagcgccgcggcgcaggaactccaccgggtcccatcggcggttagctatacggtgcggcaactggaagagtggctggcggtgccgctgtttgagcgccgtcaccgtgacgtggtgcttaccccggccgggcgctggtttttaaaggaagggcgatctgttatcaaaaaaatgcagatcacccgtcagcagtgtcagcagatcgccaacggctggcgggggcagttatccatcgcggtggacaatatcgttaagcccgaacgtagcaggcaaatgatcgtcgatttctaccgccactttcaggatgtggagctgatcgtctttcaggaagtattcaacggcgtgtgggacgcgctggcggatggccgcgtggaactggcgattggggcgacccaggcggtgccggtgggcgggcgctacgccttccgggatatggggaaattgagctggaagtgcgtggtatcccgtgaacacccgctggcggcgatggacgggccgctgagcgatgacaccttgcgcaactggccgtcgctggtgcgcgaagacacctcccgctcgctgccgaagcgtatcacctggctgctggataaccagcggcgcatcgtcgcgcccgactgggaatcctcggcggcctgtctgtcggcgggattgtgtatcggcatggtaccggcgcattttgccaggccctggcttgatcgcggagagtgggtggcgctgccgcttgaaaaccccttcccggacgccgcctgttgcctgacgtggcagcaaaaggacaattcgcccgccttaagctggctgctcgattatttaggagacagcgagacgctgaataaagagtggttgcgggagccagagtgactggctcccggcaggcttaacggcggtagtcgcggaacgggccgtcggcgaccgagcggcgttcgatgagacgcgggtgcacctcaatggactgcgactcttcacgcttgctgacgatcctgtccatcagcatattgaaggccgtttcgcccagcgaatctttcggctggtgaatggtggtcagcgccggagtgaagaaacgcgcgttgcgcacgttgtcataaccaatcagcgacacgtcctgcggcacgcgcagacccatttcatcagccccgcagagcgcgcccatcgccatcacgtcgccgccgcagaagactgcggtcggacgatgcggctgggagaggatctgctgcatggcgcggtagccggattccggctcaaagtcgccctgcacgatccagttttccggcaccttaatcagcgcttcttccatcgctttcataaagcccgccagacggcccgcgccggtgttacgctcaagcgggcccggaatgacgccgatttcacggtggccacgttcgatcagataacggcccgccatatagccgccttcaaaagcgttatcgatcaccgaatcggtaaagtccgctttcgcttcgccccagtccatcaccaccatcgggatatgacggtactcttcaagcatgcgcaacagcgggtccgggtattcagaacacatcaccatcaggccgtcgacgcgcttttgcgccatcatcgacagataagcgcgctgcttttccaggttgttccaggcgttgccgaggatcagggtatagcccttctggaagcagtttttctcaacagcttcaatgatttcggcgaagtagggcgcttcgctgctggtcgccagcaagccaatcgacttggtatggttaaccttcagactgcgcgccaccgcgcttggggaataatgcagctctttgatggctgcccacaccgcgttgcgcgtttcttccgcaacaaaacgggttttgttaataacatgtgatacggttgtagtggaaacgtttgcgcgtttcgctacatctttaattgttgccattagatctcactccagaccatatcttaaactcctgatacttctacaggtaaacgtttgccttaaaaaacccttcgcacaacattttcaggttgcgatacgccgggaaaacaacacaggacgtcaggaggggtcagtggccggtacacgaataaatttagcgtggaattctggctgatcttgatgaaaaggggaagtctaaaaatggttatcaatctaaaacagagaagatttttgcgtttaactgtgcaaaaatgagcaatctcactttttgtgggggttaacaaaggagaaaaaatgatggatagcaatctgaagtattcgctgtttactaccgtaatcgtgctcagcctgatcgttgctggcgcaatgactgccgcttttaattgatccagagcagggagagcgctctccctctctttttcattcccgccgattgttatcaaatttgcaataatcttttgtcacttcattaacttctgtttttttgtgattaatgtcatgcttttgacttcaccgcggggcgctctgtacgccatcgcattactggagtcatgtaataatgaagataaattttcccctgctgtcactggcaatcggggcttttgggataggtacaactgaattttcacccatgggattgctgccggtaatcgcccgtggcgttgacgtctcgatccctgccgccggcatgctgatcagcgcctatgcgatcggcgtgatggtgggcgcccccctgatgacgctgctgctgtcgcatcgcgcccgtcgtaacgcgctgatcttcctgatggcgattttcaccctcggtaatgtactgtcggccattgcgccggattacaccacgctgctgttatcgcgcattatcaccagtcttaaccacggcgccttctttggcctgggttcagtggtggccgcaagcgtggtaccgaaacataaacaggccagcgccgtggcgaccatgtttatgggactgaccatcgccaatatcggcggcgttccagcggccacctggcttggggaaaccatcggctggcggatgtccttcctcgccaccgcaggtcttggcgtggtgtcgatgttaagcctgttcttctccctgccgaagggcagcgcgggcgtgcgtccgaatgtgcgccaggagctggcggtgctgatgcgcccgcaggttttatcggcgctgctgaccaccgtgctgggcgccggggcgatgttcaccctttatacctatatctcgccggtgttgcaggagctgaatcacgccacgccattctttgtcaccgcaatgctggtgctgatcggcgtgggcttctcgctgggcaattacctgggcggcaagtttgccgatcgttccgtcagcggcacgctgaaaggctttctgttgctgctgatggtgatcatgctggcgatcccgctgctggtgaaaagcgatatcggcgcggccgtggcgatggtagtgtggggcgccgcaacgttcgcggtggtgccgccattgcagatgcgcgtaatgcgtgtcgctcatgaagcgccggggctgtcttcgtccgtgaatatcggcgcttttaacctcggcaatgcgctgggcgcggcggcaggcggcgcggtgatctccgcaggattaggctacgccgttgtgccggtgatgggcgctgttattgcggcgctggcgttgctgctggtgctgttttccgggcgcgccgatgcccgccgggaatgcgtggcgaactgatcgttactgagtaaaaaagaaaaacaccctgccagtccggcagggtgttttttttagcggacgtttttcggcgtcatcacccggcgcgcgcccacataatgacgctgccagtaatcttcgctaagggaagtgatttgaatatcctgaccactgcgcggcgactggatgaatttgccattgccaacgtagacgcccacgtgatcggcggtgccgcgaccctgcgtgcggaagaacaccagatcgccccgttccagctcgcccgggttgaccggcgaggcatcacgcaggtgatacatttcattggcggtgcgcgggatgcggaacttcaccagatctttataggcgtaatacaccagcccgctgcaatcaaagccggtacgcggcgaggtgccgccccagtgatagggtttgccgatctgattcattaatgtcgataacgccgccgtctgggcctttttaatgcgcactttatgcgcgtctgccagggtaaccggcttgctgcttttcactttcacgcagtgctgcttgcggcctttgcgggtggtgcacttttccgtaaaggtaacggcggcaattttccccgggctggatttgcttttgcgtgaggcgaggctgctggttttagtaccggatgagacgcgttttgttctgctggaggttttttgactggcggaactgctggatgcttttttagctatttttttactgttgccactgcttttctttgttgtcttttgggtcgtgctttgcttcttacggtcgctggttttcgccagatgcgttttttgcacggcagagggccgtgcctgttcagacgcctggcttaatggcgcaaacgtcagcgaagcaaaaaccaaagcacagagcgtgatcgagactttatttatccgcgccactgagcaatcccctgattcgggcaggcatgaaatcatgcgtgcgtgtgattttcaaaactcgtcgattctaaagcataaaatgctaaaaaggtaagagcctttttgcatccttgcgctgtttcgttaacaagcgcaaaaaaaagcagcaattcagggaaggaaacggttaaggcatgagcgaatcgtttcgcgcaaactgatattcttaaggcatctttatccgacagacgataatataacgcgtggtgaacaaaatgttattttccgtgggttgtctgaaccgctacaataagacgactgtcgtagaagaagttaaggaagcaagacaatgagcgagaccatcgaaaaaatccagcgtcaaatcgctgaaaacccgatcctgctgtacatgaaaggttcccctaagctgccaagctgcggcttctctgcccaggcagttcaggcgctttccgcctgtggcgaacgctttgcttatgttgatattctgcagaacccggacatccgcgccgagctgccgaaatacgccaactggccgaccttcccgcagctgtgggtggatggcgagctggtaggcggctgcgacatcatcattgagatgtaccagcgcggagaacttcagccgctgatcaaagaaaccgccgcgaagtacaaaaccgaagagccgggggctgaataagcgcaggcaataaaaaagcaccctcgggtgcttttttttatggctgattttcgtcgccaggcatcgccatcggccagccgcccagccgcttccagcggttaacgatctcgcagaacagcagggcggtttgctcagtatcataaagggcagagtgggcctgggtgctgtcgaaatccagaccggcggcggcgcaggctttggaaagtaccgtctgtcccagcgccagaccgctcagtgaggcggtgtcaaaggtcacaaacggatggaaagggttgcgtttcagcgaggcgcgcgcggcggcggccatcataaagctgtgatcgaaggtcgcattgtgggccaccatgatcgcgcggctacagccgctgtctttaatgcctttgcgcaccattttgaaaatcgcatgcagcgcatcgtgctcactgatcgccccgcgcagcgggttagcaggatcgataccgttgaacgccagcgcttcaggttgcagatttgctccttcgaacggctcaacgtgaaagtgcagcgtgctgtccggcatcagccagccctcatcgtccatttttaaggtaatggcggcaacttcgagcagcgcatcggttttggcgttaaacccggcggtttccacatcaataacaacagggtaaaaaccacgaaatcggccgcacagaccggtgagttgagcgttatcggacatcaggatctcttaagacggaaaattgcagcgcgcattatggcaaattttacgcaaggattataccgcgcagaaagaacgggcgcggcgcgcccgtgggggatcagttgcccagaccgcgaccggcgtctttggcttcgatcagttcgattttataaccgtccggatcttcaacgaaggcgataaccgtggtgccgcctttaaccgggccagcttcacgggtaacattgccgccattctgacggatacgttcgcaggcttcagccgcgttatccacttccagcgcgatatgaccgtaagcggtgcccagctcatagctgtcgacgccccagttgtaggtcagttcgataaccgcttcgtcgctttccgggccgtagcccacaaatgccagcgagtatttgtattcggtattttcactggtacgcagcagcgtcatgcccagcacgttggtgtagaagtcgatggagcgttgcagatcgccaacacgcagcatggtgtgaagtaagcgcataatatcctcttaatcagttgttttgcgttccggtcgtaaagctttatgcagtatagcggcggagtgtcgccgctatcaatcaacggatcacagagtagggtagtcggtgtaaccttccgcgccgccgccgtagaagctttccgggcgctgcgggttcagttccgctttgcgttccaggcgctcaaccagatccgggttggcgatatagtcacgaccaaaggccaccgcatcgataagccctttgccgatcagatcttcggctttctccggcgtgtaagccccggcgccgataatcgggccgtggaaacgggcgcgcattttttcacggaaggcttcggtataaggcgcgccgcccgcccagtccggctcagacatgtgcaggtaagcgatgccgcgacgggccagctcttcgatcagatacagcgcatcggcttcttcgttcgggccattgtcggtgttctggaaggtaccgattggcgagacgcgaataccaatgcggtctgcgccccactcgttacagaccgcatccaccacttccagcaccagacgggcgcggttttccacgctgccgccgtactcatcggtacgctggttagcggaaggggacaggaactggtgcagcaggtaaccgtgggcggcatgcagttcgaccagatcaaaaccggcttcgcgggcgttggcgacagcctggcggaaatcgttcacgatgcccggaatttcatcgatttccagcgcgcgcggcacggaggtttcttcgcggatggcgttgccattggcatcacgcagggaagtacgggtacccgctgcgatggcagagggcgcgaccggcgcctgaccgcccggttgcaggctggtgtgggagatacgaccggtgtgccacagctgtacggccatatggccattttcagcgtgcacgccagcggtgatttttttccatgcggcaatctgctccgggctgtgcagccccggcgcgcccgcatagccttttgcctgggcggaaatctgcgtcgcttcgctgatgataagaccggcgctggcgcgctggcggtaatattcgcccatcagcggggtcggaatgtcacctggctcaatgctgcgcaggcgcgtcaacggagccataaatacacggttcggtacggtaatggcacccactttcaacggggtaaataacgacttagacataactgctcctgaatagaccggtcgactagtaaaagtagaaataaaaacgcctgttattgtgcaggcgctgcgataacaaatcgggcatgcgccagcgcgctttccagcggcacggcgctgcgtgacatcttggcctgcagattcgcccccagccacagggaatagagcacctgagcctgcgtctgcgcatcgccgggaaaatcgaggctgcgctcaccacggcctttttccagcgcatccgcaatcagagcgatcacctgggttgcgccattattcatggcggtgcgcatatcctctgacagatcgcacacttctgcagacagcttcaccgtcagacaaccgctgataatgccctgctgacgaaactgctccagcgtatattcataataggccagcacgcggtcacggtaattaccttcactgctggcaaaatgctgcgccagccgcgcatggtaatttgcgtaatgacgctccagcagcgcgacgccgaaggcttctttcgagcggaaatagtgataaaacgaacccttgggcacttccgccgttttcagcagttcgcttaatcccatgccggtgaagccacggtgcatacataactgctcgccggtggccagcagatgttcgcgggtatcatgttcagtgtgtctgttcatgacgtcactgtaatagaccgttcggtctaatgcaagacgatttgcgaaatgctccggtggcgtcttcaatgtaataaaccctaaaccggaggccgggcgtggcagagcaacttgagtttttcccgatccagagtccgtgtcggggcatttgtcagacggacgagcgcgggttttgccgcggctgtatgcgaacgcgggaagaacgttttaactggcaaaacatgagcgatacgcaaaagcagacggtgttgcgcctgtgccgccagcgtctgctgcgtaaattacgcgcaaacaaaccggatgcgccggaggaaccgcaacaaccttcacttttttaatcgtgcatatgcgtatactcagagcacattaattaaagaggaagcggttatggttcagcgtattacccttgcgccgcaaggcccggaattttcacgtttcgtaatgggctactggcgtctgatggactggaatatgtctgcgcgccagctggtgagcttcattgaagaacatctggatctgggcgtgaccactgtcgatcacgccgatatttatggcggttatcagtgcgaagcggcctttggtgaagccttaaagctggccccgcatctgcgcgcccgcatggaagtggtgtccaagtgcggcatcgccaccaccgcccgcgcggaaaatgcgctcggtcattacatcaccgataaaagtcatatcatcgccagcgccgaacagtcgctgcgcaatctggctgtcgatcatcttgatttgctgctgatccaccgacctgatccattgatggatgcggatgacgtggcggaagccttcctgcatctgcaccagagcggcaaagtgcgtcatttcggcgtgtcaaactttaccccggcgcagttcgcgctgttgcagtcccgtctgccgtttaccctcgccaccaaccaggttgaaatttcaccggtgcatcagccgctgatccttgacggcaccctcgaccagctccagcaactgcgcgtgcgtccgatggcgtggtcctgcctcggcggcggtcgtctgtttaatgacgacgctttccagccgctgcgggatgaactggcgcagatcgcccaggaagtgaatgccgccagcattgagcaggtggtctatgcgtgggttctgcgtctgccgtcacagccgctgccgattatcggctccggtaaaattgagcgcgtacgggcggctattgaggccgaaaacatccagctcagccgccagcagtggttccgtatccgtaaagcggcgctgggctacgacgttccctgatcacggaataacctgactttccagtgagatccttacccctggtttacacttcaggggtaaatctgatcaagggaggttatatgaagcgtttttgtctcgcgatgctggctctgtccgtctgcgcaggcgcgcaggctgccagccaggaagttacgatgaacctcgtcacctccgggggcatcggtcagtccattggtacagttaaaatcagtgaaaccgataaagggctggaatttgcccccaatcttaaagccctgccgcccggcgagcacggtttccatgtgcatgccaaaggctcctgcgaaccggccataaaagacggtaaagcagtggcggcagaagccgcaggcggccacctcgatccgcacgataccggcaagcatgaaggcccggaaggtaaagggcataccggcgatctgccggtgctggtggtcaacaatgacggcaaggccaccgacgcggtggtggcgccacggctgaaaaaacttgatgaagtgaaagacaaagcgctgatgatccacgttggcggcgataatatgtccgactcgccggagcccctgggcggtggcggagcccgttacgcctgtggtgtcatcaagtaatctctgaaggtaccacgcctgctgccggggcctgttcaagttgcaggagcgcgcaatagagccgccagacaatggaggccagttcccgcgcagcaggctggtgatgccgggccagcgtatcgcagatgcgctgtagctcctccagcgttatccccagcgaaacatgccgcacgcctttttcactcatcacgtcacgcagcagcgcaagacagcgatcccgcacccgcgatagcggatcggagcgggtttcccagtcgcgcagctgccacaccacatgcgtacagttaagcagcaccacgccccagcgcaacagccagcgcctggactgcgcgtctttactctggctgagctggctgacgtgatgataaaccagcgactcgaactcactttcgcggtagtgcggccgacggcttagctgatcgataaaccgcaggcgcagggcgcgaatatgacgatggcttttacgggcgtccgatccgggacgcagcaccgcgaatgccagccacgccatgcccacgccgagtaatttccccagatcgtcattcagaaaatccgcgaagtcatacaccggtggattagtgacggaaataaacgatcccataaagacaatcaattgcccccacagaccggcgtatttcgccatttgcagcttcagcagttgcatggtggtcagcagcggaaacagaaaaagtaaaaactgccaaagctccgaaatttgcaccatcaggccaaacttcaccgcaaagctgaacagcgacagtaaaagcagcgtgcgcatcagcagcgtcagggagctgaaaggcgaggcaacggcggaatagagcacgcagctgatggccgccagcgtcagcgccgaggcgcccgcctcccactgcgcgccgatagcccatgcaccaatcgccaccagggtggcaaaggtgcgcagcccgctccagacggcttccagattatcggtatgacgggccagcgctggcgcacgcggcacggtgaaagcggtgacggggcgggcatgttccagccgctggatccagcgactgctggctaagtgcaagcggcaaaaatagcgcagcctgtcccagaaggcgcggtggcggtaatcggcatcatcccgcggcgcaagcggggcgataatgcgcgccacggcataaaaatccgcatccggacgcccgagggcggcgagcagctgttccagcactggacgggtggcggccggcgcgtcgggccagttcagcagcagacgccgcaggcttgagatcacgctggtcatgcgtagctgttgatgcagtaaatagttgagcagggcgttttgctggcgaaagcggtagtggctccagaacgcctgaatgcgcagcaggttgagggtgaggatctggccgatgacattttcatgggcggcgcgaatggcgtcgctggtgtccggctgccagattaaggcggcgtgttccagcaggcgggcttgcctgtttttcagcgcgctgagcagcgccgtgccatccggggcgctcggcaggatcatcatcatcatgccccccgacaggatccccacgatcacctcgcagacccgcgactgggcgatgtcccacagctcgccggtttcgctgatatttatcaccggaaaggcgatgatcgccgcggtataacccgccagctgaaaggcataggccacgttattgctgtagtgcgcgcaggcccaggtgcagtagccgatccagcccgccatggcgaataaaaacagccagggatcgttaagggtatgaccggcgatcagcagcgcggccacggccccgagcaggcttccggcgatgcggccaaggcttttgctgatcaccccgccgacggtaggaaagctgacgaccgccgcagaggtcatcgcccagtaaggttcgtcgagattaagcgtataggcgacgctgagcgccagacacatggcgataccattgcgcaggccatagcgccattgcgcacgggtggccttaaaccacggcagcgcctgaagcagccgcaccgtcagcgtccgattgccacggtacaggtggtgccggacaccagcgtcaggccctgcggcggcgcatcgaattcaatgcgcaccggcacccgctgggccagtcgtacccagggcacgttcggtttcacatcggccaccagaccgctgtcgctctccacgctctgatcgtagatggcgcgaccaatactggatacgtgaccctgtaacttttgatcgctgctgtagagcaccacgctggcgggcattccctcgcggatatggcgaagtttggtctcttcgaaatagccgatgacataaaacgagtggctgtccactaccgcgaataccggctgtccggcggtggcgtaattacccacgcgggcggaaagattggtcacccagccgtcaaccggcgaggtgaccgtcgtttgctgttgctgccattgcgcctgcgcaagctcggcctgcgccgccgcgacgtcagcctgcatggctttgacattgatattggcggtatccagatcttcggcggaaatatagttatgaggcagatgtcggcggcggctggcttcgttattggcttttgccagttccgtctgcgcgcgggccagttgcgcttcggcgtttaaaatggcgatgcggtagggcgtgtcgtcgatgcggaacagcacttcgccggcatgcacaaactgattatcccgcaccttcagcgtcgtgatgctgccggacacctgcggtgtaacgctgacctgttcggcgcggatcttgccgtcccgcgtccagggcgactgcatgtaataattccacagccagatcccggcagtgatggcgagggcaagcaccagcagcgtggagaagtattttaaggttttcataacgacgtccacgcaatcaacagagcctgagccagcgccactgaaatcacaaataaagagagatccatcagcagcggatgccagatatcaccggcatagatccagccgcgcagcaggcgatgggcgattagccagagaaagaaaccaagcgcgacggcataaaacaacggcgggaaataaacggatgcgccgacaatcagatcctggaggggcaggccagaggtgatgaatctgagcgtcacgggcagggatcctgtgcaaagtgaagggggtaaacccgggttatacaaaaaagtaacaatagcgtctggttaacaagcttttaaaaacaacactataggaaaatacgctaaagctttacatttgttttaccaatataaatgctgcacactattctaaaatcagtataataacttagcaagctaattataaggagatgaaattggaatcgccattaggttctgatctggcacgtttagtgcgcatctggcgtgctttaattgaccatcgcctcaaacctctggaattaacgcagactcactgggtaacgctgcataatattcaccagttacctcccgagcagtcgcaaattcaactggcaaaagcgatcggcattgaacagccttcgctggtgcgtacgctggatcagctggaagacaaagggcttatatcccgtcagacctgcgccagtgaccgtcgtgcaaaacgtatcaagctcacagagaaagccactcccattatagatgaaatggaaacggtgatcagaaagactcgcggtgaaatactgtcggggatttcggaagaagaattgacgcagcttatcagtcttatcgcccggcttgagcaaaatattattgaattacatacgcgtgattaatgataaaagccctgcatagcagggcttttttattacctggccgcgtatgaattaacgcggagacgccgttacctggccgccgttggttgccagagcgacacgctggcctggcgagaagcgggaattaccctgtttctgcaccacgataatgctgttgccgtcgtctttacggatttccagctctacgccctgggttttgttcatggaaccctgcacgccctgtcccgccacgccaccagcgaccgcgcccgccgccgtagccagtgaacgacctgtgccgccgccgacggtgttacccaggaaaccacccagcaccgcgccgcctaacgcgccgataacgttagaatcatcgccgccctggatctgcaccggacgtacgtttaccacggtaccgtaggtcacactctgtacctgcttggcttcggatgccgtataaacgtctcctgaaaggctatcgttgttcacgcaacctgcaagagtgaaaccaatcagcgaaacggccattacacgtaacatcatttatgaatctcctgtccaacaagaaacgctcaggtgagcatccgtataactaaattatatggcatttagccattgaggacacaacttctgccagctcgcggtaaatattgtacctttggcccgcttaacttcgtctaaacgaaacaagtgtaacgtcaaatgtcccctgacgataacgcctatacacaaaaagacataagacttcatggtattagcggtcactttatggtggagtgttatgtctgttaacttttatccgcacgcaaacaggaaggcgtatgaaatcaggtcgctacattggcgttatgtcgggaaccagcctggacggggtggacgtggtccttgcggccattgatgaccggatggtggcgcagcaggcgagcctgacctggcccattcccgttccgcttaaggaggcgatcctgaacatctgccaggggcagcagcttacgctgtcgcagttcgggcagctggatacgcagctcggcaaactctttgcagaggcggtgcaggcactgatggtccaggagcagctgcgcccggaagatgtggtggcgattggctgtcacggacaaaccgtgtggcacgagccgcaaggggaagcgccgcatacgctgcaaatcggcgacaacaatcaaatcgtcgcccgtaccggcgtgaccgtggtgggcgattttcgccgccgggatatggcgctgggcgggcagggcgcgccgctggtgcccgcctttcatcacgcgttgctcgcgcatcccacagaacgccgcatggtgctgaacattggtggcatcgccaatctctcgttgctgtttccggggcagccggtgcgcggttacgacaccgggccgggcaatatgctgatggatgcctggatctggcggcaaaaaggtaagccctatgataaagacgcacagtgggccagcacaggcaatgtgatcctgccattgctgcaaaatatgcaacgcgatgcctatttttccgcccccgcgccgaaaagcaccgggcgggagtatttcaactacggctggctggaacgccacctggcgcatttcccgggcgtggcgggcgctgatgtgcaggccacgctggtcgagctgacggcgatcaccattgccgaacaggtacaactgagcggtggcgcagagcggctgctggtgtgcggcggcggtggccgtaatccgctgctgatggcgcggctggccgcgctgctgccgggtattgaagtctccaccaccgatgaagcagggatcagtggtgacgacatggaagcgctggccttcgcctggctggcatggcgcaccgtggcgggcttaccgggcaatctgccgtcggtgaccggcgcgtccgccgccagcgtactgggggcgatattcccggcgaatccccgccatccaccccgcacgcgggcataatcagagtttcctgactccgcggcacgcctctggccggtagactggtgcggtaaagcgagagggtgcaaccctctcagaccgggaaagtctatgggacaggtgaatgaaaaaactgttaatcgcatgtgtgccagtgctgctggcaggatgtagtacctataaccagtttgtcgatcgcatgaacaccgatacgctggaatatcagtgtgaagaaaaaccgctgactgtgaagctgaatcatccccgccaggaagtgagttttgtgctggataacaaaccgcttatcctgacgcagggcctgtcggcctccggcgcgcgttacaccgatgggatctacgtgttctggtcgaagggcgacagcgccaccgtgtatcatcgcgatcgcgtggtactggagaactgccagctacaaaacccgcaacgttgagatttccagccgggcggcgcacaatagcgccacccgatcacaacgtagcgaatgccatgtcagaccacgatgaactgcaacatatcgcgcatctgcgccgtgaatacaccaaaggcggtttacgccgcaacgatctccccgctgaaccgatagcgctgtttgagcgctggctgggccaggcctgcgaagcaaaactggccgatcccaccgccatggtggtagccaccgtcgatgaaaacgggcagccttaccagcgcattgtgttgctgaaacactatgacgaaaaaggcttcgtgttttataccaacctcggcagccgcaaggcgcagcatatcgaacgcaatccccgcgtaaacttactttttccctggcatatgcttgagcgtcaggtgatggtcaccggcaaagccgaacgcctgtcgacgctggaagtggtgaagtatttccacagccgcccccgcgacagtcagatcggcgcctgggtttcgcagcagtccacccgcatttccgcccggggcatcctcgaaagcaagtttctggaactgaagcagaaatttcagcagggagaagtgccgctgccgagcttctggggcggtttccgcatcagcatcgagcagatggaattctggcagggcggcgcgcatcgtctgcatgatcgttttttataccagcgggaaaatgacgcctggaaaattgaccgtctcgcgccctgatcgctaaaaatgttgtgttaagcgctggtgctcctgtttccggcgctttattctatgtctcttttcgtaactggcgaaaggccgtgtaccggcagaggtgcagtcgttttaaatggagaatttgatggcaagcagtaacttgattaaacaattgcaagagcggggcctggtcgcccaggtgacggatgaagaggcgttagcctcgctgctggcgcaaggtccgatcgcgctgtattgcggcttcgatcctaccgctgatagcttgcatttggggcatctggttcctttgttatgcctgaaacggttccagcaggccgggcataagccagtcgcgctggtgggcggggcaacgggtctgattggcgatccgagcttcaaagccgccgagcgtaaactcaataccgaagacaccgtgcaggagtgggtggataaaatccgccgccaggttgcgcctttcctcgatttcgactgcggcgacaattccgctatcgcggcgaacaactatgactggttcggcaacatgaacgtgctgaccttcctgcgcgatattggtaaacacttctctgttaaccagatgattaacaaagaagcggtgaaacagcgtctgaaccgcgacgaccagggcatctccttcaccgagttttcctacaacctgttgcagggctacgacttcgcctgtctgaacaaattgcacaatgtctcgctgcaaatcggcggctctgaccagtggggcaacatcacctccggtatcgatctgacgcggcgtatgcatcagaaacaggtattcggtctgaccgttccgctgatcaccaaagctgacggcaccaaattcggtaaaaccgaaggcggcgcggtatggctcgatccgaagaaaaccagtccgtacaaattctaccagttctggatcaacactgccgacgccgatgtctatcgcttcctgaaattcttcacctttatggatctggaagagatcaacgcgctggaagaagaagacaagaacagcggtaaagcgccgcgcgcccagtatgtgctggccgatcaggtgacgcgtctggtgcacggcgaagaagggctggaagcggcaaaacgcatcaccgccagcctgtttaacggcaccctgagcgatctgagcgaagccgatttcgaacagctggcgcaggatggcgtgccgatggtcgagatggaaaaaggcgcggatctgatgcaggcgctggtggattccgggctgcaaccgtcccgcggccaggcgcgtaaaactatcgcctctaatgcggtgaccatcaacggtgaaaaacaggccgatccggaatataccttcaccgacagcgatcgtctgttcgggcgctatacgctgctgcgtcgtggtaagaagaactactgcctggtgtgctggaagtaagtcttaaaggttaaaaagggagtgagaaatcactcccttttttatttgcaggtcgggtaagcgcggcgcgcgcccggcgaaaagttataacccttctgctccctgtgcggcgatcacgctctcacgcgccgccacacgcgccacaaaggcgtcgagatggctcaggctgctcatttccagtttcaccgcccgcgcccagcgcagcacgttatagagatacgcatcggcaatggtgaaatgatcgcctgcaataaattcccgtgacgccagctcgccgtttacgaaggtcagtttcttctccagcaacgcacgcgccactggtttgtactcgtccggcgtatccgggcggaacagcggcgtaaagcctttgtgcagttcggtggcgatatagttcagccactccagcgttttataacgcgacagatcgcccgtcggggccagcagatttttctgcggcgcgctgtccgccagatactgcataatcacgacggattcggtgatcagcgtgccgtcgtccagttgcagcgccggcacctggcctttcgggttaatggcaagataatcgctgccgtcgctgaggcgtttggtcatcagatcgaccgcttccagcgtaaaatccttaccggtttcacgcagaataatatgtggggcaagcgagcaggcgcccggtttatagaacaatttcattgatcactcctgttgttatagaaactcaagtgtacgttaaacctcaaaaaaaaaccgctgacactatgccagcggtttaatttgcgtttcccgaagcgattacgctttcgcgatttccggagcgtcaggttttacatcatcctgcgccatacggttcagtttcggcgccatcagcaccatcagcgcagccatgattgcggtggcgataccaattttcaggaacacgctgccgtagacgttcagggacatcagcggatcggtcaccccttccgggatcgccatcaggttagccacataaccggcgatcaggttagcaccggcggtggtcaggaaccagctacccatgatgaagcccatcagacgttgcggcaccagctgcgccaccattgccagacccagaccggaaatcatcagctcgccgatactctggaaggcgtagctcatgatcagccagttaacggaaacgatacccgcgtcggtagcgaatttagtacccagcggcaggatcaggaaggccgcggagcacagcaccataccaatggcgaacttgtgcggcatcggcaggttgtcgcccatcttgttatagatggccgcaaggattgggctgccaatgatgatccagaacgggttcagcgcctggaactgctccggctcgaaattgatacccagaatggcatgctcaacgttacggatagcgaagaagttcagcgaggtcggcatctggctgtacagcacgaagaacacgatcgcctgcaacatcagaatgaaggcgacgatcattttacgacgtgccgcaccctgcatggagaaggtttctttcgcgaagataacgataatgcccagcgcgacgacgcccagcaccatacgagcgataccctggttatgcaacagccaggtggcgatggtcaccagtacaacgataccgacgatggtcagcagcaggctacccacacgcagcggttcaaagtctggtttagagccatactgtttcacccagcgctggcagaacgcgaagttcaccacggtgatcagcatacccaccacgctcagggcaaaagccacgctccagccgaacttcgcggcaagccacggggtcgccagcatggagaagaaggagccgatatttaccgccatgtaatacatggtgaatgcaccgtccagacgcggatcgtctttcgagtagcaggtggacagcagggaagacgggttcgccttaaacaggccgttacccaccgcaatggtcgccatacccatataaaccaccgccgcgtcgtgaccggaccatgccaccagggcataaccaatcgccagcacaatagcgccgagcataatcacacgcttggtacccagcactttgtctccgagccagccgccgatggcaaccagaccgtacacgagggcgctgaaggaagagaacagcgtaatggaatcagattcggacatacccagttgttttaccaggtagacggccatgatgccttgcagaccgtagaagccgaagcgttcccataattcgatagagaagatcagataaaacgctttcggttgtttgaacgcgttcatacttacgttatctgctggttttttgtttgcagtcgacacatatacctctttttttacaacccatattaacgggggtgttcagtgcgccatgtccagagatcatcgcgcttatagttatagtgggaggggaaaacggcaggtaatgttccctatccggggcttccaggcaatacctttgtaatagtctgttacatataaacagggcgggataaaactcggagcggctaaatgttatttagcgttaaatttcactatggaataaaacatagttttttactctgcgaagggggcggtggtagcgggatatggcgatatattctgccatcgggcgaaaaacttagcgaattagtccagtattacagaattgactggttttatctgttgctggttgaaaaaaagcctctttgatacaaggcgtaactttgccgaaaaatacaatattttaacaaactgaaaaaaatgcatccggcggtgtgggttgtagtaattttttgcgctaaaaaaacattcaggcgcattccgatggaataagcgcctgcggatccgctaagcgcggcgctactcgtagactttttctttatattcgcagagatcttcaatcaggcaggagccgcagcgaggcttgcgggcgatacaggtatagcggccatgcaggatcagccagtgatgacagtccactttaaactcagcgggcaccaccttcagcaggctttcttcaacttgctctacgttcttgccgggcgcgaaacgcgtacgattgcagacccggaaaatatgcgtatccacggcaatggtcggccagccgaaagcggtgttcagcaccacgttcgcggttttacgtccgacgcccggcagtgcttccagcgaggcgcgatcttccggcacttcgccgccgtgcagctcgatcagcatgcggcaggttttgataacgttttccgccttgctgttaaacaggccgatggtcttgatgtacgactttaccccctcgacgcccaactccagcatcgcctgcggcgtattcgccaccgggtagagtctggcggtggctttattgacgctgacatcggtggcctgcgccgacagcaataccgcaatcagcagctcaaagggggagctgaagttaagctcggtggtcggatgcggattgttatcccgcaagcgcgtaaggatttcccttcgtttaacgttgttcattatgccttctctggcgttacgtccggcagcgcgtcggaggttgccaccgccgccgcgcggcgttttttactgcgttcatcaatcaggtatttaaccgccagcatcatgccgaggccaataaaggcgccgggtggcagcatcgccagcaggaaaggggaatcggtgtggaagacttcaatgcgcagcgccttggcccagccacccagcagcgcatccgcgccgtcaaacagggtgccgttaccgaggatttcacgcatcgatcccagcacaaacatcgcgccggttgcgcccatgccgatggcaaagccgtccagcgccgacagcgccgggcctttcttcgccgcaaaagcttctgcccgacccaccacgatacagttggtgacgatcagcggaataaagatccccagcgactggtacaggccaaacgcataggcgttgatcagcatctgcaccacgctcaccacagaggcgataatcatcacgtaaatgggaatacggatctctgacggcgtccagcggcgcaaggcggaaatggacaggttagtcagcgtcagcaccagggtggtggccagccccagtcccagcgcgttggtggcggtagaggtcaccgccagcagcggacacatccccagcagttgcaccagcgcggagttgtttttccacaacccctgaacaataacctctttgacttcgctcatggtttactctccacagcccggtaattggttgagacgggcaggcagcgattgtgcgtagatccccgcccgtttgacggcgttcaccaccgcgcgcggggtgatggttgccccggtaaactgatcgatatcgccgccgtcctttttcactgcccagtgcgcgctgtcctgcggatcgattttgcggcctgcaaaggtcaggatccagtcggaaatgcgcagctcaattttgtcccccagtcccggggtttcatgatgttcggtgacgcgcgccccggtcaccgtaccggaaaaatccgcgccgaccagcagctggatcgcaccggaatagccgtccggcgcggtggcttcaatgacggccgccaccggcgtgtcgtcttttcgggcaatatagacgcgatgctcgcctttgcccagctctggcgcagtaacaaaatagcagctctggctgagatcgttatcataaagcgacgcgggcaccacctgatcgaacagcgctttctgttgcagcgccgcctgatcgtcaatggtcgatttagtcagctggttaatcgcggcggtcatgccggtacagcaggcggcaaagatcgccagcgtcacaccgtgtttttgcatggtctttaacatggtgcgtcctcagcggtgaccgtacacgcgcgggcgcgtgtagtaatcgattaacggaacggtaatattcgccagcagtacggcaaaggccacgccgtcgggatagccgccgaagctgcggatcaaccacaccagcagacccgccagcgcgccaaaaatcagacggcctttattggtggtcgacgcggtcaccggatcggtgagaataaagaacgcgcccagcatggtggccccggagaacagatgcagcgtcggggatgccaggctgtccggcgacagcagccagccaagggtggagcagaaggccagcatggcgataaaactgaccgggatatgccagcggatggttttctgccacagcaggaacaccccgcccgccaggtaagccaggtttacccactgccagcccgcgcctgccagcacgccgctgtaaatcggatagctcaggatctcgtcaactttatgtccggcatgcagggacgttttaaaggtatccagcggcgtcgcctggctgatgccgtcaacgcccatgcgcagggtatccatattgccgccgctggaggtatggccggagaagatcacctggagcgcatccataaagccgggaacggtggcggcaatgtcatgcggcggcagccagctggtcatctgcaccgggaaggagatcaacaacaccacgtagccgaccatcgcagggttaaaggggttatgcccgaggccgccgtaaagttgcttggcgatgatcaccgcgaacaccgtgcccagcaccaccatccaccagggggaaaaagagggaatactgatcgccagcagcaggccggttaacagcgcagaattatccgcaaggatcattttgatgttctgcttgcgtaacttcagcaccagcgcttcggcggccagcgcgctgacgcccgccagtataatttgtatcagcgtaccccagccgaaaaaccagctttgcacggcaatgcccggcagggccgccagcaataccagcatcatgatgcgcgaagtctggcgctggttatgggtatatggggagcttgcgattcgaaaaaccatttaatcctcgttaacggcctgttgtgcggctttcttagcctgaactctggcgatcgccgcagcgacggccgctttacgcggatcgtcattggccgccggagtatcggtgaccggctgctgggctttacgtgctttagcgcgggcaatagccgcttccaccgcggctttgcgcggatcgatgacctcgtccggcgcgggtggaattttcggcggtggcgcttctgccgcctgctgctgcgctttacgggctttggcgcgggcaatagctgcttccaccgccgctttacggggatcaacatcgccaaccggttcagagggcgctgccggctcaggggcttcagcgctctgctgcgctttacgggctttggcgcgggcaatggccgcttctaccgcggctttacgtggatcggcgtccggcgcgttaacggccgccgcctgctgtgctttctctgcctgacgggcgcgcgcttcggctttgcgggcttcgcgggcggcgatgacctcgctgttatccggtacggcgcctgcctgcaccaccaccggctgggtggcgttctgttttttctcgcgcacgcgggcaagcgccgcgtcgatggcagcctgatctttcgccgcaggctgtaccgccgcctgtttgtggcgggcgagacgggcttctttttcacgctcaagacgcgcctgacgcgcttcaaagcgcatcttcgcttccgcggcgcgtttttcttcctgcgcgatggcgtagatttcggctttttcctgacggaaatactgcaccagcggaatattgctcggacacacccaggcacaggcgccgcactcgatgcagtcggaaaggttatgcgcagtggctttgtcgtgttgctggcctttactgaaccagtagagctgctgcggcagcaagtcggcaggacaggcgtccgcacaggcgctgcaacggatacagcctttctcttcctgcggctcgcccatttcagtggcggacggggccagcaggcagttagtgattttcaccaccggcacgtcgagccacggcagggtaaagcccatcagtggaccgcccatgattaccatctgttcgccaccggggcaaaaacctgcggcgtcaagcagatgacggatcggcgtgcccagacgcgcccagacgttgcccggctgttttaccgcttcaccggtcagcgtcaccacgcgttcggtcaggggttcgccatccaccacggcgcgttttaccgcataggcggtgccgacgttctgcatcagcacgccgatatcggacgaacgcccgccgtgcggcacctgtttgccggtgaggatctgcgtcagctgtttcgcgccgcccgacgggtatttggtcgggatgacgcgcagcgtaatgtcgtgcgatcctgccagcaccgcccgcagcatggagatcgcctggggtttgttatcttcaatgccaatcagcacctggcgcggctgcaaaatatgcgcaaggatgcgaatgccttccaccacctgtgccgcgcaatcctgcatcagacggtcatcggcggtgatgtacggctcgcactcggcggcgttaatgatcagcgtgtcgattttatcgctgccgccatgcagtttgttaccggtcgggaagcccgcgccgccaagaccagcgacgcccgcctggtgaatacgctcaatcagcgcctcgcggctgcgggagcggtaatcactccagccgtcgcgctcgatccattgatcctcgccgtcggcgtcaatgagcacgctcagttccgccagtccagacggatgcgccgtggagtggggggcaatggccaccaccacgccggaggttggcgcatgtaccggcagcatacggccgcgcccgcgggtcagcggctgaccgcgcaatacgcgatcgcctgcacgcacgcacagctcaccctcagcgccgatatgctgcttgagaggaatgacaaaacgtgaggccagcggcagctgacgcagcggcgtgccgttggactgggtcttcatttccggcggatgaataccgccgtggaagtcccacagtttatcttttcggaaagccgagaataacttaagcatgttgttccacagaaatgatgcgcaccgggatcgtctgcaaatcccatttccagctgtcaggggtagcggccaccggacgcagctcaatgcactgtgtcgggcagggatcgacgcacagattacaaccggtgcacaggtcgctcatcaccgtatgcatggcgcgggtcgcgccgacgatggcatcgaccgggcaggcctgaatgcatttggtgcagccaatacagttaggttcgtcgatcaccgccagcatacgcaccggctctgccgcgacctcttcgtcgtccactggttgcggatccacatttagcagcgtggcgattttcagcatcacggcttcgccgccaggggcgcagcggttaattttttcaccctgcacgcccaccgcctcagcataagggcggcagccagggtagccgcactgaccgcactgactctgcggcagcagttcgtcaatgcgttcgacaacgggatcgtcctccaccgcgaaacggcgggaggcgtaaccgagaatgacgccaaagatcagcccgagaacgctcagggcggcaatggcaatccagatcgcgctcattacaacttcaccagaccactaaagcccataaaggccagagacattaaacctgcggtgatcagcgcaatggcgttaccgcggaagggggcgggcacatccgccaccaccagacgctcacggatcgccgcaaacagcaccatcaccagtgaaaagcccaccgccgcggcaaagccgtacagcgcggactgcataaaattgtgcccaaggttgatattgagcaacgccacgcccagcaccgcgcaattggtagtgataagcggcagaaaaatgcccagcaggcgatagagcgccgggctggttttacgtactaccatctccgtaaactgcaccaccacggcgataatcagaatgaaggccagcgtacgcagatagatcagatccagcggaataagcacccaggtgtcgataatccatgcgcacacggaggccatcgtcattacaaaggtggttgccagtcccatccccatggcggattccagttttttggacacccccataaacgggcagaggccaagaaacttcaccagcacaaagttattgaccagaacggttccgacaaacagcagtaagtaatcagtcattattcgccctgaaagaataaaccgcccattatcggataatccgcaacgggcgacaacagcataactgtagggttattacgggttaacaaaggtctttttgaccctgccggagcgcttaaaatagggcaccagcaacgccgccgccatcagcggaaacagcagctggcgcagcgccagttcatccgataccggggaaaaggcaaaggcttttaccgccagcagcaccgaaatcagcagccagataatatagtgctttggcaccatccggcggcgtttgaaaaaggcaatggtcagccacagggtgtaataccacatgcccacagcaaacagcagggtggcaaaccacatcaccatagacatcatgccctgggcgtgcagcgtggtgaacgtccggggcgacatcagcgccgaagtatagagcagaagcgccagcgacgtgctcagcagcgccaccagcagccatgccaggggggcgagtaaccagcctccgattcgttctgcgggcgttgcggtcatggattattcacctttagtctgtacgcgtaatttgccgggcgaagattataaagcattgccgggggaatactactggcattattaccggtaacacccggacgcagcgggtaataatacgcgacctggcgaaacagatttgtccgtcaatgcggtggcgggggagttaaggtggttcttaaggggtaaaaagcaggcactggaaagtgcctgcggtaaattaacgctgcgcgccgcgactggcaattaactgctgataccagaagaaactttttttacgtttacgcgccagattattgtcatgatcgacatagacaaaaccgtactgttttttataaccgttaagccagctcagcaaatcaataaatgaccagggataatagccgcgcacgtccgcaccctgcgccatggcgtcagccatcgcatccacatgcatgcgcagataatcaatgcgcgggtcgtcaacaacttccccgtcaataatgggatctttcgcgcccaagccattttcggtgatgtagatgggaatatcaccgtaacgggctttgatttgcataatgccgtcggtcagtccctgcggccagatttcccagtcccagtcggtataaacgccgtccggattacgcacgaatttaaacaggcctttaaagccgaattcatgaccgctgttgctctcgccggaatgattcgcctgggtatgggtttcgtgcggattggaaactaccgtttcacgacgataataattcaggccgataaagtcgcagcgattctcccgcagtaagcgatcgtcgtccggggcgaaccgcggcaccccccagcgctgctgcgcggcagccagtaatgccgccggatattcgcctttcagcaccggatcgtaaaaccagtgggtataaatggcatccgccagatcagccgccgccacgtcttccggcaggcgggtgagcggggtgtgcggttgcagtacgttcacaaaaccgatttcacctgcgatgccggactgacgaaaggcttttaccgccagcgcatgggcgataaagacatgatgacaggcctgaatggcccgcgccggatcggtaacggagggcggatggctgccggtgatatagccgtgaccgatgaatacgatggtttcgttgaaggtggcccacaggcggacgcgggagccgaagcggtcgtagcacaggcgggcgtactcctcaaaagcgtccgccgtagagcgcgcttcccagccgccttcgtcctgcagtgcctgcggcaaatcccagtgataaagggtcaccataggcacaatattgtgcgccagcagggcgtcgatcagatcgctgtagaacttcacgcccgcttcattcacctcgccgcggccctgcggcagcaggcgcggccatgaaatcgaaaaccggtagctttgcagccccatttccgccatcagcgcgacgtcttcctgcatgcggtgataatggtcaacggcgacatcgccgttcgtgtcctgccaggtggcgccgggaatatgcgaaaacacatcccagatcgacgggcctttgccatcggcatcatgtccgccttcaacctgatacgccgcagtcgcggcaccccataaaaattcttccggaaacgcagccatcgtgtgctccttacagttccatgacgttaaggcacgttacacgcgatgcgtttatcaccgcaaccggtttcagaaaccggttaccggaatgggagggcagtcacttttaacccggcggggagggcgttattttgcctgtacgtgggcggcgggctccggtggctgataatcatcaatatggctggcaacgcctaataaaatggcgctgacgcccagcacgatccaaccggcaagttcaataatgcgggtcactactccgttcataatgcagacttctcctgtttacctgagggcgaatagtagcggggcgtgattattcgggcaagtctccgtcggtattcagggtattttcaggattttctgaaatcagcgcccccgatgacgctctgtttgaggaagacagggtgaccatcgccacgtatgattaataaagcgaaaacacattcctccactgacgagaggcagctttatgagtgacaagatccgtgtcggattaattggctatggctatgccagcaaaaccttccatgcgccgctaatcgacggcacacctggcatggagctggcggcgatctccagcagtgatgaaaacaaagtccatgccgactggccgaacgtgccggtggtgtcggagccaaagcatttatttaatgatccttcgctggatttgattgtcatccccacgcctaacgatacccatttcccgctggcgaaagcggcgctggaagccggtaaacatgtggtggtggataagccgtttaccgtgacactgtcacaggcacgcgagctggatgcgctggccaaaacccttggccgcgtgctgtcggtattccacaaccgccgctgggacagcgatttcctgacgctgaaagcgctggtggcggaaggcgcgctgggggaagtgacctattttgaatcgcacttcgaccgttaccggccggaagtgcgtaaccgctggcgagaaatggccgggccgggcagcggcatctggtacgatttagggccacatctgctcgatcaggcggtcaacctgtttggcctgccggtggggatgaacgtcgatctggcgcaattacgtcccggcgcgcaggctaccgactatttccatgcggtgctcacctatccgcagcggcgcgtggtgctgcacggcacgctgctggcggcggcagaatcggcgcgctatatcgtgcacggcacccggggcagctatgtgaagtttggcctcgatccgcaggaagaacggctgaaaaacggcgaacgtctgccgcaggaagactggggttatgacatgcgcgacggcgtgctgacccgtgccgaaggcgacgagcgggtagaggaaagctggctgaccattccgggcaactatccggcctattatgccgggatccgcgatgcgctgaacggtgacggggaaaacccggtgcccgccagccaggcgatccagatcatggagctgatcgagctgggcatggaatcggcaaaacatcgatcgacgctttgcctgtcgtcatgaagaagcccggcatttgccgggctttttttatgcgcggatgaggctgtcgcgcagcgcctgtttttcagcggcgctcaggaaggcgatctccagaccgttgatctgcgcctggcggatctgctcgcggcttaaaccggcctgcggcgccgcgacctgatactcatgaataatatccacgccctgtaccgccggatcgtcggtattcagcgtggccagcacgccgtgctcaaggaaggttttcagcgggtgcgcggaaagggacgccaccgtgctggtctgaatattagaggtcaggcaggattcaatgccgatgcgctgctccgcgaggaaatccatcagcgcaggatcttcaatagccttcacgccgtggccgatacgctcggcgcccagctcacggatcgcctgccagatgctctccgggcccgccgcttcaccggcgtgaacggtaatacgccagcccgcgtcacgcgcgcggttgaagtgggagaggaacaggctgccggggaagcccagctcgtcgcccgccagatccagcgcggtaatgctgtcgcggtgcgccagcaatgcctccagctcttcaaggcaggccgcttcgccgaaggtgcggctcataatgccgatcagacgcgcctgcacgttgaacgcgctgctcccctggcgcaccccttcgattaccgcttccaccacgcccgccaccggcaggttatgggtcatcgccatatagcccggtgaaaaacgcagttcaacatagtgcaggccattacgcgccgcatcttccatattctcaaacgccacacgacggcaggcgtccagcgaggccagcactttcacgccccagtcgagtttagacaggaagctgaccagatccggttcgttggaggtcacctgcacgtgcggacgcagggtatcaagggtatcagcgggcagagagagattaaactggcggccaagatcgaggatggtctgggcgcgaatattgccatcaaggtggcggtgaatgtcggtcaatggaatagtggaatcaatcatgctgcactctttttagatgttttaggtaaagtgcagagcattataaaaataaatcggggtaaaaagctatgttgcgcaagcaataagttggttgcgcaacacaaaatcacaaaagtgcctgaattccggctattaaccggctaacaccctgttccagcttgatgcgcggacaaccggcgttcagacgcacaaaaccgcggcccgcgtcgccataggtcaggcccggcataatggcgaccttctggttttcaatcagctcctgctgcaaaagtgcatcatcgatacccagcggccgcaggtctatccaggccagataagtcgactgcggcggctgccagttaagggcagggaaggcggcgttcagctccgccgctacaaagtccaggtttgccgccagatatgcccgcaacgcatccagccagggcgcgccctcgcgataggcggcaatatgcgcatggatcgccagcaccgacggtgatgatagcccgtcgcggctcttcagcgccgtcagataacgtgaccgtgtcacgttatcttcaataatgccatatgcgccggtcagcgccgggatattaaagcttttcgacgccgaggtaagcagcgcccagggaccctgagcgacacggctccagggtatatgacggtgcgctccccaggtcatatccatatggatctcatcgctgatcaccctcacaccgtggcgggcgcacagcgccgccatggtttccagttcatcctgcgtccagaccttcccggtcgggttttgcgggctgcacagcagcaggattttgttttcttcctgcgcgagcaccgcttccagcacggccatatcgcagtaccagtcgccgttatgttgcaggggcaccggcacgacgcggcgatcgttgccctcgatcaccttgtagaacgcgtcataggccggggtatgcaccaccaccccgtcaccgggggcagaccacaggcggatcagttcggcgaccatgtagatcaccgacgggccatagaccagcgcattgtccggcagcggggcgttaaagcgcgtactgaaccagtgctgcacggcgctgataaattcctcgttgttccagcggctgtaacctaatacgccatgggccagccgcgcctgtaacgcctcaatcacacagggcgccgtggcaaaatccatatccgagatggtgaacggcagcaggtcggcgtgaccaaaacggtctgccacataatcccactgggtacaccaggtgccgtggcgatccacgacggttgagaaatcaaacatctcgctatccttatgcttcaacggtattcatcagtgacaccagctcatctttgaccgactgaacctgcgggccaatgaccacctgaagattatgctcgtttaatttcaccactccaatcgcccgcagtgctttcagcgcgtcggtatccacttttgacatgtccgccaccgacaggcgcaggcgagtaatgcagttatcaatggtcaccagattctccgcgccgcccagcgccgccagaatagccgggacgttatagcccgatttcccggcgctgcccgcaaaacgtttttcaagctggctgctgatctctgcctcgcgacccggcgttttcaggttaaagcgggtaatggcgaagcggaaaatggcgtagtaggttacaaaccagaccgctgcgaccaccggcaccatgtaccatttggtcgccagaccgtgcaggatgccgaacaccacaaagtcgatcaggttgccgtcggtgttgccgatggtcacgcccagcaccgccatcatggtaaagcccagacccgtgagcagggcgtggatcacatacagcaccggcgcgacgaacaggaacaggaactccagcggctcggtggtgccgccaatcacgcaggcgaccacgccggaaatgagcaggcctttgattttatgacgattctccggacgggcgcagtgatacatcgccagcgccgcccctggtaagccgccgaggaaggcaggcattttaccctgcgacagaaaacgcgtggcgctctcggcaaagccgtgggaagtggggcagtttaactgcgcctggaagatggttaacgcaccgctgacggtgttgccgcagacgtcgagcgtaccgcctgcttcactgaagcggatcagcgccaccagaatatggtgcaggccaaagggcagcagcagacgctcgccggtgccgaaaatcatcggcccaaaatccccggcgctgttgatcatctgcccaaggccgttgatgcccatggcgaaaaacggccagatgagcggaatacacagccccaccagccccatcactacggtggtaatgatcggcacaaaacgcgtgccgccgaaaaacgccagcgcgtccggcaggcgcacggtatggaaacgttcatgcagcagccagaccaccacccctgcgatcaccgcgcccagaatgccggtatcaatggactggatgccgaggatgttctgcacgttgttggctttcagaatggcggcgtccgtggtgggcagaatgcctttcgcggtcagccagaagttaaccgccaggttcatgaccgcataaccgacgaaaccggcgaaggccgccacgcctttgttttcacgcgccagccccagcgggatggcgatacagaacatcaccggcaggaagctgaacgcaaaagaaccaactttccccatccagatgaaaatcgcctgtaacaccggattttcaagcgccggtaacagcgtcaccacatcatggctgctcagcgagctgccgatgcccatcatgatcccgcagaaagagagcagggccaccggcaacataaaggttttccctaactgctggaaaaactcccacagcgtaatttttggtgcagttttaacaggcatgaacgattccttgtctggaaaagtggattcagtggccagaagataaaacgttttatcaaattttagtgcgacaaatatcacatagtaagcgtataaattgcggtaaaaagggtaatggtaaaaaaacgttttaccagaatcattagcagggatacctcgccgggatgacgaataaaaaaatcaccattaatgatgtcgcgctgcacgctggcgtatcggtcagcaccgtatcgctggtgctcagcggtaaagggcgcatttcgccctccaccgggcaaaaagtgaatgcggcggtagagcagctgggttttgtgaggaaccgtcaggcagcgctgctgcgcggcggcaaaaccggcgtcgttgggcttattgtcagccacttttcagatcctttttatgctcaactgacggcggggttaacaagcgtgctcgaagcgcagggcaaaatggtgtttcttacccagggaggacggcagggggagcatctgctgtcccgcatcgacacgctgatggcgcagggggtggacggcatagtgatcgccggtggcgtcagtaataccgctgaaattaacgcccgtgctgacgggctgccggtagtgttcgcttcccgcgccagctatctcgatgacgccgatattattcgcccggacaatatgcaggcggcacaaatgctgaccgaacattttattcgcggcggccatcagcgcattgcctggctcgggggcaacagttcgtcgctcacccgtgcggaacgcgtcggcggctactgcgccaccttgctgaagtacggcctgccgtttcacaatgaatgggtggtggagtgtgaaaccagccagaaacacgccgccgaagccattggcgcgctgctgcgccacaatccgaccatcagcgcggtgatgtgctacaacagcaccatcgccatgggggcgtggtttggcctgatgcgcgccgggcggcagagcggttttgagagcgtcggcaacgtgtttgatcagcagatcgcgctggcggcctttgcggatgtgccggaaagccggctggatgatgtgcctatagcctggtcactgaccccggcgcaggagatcggctgcgcgctggcggagcggatcatgcagcgcatcgacaaaaaggatgcccacacgcaggagcagatcatgccttcacggctggtgaaggtgagataaaacggggataaacaggggaaaacggcaccttactttgcggagatatccgcatttcaggtgcagcttatcgttactgctgaggcaccgcaggcacggccggggcaaccggcggctgaggcgctggcgctggcaggccgagatccggcataccgaacatgccgacaaactcatccagcggcattttctgaccgttcagcgtcacctgaccattagcgtactgcaggctggtggagatcacgttgttatccagcgtggtgatgcggaacatctggcccatcgccgccaggcctttcacctgctgggcggccagcttgctggcgtcagcatcctgataaccttccagttttgccacctgggtcataaactccgtcgccatatccaccgggatggtcagcttgctgtcgagggatttcacgctgcgatccacttcctgcgccagggtttgcggctcgccggtggcggtggccggatcttttaagaacagcgacaggttaaaggcggtttcacctttgtcgtttttccagctcagcggcgcaacggtgatcaccggctcgcctttcagcagcagcggcagggaagagaagaaggcttccgtggctttctgttgatacagttccgggttctgcaccacgtccggctgcgccatcagcgctttggtctgcgcgttatattgctggctgaactgatgccatgcctggccgtcaatctgaccgactttcagcgtcagtttgccgctgcccatattccggttctgaattttcaggctgttgagggtgtaatcaatctggctgttgacggttttgttgtctttcgccacatcggtcttcgccgtcagatccatgccttccagcaccgccatctctttgttttccaccgagatagccagcttttccagcgacagtttctgatcgccgatacgctcgttgaagctggcgcgtttgctgttgccttcgctcttcagattgttaaaggtaacctgcaccttctggccgtattcgttgaccgcgtccaccagaccgcttgccgcttcgccggtcagcgacacttcgttgccatcacgatcggcctcaagtttgaaatccccgccgctgaaggcgactttctcaccctctttttcatagttaagcggcttcagggcgatgtcagaacgggtatcgccgccgtagccaatgcgcgtgtccaccacaaacggcgactcgcctttggccatatcaaacagcggctttgagacgttattattcaccagcgtcgacttcacggacgccatcgccgggatcagattgaaatgtttaagctgcgcaaaggggaaggggccgtgatccacggactcgttcaacaccacgctttcgcccggtttcagccagacgttctcgctgccggcgacgggtttgatcaccagttgcaaatggctgctgaagacgccgcgctgatagctctgataagccagttccacgcccgcttccggcgcgctgtttttaatttctgcgttagcctgattcaccatatctgcgatacggccttcaagctgtttacccgtgtaccaggctgcacctgtccagatagcacccagtgcaacaataactcccgcggcgaccagcgtttttttcataatgattatccataaaaatgaaaccaggcggctcaggccgcctggacgatcgtaaagtcttgctaagcttagcaatacccgcctgttacgtcagtaacttagttaaccttattgtagactctcgccacgcggccaacaccactgacggcgaccggtgactcatcggcgcggatcaccgccgactcgcccggtttcagcgtcaggcgctcgtcgcctttactaagcagggcttcgccttccacgcagaacacaatcgcggcgctgtgctgggcaagcgccgtttcctgggaggataaatcgtgcagcgagaacgcaaaatcctccaccgggatcgggaattccagcgtactgccgtctttttgcggctgcgttagcagttcagcggctggcttcggcgtgaatttgacgtttgccaccagttccggaatatcgatgtatttcggcgtcagtccggcgcgcagcacgttgtcggagtttgccattacttccagcgccacgccctgcaggtaagcgtgcggggtttcggcgaacaggaacatggcttcgcccggttccagtttcaccacgttaagcagcagcggcgagaacaggccgctgtcgtccggatagaactgcttaataacgcggatggtctcccacggctctccctgctggctggtgagcgtggcgctgagcaccgccagcgcgcgggatttctcttcgccctgcatgttgagcaggctggcgaacagctggcttaagctctctgcgtcaggcttttccaggaaatgagcgatggaggtatgcgcacccgccaccggctgcaatagcgagacaatctcggagaactcgcggaatgcgttcatcgcgaggaacggcgtcagggcaaagaccagctccggtttatggttcggatctttgtagttacgctctgcggcatccagcggaatgcctgcggcattttccttcgcaaaaccggcttcagacgcctgcttgttagggtgcacctggatggaaagcggttgatcggcacacagcactttaaacaggaacggcagttcgccaaaacggttggcaaccgcctcgcccagccagcgggttttatcctgatcgatcagatcgcgcagcacctgaacggaaccgttcgcgtcctgcacttttgagctgctcttcgggtgcgcgcccatccacagttccgccatcggcaactgctgtgggttggcaattccgtagagatccgttaacgcacttttacttccccaggcatagttttgcactgagttgatgagtttttgcattatcaagccctgtagtttcgttaaagagtttgcgggtattaaagcaataaacatcagggaagtaaccactgcatgcaaaaagtcgtactagtctcagtttttgttaaaaaattgtgtaggataaagcgactcgcttttaagcagggcaatggaacatctgcccgaaccataaccagaccgtgcagtcagtgagagaacaatgtcgaataaacccttccagtatcaggatccttttccgctgaacaaggaccagaccgaatattatctgttgagcagtgaccacgtctccgtcgccgaattcgaaggacaggagatcctcaaagtcgatccccaggcgctgaccttgctggcgcaacatgctttccacgacgcctcctttatgctgcgcccggcgcatcagcagcaggtcgccgatattctggccgacccggacgccagcgagaacgacaaatatgtcgcgctgcaattcctgcgtaactccgaaattgccgccaaaggcattctgcccacctgccaggacaccggcacggcgatcatcatgggcaagaaaggtcagcgcgtgtggaccggcggcggcgatgaagcggcgctggcgcgcggcgtctacaacacctatatcgaagacaacctgcgctattcgcaaaacgcggcgctggatatgtacaaagaggtgaacaccggcaccaacctgccggcgcagatcgacctctacagcgtggacggcgacgagtacaaattcctgtgcatcgccaagggcggcggctcggccaacaaaacctatctctatcaggaaaccaaagcgctgctgacgccgggcagactgaaggattacctggtggataagatgcgcaccctgggtaccgcggcctgcccgccgtaccatatcgctttcgtcatcggcggcacctcggcggaagcgacgctgaaaacggtgaagctggcctccaccaaatattatgacgagctggcgacgacggggaacgagctgggccaggcgttccgcgacatcgaactggaaaacgagctgctgcgcgcggcgcaggatctcggcctcggcgcacagttcggcggcaaatatttcgcccacgatattcgcgtcgtacgcctgccgcgtcacggcgcttcctgcccggtaggtatgggcgtttcctgctccgctgaccgtaatatcaaagcgaagatcaaccgccacggcgtgtggctggaaaaactggagaacaatccgggcaaatacattccacaggcactgcgccaggccggggaaggtgaagcgatcaaagtggatcttaaccgcccgatggcggagattttacgccagctgtcgcagtatccggtgtccacccgcctgtcactgagcggcaccattatcgtcgcccgcgatattgcccatgcgaagttaaaagagcgtatggatcgcggcgaaggcctgccgcagtacgtgaaagatcacccgatctattacgcaggcccggccaaaacgccggaaggctacgcctccggctccctcggcccgaccaccgccggacgcatggactcctatgtggatcagcttcagtcgcagggcggcagcatgatcatgctggcaaaaggcaaccgcagccagcaggtgacggatgcctgtcacaagcacggcggtttctatttaggcagcatcggcggtccggcggcggtactggcgcagagcagcatcaaaagtctggaatgcgtggagtacccggaactggggatggaagccatctggaaaatcgaagtggaagatttcccggcgttcatcctcgtggatgacaagggcaacgatttcttcgctcagatccagtcctccgcctgcgcgcgctgcgtgaaataaacccttttcgtccggcaacgcagctcgtcgccggacgtttttttgcaacattttctatcgtgccacgcaacttcagtaatacttacaacttcgtttgcaggtgagcaatgtcggcaacccacatcacttggtatccagggagaaagtatgacttcgcatcgcagtgaaaaagattcgatgggcgccatcgacgttccggcagataaattatggggcgcgcaaacccaacggtcgctggagcattttcgcatctcgacggaaaaaatgccggaggcgctgatccgcgcgctggcgctgaccaaacgtgccgccgctaaggtaaatcaggatctggggctgctgcccgaagaaaaagcccgcgccattatcagcgccgccgatgaggtgctggcgggtaagcatcctgatgagttcccgctggccatctggcagaccggctccggcacccagagcaacatgaacatgaacgaagtgctggcgaaccgcgccagcgagctgctggggggcgtgcgcggtatggagcgcaaagttcacccgaatgacgacgttaataaaagccagagctcgaacgatgttttccccacggcgatgcacgtcgctgccgtgatagccatccgcgaacagctgctcccgtcgctgaacgaactcaaaaccacgctcagcgaaaaatcccgcgcctttgcggatatcgtcaaaatcggccgtacccatttgcaggacgccacgccgctgacgctggggcaggagatctccggctgggtggcgatgctggagcataatctcaaacatattgagcacagcctgccgcatctcagcgagctggcgctgggcggcacggcggtgggcaccggcctgaatacccatccggaatacgccgtgcgcgtggcggaagagctggccgccaccaccgggcaggcgtttgtcaccgcgccgaataaatttgaagccctcgccacctgcgacgcgctggtgcatacccacggcgcgctgaaagggctggcggcctcaatgatgaaaatcgccaacgatgtgcgctggctggcctccggcccgcgctgcggcatcggcgagatcgccattccggaaaacgagccgggcagttccattatgccgggcaaagtgaacccgacgcagtgcgaagccatgaccatgctgtgctgtcaggtgctgggcaacgacgtggcggtgaacatgggcggcgcgtccggtaactttgagctgaacgtcttccgcccgatggtcattcataacgtgctgcaatcggtgcgtctgctggcggacggcatggagagctttaacgaacactgcgccaccggtatcgaaccggtgcgcagccgtatcgatcagctgctcaacgagtcactgatgctggtgacggcgctgaacacccacatcggctatgacaaggcagcggaaatcgccaagaaagcgcataaagaagggctgacgctgaaagacgctgccctggcgctgggctatctcaccgctgaagagttcgacagctgggtgcggcctgaatccatggtcggcagcatgaagccgggccactaaccggcaacaaagaggtgcagccggggaataatcggcgttaacggctgcgcctcaggcttataacgatgctgaatattgtcagcatcgtaattcagcagttccccgatatccggcgcccggccgccgttttccgcatcaatcagcgcaatcatcggcgcggggcaggcgtactgcacctgctttttggtgtccgcataccagacgcgggcaatgggctgcaccttcaccggccgtttgattttcagtttcgcccgttgcggcagggcggcaatatcgttgtactcctgctccagccgcgtctgccactgttcacgcgtccagccgcccaccgcgcggggggctttcaggcttttcgccagcatcgccagcacctcatcccgggtcagattcttaatgatgtgtttgttcgcccagccaaagcgcagcgtcgccggatcgcgcagggtggtcagcgagcgataggcgttaagggtaatcagccccggcaggtggtggtgcacccattcaaagcgcgcggcgggaggaagttcagattccacggtgataatgcgctcaaaagcctgcttcaggtcattgatggtggcgatgcgcgcttcgatggcgtcgcgcagcccgggagccgtttgcaggcaaattacgccgggcagccgcacggcggctttgctgctgcgcttttctgactgctgctggataaacagatgcgtgaagtggcgcagcgcccgttcagccgcttccttgccgatatgctgcttcacggtgatggtggtcaggggatcgtgctcgctgcctttttccactgccggcaactcaaagacgcggcctgccagcagccgacaggcggcgagttcggttttcagctccgccagttgctgctcaagctggcgaaaagtgctggtgaggcgttcgatcaggtcgtagcgcgccatagcttactccttagttacaacatactttatgtatagcacagccggaccgctccggccaccgcgattaacggtccggcaggacgggaagggcgaccagttgtgtaactggccagcgaaaacgaaagcgcgcgccgccggtatcgctggcgtcacagctcacttcaccgcccatcgcctgtgcgatcgagtgcacaatcgccagccccagtccgcagccgccggtggcgcgatcccggctgggatcaagacgcacaaaaggctcaaacacccgctggcgttccgcttcggcgatgccggggccgtcgtcgtcaacctgtaaacaggcatagctgccgtccagatccaggctgacgctcacctcgttttcacaatagcgcagcgcgttattgagcaggttatccagcacccgttccatcaggcgcatgtccagcgcgccaaagtgcgcagcgctgtcggcataaacccgcagacgtttgtcgggggttacgctctgcacgtcggcgatatggctggtcagccaggcgggcagatccggcgtcgtcagccgcagttcattttgcggccggtcgaggcgggcataggtgagcaattcttcgatcagtccttccagctggccgatatcacggttcagcgccgctcgttccggctcgctgaggttatcgctcatttccagacggtaacgcaggcgcaccagcggcgtgcgcagttcatgggcgatgccgtctatcagctgtttcttgctggcgatgagagcgttaatgttatccgccatctgattaaaagccacgccgagccgctcaaagcttgagccacggtcaaagtggatgcgctcggtcagatgcccgtcgccaaaacgctgcgccgccgattcgatacgcagcatctcctgccagtgcgggcgcatccagataaagacagggaatgcgagcgaaatcgcgataaacaccagcagcgtgatgtcgagaatgcgcatctcatgcagataaaacagataaggcaccggcccgaccgccagcacatagtggctgcggggaatgcgctggataaaggtgtactccgcgtccagcgccacaatgtcgccttcccgcagccgctgcgccgttggcgcgtcaaggctgaacttattcagcggttcaatacgcatatcgaatgaaagattaagatccatctctttaagggttttgctccactcgtggggcgggatctcgcgcagctcgctgcggatgaggtacagcgagcttttcatcagatcgtcaagcgactgtcggcccgcacgctcggcggtgaatttgtacaccaggccgaccagcatggtcatcaccagaaaacagacgaacagcagcaggtaaaactgcacaaacagctttttcattcagacacctgtgattgtggcgacactcagttttcccaggcgtggggcgcgaacagatagcccttgttgcgcaccgttttaatgcggtagggctcggtggcgttatcaagcagttttttgcgtaagcgtgaaatggccacgtcaacgctgcgatccatcccgtcgtagctgacgccgcgcagattctttagcagcgcgtcccggtccataatctgcccggcatgggtcgccagctcccacagcagatcaaaatccgccgtcgagaggacaatttcatccccggccagcagcacctggcgattaaccggatcgatggacaaactgccaaagcgcaaggctttgtgcggcgttaaggtattttgctgcgccgcgggcgtggtgttcgcggcatgctggcgcaggtgcaatcgcagacgggccagcagcacggcgggcggggtggttttcaggatgtaatcgctggcgcccatttccagcgacaaaatatggttcatgtcgctgtcaagagaggtcagcagcacgatgggtccctgccactggctgcgcagatcgcggcacagcgtcatgccgtctttaccgggcagcatgatgtccagcagcaccagttcagggttctcgcgcaggatcaccgcttcggcgcagtcgccgcgcggctcgacaatcacgtcgatgtcgtgtttaccaagatacgccgcgatcagcgcgccgacttccgggtcgtcttctacaaaaacgatcttattcatatgcatgatggttagctaaaaacgccaacatacaccgccttgtttcaacccgccatcactctttcgttaccggagcggacgaccgccgtcgatggcgaaactgcgaccggtgacataacaactggtgagcagataatccaccagatcgataacctctttttcaccgggggcgattttcatcagcgacttattcagtgccttctgacgatagctggcgtcgtcgtgctcgttgaataaaatcagcgacggggcgatggcattgactttcacttccggcgcgagcttgcgggcaaaggagcgcgtcatgttatccagcgccgctttactggcggcgtaggcgatatgcttatcactgccgcgctccaccacgtaatcggtgaaatggataatgtcggtggatgcatgaccctgaccgcgcagtagaccttccagcgcatgattaagcaggtaaggggcgtggacatggatttgcagcatggcggacagcacctcggtaagaggcgtgccgggcttttccggcagccagccgctggcgttgtggatcaccgcgcgcagacaacgggtacgggatttgatctcctcggcaaattttaatattccgtcatcggaacaaaaatccgcctggatgcagaccgcgccttcttcctgcaacacatcgatagccgggtaaggggtgcgatagctgacgatcaccggctggtgcaggttgagaaaatggtgggcgagggcgaggccgatacggcggcctccgccggtaattaaaatgggattgggttgatctttacccatcgctatctccttatcgttaagacgatgggcgcagcatttatcccatcagcatccaggtcgccggaaccgctgcaagcagcagacaggcaatcatcacatgttcggcgcggcgcagcggtttatcatgctggtgggtacggcgggcatagataaacaccagcaggccgggcgcataaagcaccaccgacagcagcagatgcatcgggccggaggcatataataaccataaaccatacaggcaggatccgacacccacgaccttatgcagtggacggctggcgattttcagcaaatacgccccgacgaggaaatagggcacgaggatcatttcggaggcgatggtcaacagcgtgttgtaatcggatccggtcagccagataaggatcagacacacctggacgctggcgttggtcagccacagcgaagcagaaggcgcgctgtttttattctgacgggcgcagatacgcgggaaggctttgtaggtggcggccagcagcggcacttccgccgccatgatcgtccagctcagataggccccgcaaacggagacaaccagaccggcggcgataataatttcgccccaggaacccatcatacgtaccatcaatcccgccatcgacgggttacgcatttcagccagctccggacgggccaccacccccagcgacaacagcgtcaccagcaggtaaaccgttaaggcagccatgaccgccagcagcgtcgcgcggcccacgtcatgcttgctgcgcgcccgggcggacaccaccactgcgccttccacgccgataaacacccacagggtgataagcatggtgtttttcacctgctcccacaccggcacgcccagatcgatgccggtaaaatcgagtttgaacttatcaaaattaaaggccagcgcagccagcaccacgaacagccccagcggcaccagtttcgccagggtcgcggcgaggttgatactggctgccgtctgcacgccgcgcagcaccagcgcatggacgatccacagcaggcaggacgcgccgacgatggactgccaggtgttgccgtcgccaaagatgcgcagctgtggggtatcggtgaagaagctcagcgccgagaatacgatcaccaggtaggagacgttggcgatcaccgcgcacagccagtaaccccaggcggagcagaaaccgatcagttcgccgaagccttcccgcgcataggtaaagatgccgccatccagatccgggcgcaaccgcgtcagcagcagcatggcaaaggccagcaataaaatgcccgcgccggtgatcccccagccaatcagcagggcggcgggactggcgacttccgccatattctgcggcagactgaacacacccgcgccgagcatggagctcagaacgagcgcagttaaagcgctaaggccaagtttcttttccatcgtcatcctgttatgaacgaactggatccagaataattatttcgccgtagcgcataaaaatggtggatcacactgaggcgcggaattttacgaagagcggcaggcgcatgcaatgaggtacagcagaaaattatgcaaaaagctgtaaaaggcggcacaagccgccttttaagaggggaattacttatacagatcggcgctgatggtgatattgccaccacgttcctgccactggcgggtgatgtggtaatattttgcgcctttctttgccgcgcgtttggccacctggtaggagatttccgtcatgttgccgtagttaccggtgaacttcacgctgtcgaagggcaccatttgcgccgcggtgattttattcacttcttcaattttggtgccgtccggtaaagtgacagtgtaacggccaccttttgatgactgggtttcaaagaaacgacccacttcggcgcttggcgcggcgctggtggcgatacccgggatctcaactttcttcgcttcttcgccgcctttcgccagcattgcgcgtcctgcgtcagagtttgccggaatagcgtccgggctttgcagtacgcgttttttggcgtctgctttatagacgtaggcggtgatcatctggttgccgccgtcgttggtatccacctggcgcacaatatagtaagaggccgcatttttcgctttcgcggccttggtgatggcggcgttaatatcaggctggctgcggtagaaaccccgcaccgagacggtgtcaaaaggttccagctcgatcgcctgatctttggttaattcggtcacgccgttaatgacacgattttttggcgcatccgcttttggcgcatctgatttatagagatcggccaccacgcgctgattaccgctgttggcataatcggcagagtcgacaatatagaaggcatccgcgcctgctttatcggcgcgattagagacggcattcacggcgtcgctgatggcattaaaacggccagtgatcgtgatgcgatcgtaaggcttaaccgctgctgcctgctcaggcgtcaattctgtcgctgcattaaccgacaatgttgtcgctgaaagaagtacagacgccacgagggtgttcttaagcttcataaaaataatccttcgccttgcgcaaaccagtaattggtagtgtggttgtcttgaaaacgttgccgattatggcattgaaatgtcgtcattgtctgcgtcatttttaacggccagtgcggggcgttagctgaattaccataacaattagatatatgtggaaaaaacagccgccagaccagcaaaaccggtaaagcatatgacttttataagttaactcattgttaaattgttgatctcagcaaacaggtaatcatgttttgccgcctcgctttggcggattatggggcgcgcgccgcaattttaagttaaaccagccagtcagaacgcgtttctcttaatattccgcaattaaataagaaatactcttttctggcgctagatcgcaggcgttattttcagtaggttatagaaagtttgttaccgtttgatttattagcgttgatgttcgttacccctgtgggtggcgggcaaggtcttttgagaaaactgacaaaccatcatcttaaaccgatggaagggaaaactatgcgtattggtgtaccaaaagaacggttggccaatgaaacccgcgtggctgccacaccgaaaacggtcgagcaactgcttaagctgggtttcactgtcgctgtggaaagcgacgcgggcagactggcaagttttgacgacgaggcgtatacccgtgcgggcgcgcagatcgttgacggaaatgacgtctggcagtcagacattattctcaaggtgaatgctccgggtgacgatgagattgcgttgctcaatccgggcaccaccctggtgagctttatctggcctgcgcagaatccggaactgctggaaaaactcgcggcccgcaatgtcaccattatggcgatggactcggtgccgcgtatttcccgcgcccagtcgctggatgcgctcagttcgatggccaacatcgctggttaccgcgccattgtcgaagccgcccacgaatttggccgcttcttcaccgggcagatcactgccgccggtaaagtaccgcccgcgaaagtgatggtgattggcgcaggcgtggcaggtctggcggcgattggcgcagctaacagccttggcgctattgtccgtgccttcgacacccgtccggaagtgaaagaacaagtgcagagtatgggcgcggagttccttgagctggatttcgaagaggaagcgggcagcggcgacggttatgccaaagtcatgtccgaggcctttatcaaagcggaaatggcgctgttcgccgcccaggcgaaagaagtggacattattgtcaccaccgcgctgatccccggtaaaccggcgcctaagcttatcacccgtgaaatggtcgattccatgcagccgggcagcgtcatcgtcgacctggctgcgcaaaacggcggcaactgtgaatacactatcgccaatgaagtcgtcaccacgccaaacggcgtaaaggtgatcggctataccgatttaccgggtcgtctgccgacccagtcctcccagctgtacggcaccaacctcgttaacctgcttaaactgctctgcaaagagaaagacggcaacgtgaacgttgattttgacgacgtggtggtgcgtggcgtaactgtcgtgcgtgagggtgaaatcacctggcccgcgccgcctattcaggtttctgcccagccgaaagcggcggcaaaagccgcacctgagccgattgaagaggcggttcccgcatcgccatggcgtaaattcgccctgatggcgctggcgatcattctgtttggctggctcgctgatgtcgcgccgaaagagttcctgggtcacttcaccgtcttcgcgctctcctgcgtggtgggctattacgtggtgtggaacgtatctcatgcgctgcatacgccgctgatgtcggtgaccaatgccatttcaggcatcatcgtggtcggcgcgttattgcagattggtcatggcggctggatcagcttcctgagctttatcgccgtgctgatcgccagcattaacatttttggtggtttcaccgtcactcagcgcatgctgaaaatgttccggaagaactaaggggtaacatatgtctggaggattagttacagctgcatacattgttgccgcgatcctgtttattttcagtctggccgggttgtcaaagcatgaaacctcccagcagggtaaccgtttcggcatcgccggtatggctatcgcgctgattgccaccatctttggcccggaaaccggcaacgtggtgtggatcatcgtggcgatggttatcggcggcgcgatcggtattcatctggcgaagaaagtcgaaatgaccgagatgccggagctggtggcgatcctgcacagcttcgtgggtctggcggcggtactggtgggctttaacagctatctgtatcacgacgcgggtctggatccgattctggtcaacatccatctgaccgaagtgttcctcggtatcttcatcggcgcggtgacctttaccggctccatcgtggcctttggcaaactgcgcggcaaaatctcctctaagccgctgatgctgcctaaccgccataagctgaacctggcggcgctggtggtctctttcctgctgatggtgatcttcgtgcgcaccgaaagcgtcgggttgcaggtgctggcgctgctggtgatgaccgttatcgcgctggcctttggctggcatctggtggcgtctatcggcggggcggatatgccggtggtggtctccatgctcaactcctactcgggctgggcggcagcggcggcgggctttatgctgagcaacgacctgctgatcgtcaccggcgcgctggtaggctcgtccggcgccatcctctcttacattatgtgtaaggcgatgaaccgttcgttcttcagcgtgatcgcaggcggcttcggcactgatggctcctcgaccggcagcgacgaagaagtgggcgagcaccgtgaaatcagcgcagaagagaccgctgagatgctgaaaaactcccacagcgtgatcatcaccccaggctatggcatggcggtggcgcaggcccagtatccggttgccgatattaccgagaagctgcgcgcgcgcggcatcaaggtgcgtttcggcattcacccggttgccggtcgtctgccgggccatatgaacgtgctgctggcggaagcgaaggtgccctatgacatcgtgctggaaatggacgaaatcaacgacgatttcagcgataccgacacggtgctggtcataggcgcgaacgatacggtgaacccggcggcgctggacgatccgcgcagcccgatcgccggtatgccggtgctggaagtgtggaaagcgcagaatgttatcgtctttaaacgctccatgaacaccggctatgcaggcgtgcagaacccgctgttcttcaaagagaacacccacatgctgttcggcgatgcaaaagccagcgtggatgccatcctgaaagcgctgtaagacaccgcaaaaataaaaggccgctcaatgagcggcctttttgtttctgagggcaggttaatcgtcttcgtcatccagctcgatcggggtctggaactcgtccggcttcagcaccagcacatcgcagcgcaggtgatcgataacctgttccgccgtattccccaggaacgccgctgacagcccggtacggcccaccgtacctaacaccaccacgcccgcctgcatatgctccgccagatccgggatcacttcttcaggcaaacctttttccacatgggtcagcttctcatcgatgctgtatttctggcgcagcgccttcattgccagcagatgctggccgcgaatggcatcgttatagacgctgggatcgaactccggcagttcaatggcgatattgattggcgtaacagggtatgcgcctaccaggtgcacttcggtatggttaaccatatccgcaagctggatggtttccttcaccagcttctcattaagggccgtgtggtacggctcttcgctggcaaggtttactgccaccagcgctttgccgccttccggccacggctgatccttcaccatccataccggacaggggcatttacgcagcaggtgccagtcggtaggggtgaagatcaccgattccagtttgtcgtgctggtgggtcattttcagcaccaggtcgtgatgatcgctcagcacttcctggataatggcttcgaagggacggttatgccagaccactttaatgtcgataggtacgccggcatcaagataatactgggcctgttcgcggatccacgcggtccgctggctgatcacccctgaccgcatggcggtgcgctcatcaggcgacagcagggtggtcatctcgtaggaaaaatcatagattggcaaaaaggctttgatccgaccaccaatccgttgatgtagataaacagcgcgccgtaatgccggttgatcgtcctggttgggatcgatggcaaccaacatattttgatatctggccatacagggtctccttacatctgtcaccgcagtctgtaactaaaagataacccaaatatgatgaatgaaacaggggagaacctttgccagatcaataaatcagataaatttaacgatccagcaaaggaggctgcgaaggggaaaaatcaggcaacgttacgggagtgtccggccagtaccgccagcgcgtcaccgttttcaatagtgatgtacttgcctttcaccgccagcatgccgctcttctggaagcgaccaagcagacggctgatggtttctaccgtcagacccagatagttgccgatatcgccacgggtcatggtcagacggaactcacggggcgagaagccacgctgggcaaaacggcgcgacagattatagataaaggccgccagacgctcttcggcatttttcttcgacagcagcaggatcatgtcctgatcgcctttgatttcgccgctcatcagacgcatcatttgctgacgcaggttcggcattttaccggacaggtcatcgagggtttcaaaggggatttcacagaccatggacgtttccagcgcctgcgcaaagctcgggtgatggccggtgccgatagcatcgaagcccaccagatcgccagccagatggaagccggtgatttgctcgtcgccctgttcagtgatggtgtagctcttgatggtgcctgaacggatagcgtagagcgatttcagttcatcccctgctttaaacagcgtctgccctttctgaataggctttttgcgctcgataatgttatcaagctggtccagctcatgttcattaagggtaaaagggatacaaagctggctgatgctgcaatcctggcaatggatagcacaaccgccagactgaatgcgtcgtataattcgcttttccgggatcataggtctgctcaagccttaattgattttggtcaattttaacatctttttagagcagaggtaagtccgggacagtgccagaaggtgattattggaaacctaataacattatttattgtatgtcattgatattccgcatatagattagggctttttacgctaatcactgatagaaaagcactaaatgtccttttttctcacaataaaaagtagccctcatggcgcaacaaccactcttttcgctgtacgccgcccgcataccccgtgagcataccattgctgccaatcacccgatgacagggcaccacaatgcttaccggatttgaaccattagcagcgccgactgcgcgggcggcacctgcccgacccagcgccgcggccagctgaccataatgcatcacctggccgcagggaatggcgcgcagcgctttccatacctcgcgctgaaagggcgtaccggcggtttcggtgggcagggtgtcaataacgtcaagatcccccgcgaagtagtcgcgcagcttctggctgaggccgcccggattactggcgctgacgcgctgataaccttcaaggcgataatgcaggctcagcagctgttccatgcgatcgctgtgctcttcccattccaccgcgcgcagacggaactgttcatcgcacatcacccacaaggggccaagcggggtagcaattttatcttcaagcagcgtcagcatggggatcctggtaaaggcagcgggaaagggcggagataatctagcacgacgacaaccccgtctctaccctccctgagaggtagcgcaccattaataaccagcgaaacgttttgctgactaaataataatcacctgcgcatttaagaaataaaaaaatagagtctgccgacatccgccagactctacagtacacacagcagtgcttcctaagcttattcccgagaaatcgtccctgtgggttaatttaagttatagccaggttgcggtataattccagtcgcggatgtcattaatgtctcattatttttatttatcctgtcattttaattttcatggggtattagttaagggcaggcgaataaaagaccagcgaaatagtattccatctggttatgatttttttaacgcctttgggaaatcagggatggtcattgagacgcgggcgcggcgcggttatagtagagggatgctggcaccagcagaagtagcctgaggacaacaacatgaaccttgacgacaaatccctgttcctcgacgccatggaagatgtccaacccctgaagcgcagcaccgacgtgcactggcagccggagcgccgcgcccccggcccgcagcatcctgatctcctgcaactggataacttcctgaccacgggttttctggacattgtgccgctcaacacgccgctggagttcaggcgcgaaggcctgcaaacaggcgtcattgagaaattacgccagggcaaatacagccaacaggcgagcctgaatctgctgcgtcagccggtggagcaatgccggaaaatgctgttcagctttatgcatcaggcagcgaaagataacctgcgcaatctgctgatcatccatggtaaaggacgcgacgacaactctcacgccaatattgtgcgcagttacctggcacgctggctgaccgagtttgaagacgtgcaggcgttttgcgtggcgaaagagcaccacggcggcagcggagcctgttatgtggcgttgcgtaaatccgccgctgctaaacaggaaacctgggagcgtcacgccaaacgcagtcgctagtttgtttttatttaacggctgcgccggtgataattttccccgcggtcagcggggcgcatgaataagcagggccgcaatttttatttatttgcgcttaaattattcaccttgtaaatataaaacgccctgcataccagacagggcgcttaatattatccttcaggagtagaaaattatcagcgcgctagagcgcttcatattcgccggtgccatccggccacggcgtcagtaaatcataaccgttttccgtaacggctacggtgtgttcccactgggcggaaagcgagcgatctttagtcaccaccgtccagccgtcagacagcacgctggtggctgctttaccggcgttgatcatcggctcaatggtgaaaatcatacccggtttcagcaccgtgccggtgccgggaacgccgtaatgcaggatctgcggctcgtcatgataaacctgcccgacgccgtgcccgcagtactccctgacgacggaaaaaccggcgtcttccgccacgcgctggatcgcagccccgatgtctcccagcgtcgcgcccggacggacggttttgatcccggccaccatagaggcataggtgatatccaccaggcgtttcgcgcggatcgagggttcgccgacaaaatacatacggctggtatcgccgtaccagccatctttgatcaccgccacgtcaatattcacgatgtcgccttttttcaggactttctccgccggaataccgtgacacaccacatggttgacggaggtgcagacggtgcgggtatagccctgatagccaatgttcgccggcgtgattttcagctcgttcacaatgaagtcgtgacacaacctgtccagttcatcggtggtgatcccggggcgcacgtgaggaccgatcatcgccagtacactggcggcagcctgacctgcggcacgggccagctctatttcttcctgcgtatggagttttatcgtcatggtatcagcgcctctttttgtgccggaaatgccccggcctggactaatttttgaatttccgcgccgccctgcgactcggtctgcaccagcaggcgcatcaggtcctgatgggttaaatgcggatagacttccgccagcatgccaatttttaaccagtgttccgcctgagaatttatcgagcggctcatcgcattgctggcaagacgcagattctcatgcatcaggtccgagattttcacaatacccataggtgatcctgcctgtcggtttaatacgaaacatatatgaaacgtataatagcataacctcaccggcgtacaacatgtccctttttgacatcaggctgtccggcgcggggctgtcgcctgtggcgggattgacataagctcagcaaaaaacagaggggacaattgatgcttgaactaaaacctgcctgtgaacgttgtggcgccgcgttgccgcacacctcgacgcaggccatgatttgctcatacgaatgcactttctgcgccgactgcgcccggtcgccgttgcaacatacttgcccgaactgtggcggcgaactgctacggcgacccgcgcggcataaaaaagaggcctgacggcctctgatttgtggtggattttgtcgggtggcggctgcgcctgacccgacctgcgatatggtgatctgtgactattcacacatgccacgcgttgtcgccttcttcccgctggcgggaaagggcatcggcggcgcaaatcaacgataaatggctcagtccctgcgggacatttcccgtccagtcgccggttcgcacatcaaacatctcattaaaggtttcgacgttgcccttattacacaggcattccaggatgtgctccatataacctgacgccttttcgtcgttgcccagccgcgcccaggcttccaccagccagaacgagcaggccacgaaggtgctttcctctttttccacgtcgctatagcggtagagcatgggggtgccgtgccccagttccgccaccattgcgtcaaaggtggatgtcatacgcgccagattgttttcccggccgtagtaccacaccaggcacagcgaggcatccagtctgtctgttccgggataaaaagtgtaggcctgcttcttttcagaccagcagtgttcttcgatccagtcccgaatacgatctttttcccgcgtccagcggtcgatccaggtggattctatatgtccatcgctggcaagcttagcggcgatatccagcgtcacccagcaggccattttcgaatgggtataatgattacgttctggcagttcccagatccccgaatcatcctgtcgccaggagtcggcacagtcattggccagccgtgacagcagacgggaagtggtcagatccagcacgtgaccggcatggacgaacagcagggcggtgtcgagcatatcgccaaacatactcagctgacgctggctctgggcgttattaccaattcgcaccggttgggatcccttataaccttccagcggcagccaggtttcatccggcacaatttcaccgttaagggtgtagcaggcgcgcagctcgccttcatgtcgcacaatggtgtgcgtcagccaggaaaaagccgctttgcattcttccagcgcgccgataaaggcaaatgcgcgaataatcagacaggcatcgcggatccaggcgtagcggtaatcatagtttttctcgccgccaatgccttccggtaacgaggtggtgggcgccgctgccagtgcccctgttggcgagtaaagcaaaaacttcagcgccagcgccgagcgtttgacgtgttccgggaaacgtccgtcataggtcagatcctcagtccattgccgccacatttgatcgctgatctcaatacggtggtcgattctttccagcggcggcacggccagcggctctttatcactcaccagcagggcgatcaggctgcgggagccgggagaggtggtcagggtcgcctctatacgatcatcttccgtgcgggtgagcgtgacatcaggggtggtgctgatcatcgccatcagctcaccgatatgaatgacctggcctttgggagattcagccagccagggggcgcgggtacaggcggctgaacccggcacgaagaccatttttaacgtcacttccccttcaacgccttccacacgacgcgccagttcacaccagggcagacgtcccgcgtgattactgttcagggattcagtgaactttactttgccggaatcggtttcatagcaggtttccagcacgttgctgttttcgcggtacatacggtttacgcagtattcgccgatgggttcaatctgaaagaagccgccatgtgtggcgtcaagaatacggtcaaacagcgggggtgaatccatattaggcgcgcaccaccagtcaattgcgccatccggggcgataagcgccaccgaacgaccatcgccgatagcggcatagtcgcccagcccggcatagccatccacacgacccgggtgggtataagattgattcttcatcggcactctatcctgcaaaaagaaaaatggcaggcaaaggcccgccattctgttacacggtgccggtaccaccgtcggaacaccagacctggccggacgcgaaggagctttcgtcagaagcgaaaagcacatacagcggcgcgatctccacaggctggcccggacgacccagcggcgcggtttcgccaaaggctttcactttttcctgcggctgaccaccgctggactggagcggcgtccagtaagggcccggggcgaccgcattcactcggataccttttttgcccagctgcttggcaagcgctttggtaaaggccacgttacaggctttggtctgcgcgtaatccagcaggatgtcgctcgggttaaaggcctgtacggacgaagtattaatgatcaccgcgccttccttcaggtgcggcaccgccgctttggtgatccagaaaggggcatatacgttggttttgaaggtgtcgtcaaacgcctcggttgtgagatcttcaatggattcacaaaactgctgacgaccagcgttattcaccagaatatccagaccgcccagcttattaatggcttccaccactaattgctggcaaaaggtttcggaacgaatatcgcccggcagggcaacagcggtacggccttctgcctgaatcagggcaatcacggcttccgcatcggattcttcttccggtaaatagttaatagccacgtctgcgccttcacgagcatacgcaatggcaacagcacggccaatacctgagtcgcctccggtgatcagcgcctttttccctgccagacggccagagccgatatagcgagtttcgccatgatcgggaatcggcttcatctcagaggcaaggcctggcgcctgttgcggctgctcagggaaaggtggacgtgggtactgcgaaagtttgttatcctggtttgtcattatatccgcctcgttgataaaaacacgtattaaccctagacacgaaatcatcggtgcgcgaaatttttctataataattaagattaattttaagaactttacttcttttatattaggatctacccgccataaataaggggagatgtttaaaaaatgttcttttttgttaagctaatgggcgagtaatagcgggtaaaacgtttcgatgacatcaaaaaacggattattccttaaataagacatttcttacgaaataggcttgtgactattatcagttaggctaagataattcctgacactggagcctgattagcatgcgtcgtacctgatatttacggcccggcactgttttttgatcggttaaacatgtcgtaacaaacgtgttgtaatgttaaacctgtgaaaaacattgatttataaggagatttaggatgagcattgagcccgtgtttcctgcctttcccgtagtgggctggcaggttggtccggttgaaagtcgtagtaatgtcgtcgttaaatttggctacagcacgtcgccccatacggcgggtgccagtacctttgattcgcagttctttagtttgtcgcctgacatggtgcgcagtctgatttatgatttgcagcgcagcctgcgtgagtgtgaagcaccgctggaaacgaaagtcgcctgagtccgtcgcacatcaaaatcgcagcaggccgttgatcacctgcctgctgcgaaataccatcgccttccggcaacacgccaactaatctattaattaaaaattccagctcatactttttgcttaattccacctctcagtggaatcttaattaattcttcgccgctacgttctgcgctataacttaatacagatagattgtatctgcggaatggagaaagcatgaactttgtttattttaaggcggagaatcatcagcaggataataacacgcccgttaacctggtagttgaagacgtggtacttatgcgagatggggaagttatcgccggactgggagatataaaaatcacccgtttgccattatatgtatatcgtgcagtaccaacaggttttcgtaagattgaatataaaatgaaaaccaccagtcaccggcgtattttgttttcagctggttatctgaaaacgggtgcctattatgttgaaacgcctgacggtgaacagacaatgaactttaacgcgctctccggtttatggaccggggtgcatgaagatgaaaagataatggataaccatgcttttcagaatcagggatacgctgtcttacgcccggtacccagggtaaagaaaaaacgcagcgaattgccccgttaaacttctgcgtcggcgattatcaactaaactaaaaagacaagataacaggaggccgacatgacaacgcaaacgcaaccaccacacatcacagcagcagaaccgcaacggccggtcaaagataatccggcgaagcagggcgaattgccccgtaaacgcgacgacagccaggatgacagcaaagatccgtttaaggcaagttaatcgccgggaacgatttaaaataaagggtgcgctgcacccttttttattttaaacccccgcaactttgcttaaaaaataaccctgccgctgcgtaaagatttgaaaatttcgagaatcccatacagccgttgtggtaaaaatatcgcgtgtttaactaccgaggacaattttcatccgcaggacgagaagcaagacgcggataattgtaattttatggacaatctttgcaggtcaattcgttttaccccccgttttatcctttctgcacccactcagcttgctggtgaacagtactggcgctcggcgctttagccttcattctctctgcacgagctggcgcatgatgcgcacggctaccctctaccgttttaaggtttgcgatttatcgtaagccacgaaggattatattctcacgcaggagagaatgatgcgttactggatcttactggctctggctattctggctgaaattattggtaccctgtccatgaaatgggcgagcgtttctggcggccataccggctttattttaatgctggcgatgatcgctctgtcttatattttgctggcctttgccgtgaaaaaaatcgcccttggcgtggcctacgcgttgtgggaagggattggcattctgctcatcaccctgtgcagcgtactgtggtttgatgaaagcctgacggtgatgaaagtcgccgggctgaccacgctggtggtgggcattacgcttatcaaatccggcacccgtaaagtgaaggagtccgcccatgcagccctttgaatggcaacacgcggcctggctggggctggcaattttgctggaaattatcgccaacgtactgctgaagttttccgacggttttcgccgcaaaagttatggcgtgctgtcgctggccgcggtactggccgccttcagcgcgctgtcacaggcggtgaagggcattgatttatcggtcgcttacgcgctgtggggcggtttcggcatcgccgctaccctggccgctggctggatattgttctctcagcggctgaacaggaaagggtgggcgggggtcatactgctgatcctcggcatggtgctgattaaacttgcctgatgtgatcgccgtctgctgccgctgacggcgaaatcagctaagcttatttttacttctgtaaaaaagataacagccttttcaggcggataagagggcggtgaatgttcaaacccttaagctggcgtaatctacccaccgcacgaaccttatccgttatgatattcgtggcgggtattggtctggttatttccgttattaccctgatttatctctcgctgcatctcatcagcgctaaaaccaacgaaatcgatgaacaccgctcggcgctgtcggtgcagggggcgatccagacttcggtaaaccgggtatggtcgctggtgctggacaacgccgtctgggacgatgcggtgcgcgaggtctatcgcccacaggtgaatgccagctggttatataacacctggggcgcaggctttaaggttaataatctttatgacggcacctttgtgctgaatgagaatttcgacatgctgtggggttcctttcgcatggagccttttaccgaacttagtctggatttttttggcgcggggctgaaggcgttaatcagccataatcagcgtacgctgcccggggaaaatctgatctacgcagggatcacccgcacccgttacggcgtggcttttgtggggatcggccttatccgcccgaccaccggtcgtctcgaagtgtacgacaatacccggcgctatctggtgatcacccgccatctgacgccgcaaatcctcaaagacctgggcgacaccttccagatcaacaatctcaccttcagtcataccatgccgtccaccgccagcgtcccgctgcgcagcgcggcaggggaaatcctcggctacctgagctgggatccgcagcttcccggcgcgcaggccgctcatgcggcggcgtgggaaatccgccagattgttggcctggtgacgctgttgatcctgatgtttatcctgctgaccagcgccgggctttacaaactgtcgcgcggcgaaaagctggcccgccgcatcgccgtcaccgactggctgagcggcttacccaacaggcgcgcgctgatcgaacggctggagcagcttaatcagtccggcgataccgacaccatcacggtggtgtttatggatctggatggctttaaggatgtcaacgacgtttacggtcatgacgtcggcgacaagctgatcgtcgccgtcgcccgcagcctgagtgaaaaagtgccgccgggcgggatgctgtcgcgcatgggcggcgatgagtttgccatgaccatgcacggcgacaatgctcacgaaaagagcgcgatatttgccatgctggtgctctcctggttcaatgcgccggtgcggctggacgaacgcagtattcacatcaccgccagtatcggcatcgccagcagcgtgcagggcgactgtagcagcaccgagctgttccgccgcgccgacatcgccatgtatcactcgaaaatgaccggtaaaggccgcatcacgcattatgacgcggcgctgaacagcgcgcgcgaacgcaagttgatcatcgagaatgacattcgtgacggtctggaaaacgacgaatttgacgtctggtatcagccgattgtcgatgcccatacgctgaccatgaccggcgtcgaggcgctggtgcgctggccccgtcgtccagccggggcgctggggccggatgaatttatcccggtggcggaaagcagcggcctgatttacgccctcggccagtttgtgctgcgccgcgcctgtaccgatttactggcgatggaagatcttaagctgtcggtgaatatctcccccgcgcagtttcgcgatccggaatttgaagtgaaagtggcgggcgtgctggacaccgtcggttttccggcgcaccgtctgcaactggaagtgaccgaaacctatgtgctggaaaatccggagcgttcgcgtacggcgatcgccaatctgaaagcgctgggtaccggcgtggcgctggatgatttcggcaccggctactccagcattggctatttgcggcgctttaatttcgacaccattaaaattgataaatcgctggccgggctggtagatgcggacgatcaggccgccgcgctggtcagcggcaccgttcggatcgccagcgcgctgggtatgtcggtcactgcggaaggggtggaaaacgaaaagcagatgaaactgctgcgccttgccggttgcgatcggttacagggcttctacttcagccagccgcagccgatttctgtgctgatgccgctgcgtaaacagcggcggggatgatcattcctgcgccagttcgctcagtttttcgcgaaaacccgttactgaaatcgcccggttatccgcccgccagcgatctttcgcggccggggcggaactctgcacgccaattaactgccagccggtgtccgtctggatcatcagcggcgatccgctgtcgccgggcagggtatcgcactgatgggacaacaccgaagtctgcgcccagccggtcaccacgcaatctttatggctgtacaacgcatccagatgatcctgcggatacccggactgggtaacgtggcggccggtcgtttttagcgctgccgttaatgcctcgcgatcgccggtaaacagcggcagaggggtgatgccggacggcggatagcgcagcacgataagcccaaaatcccagggggcggcggaagacggtacgatccagccctcgccgtcaggcttcagacgtttgccgagagacggatcgacacggccttcaatgccatggatctcataccgccagatgcctttttgcgccacaaaacgcagcgccagcgctttatccggcttgccgtcgggcggcgtcagcagacagtgcccggcggtgagcgccagatgcggggagatcagggtggcagtacataaattgccgctgacggtttccagttgcccgattgcatcccagggggactgctccggttgcgtgacgcgggtacgatcgtcatgaccgaaaaatagcgttttcacctcaccggcattcatcgcctcatcatcgccttcatcagcatgcaggactgcggaaaataaacagaacgttcccagtaacaacacaacagttttacgcatagcacactctggtggggtaattatgattattaaaagtaacccaatgtaagactaactatagacgggaggcgtggaaagtgggagtaaaatcagcgtactacaatcaggaaaaatagaaatgcgtggcaacgattgcgcataaaataagcgtgatgagaattaactcaaaccgataacgccccagcatacgccctccggataaaaaacggcgcttaccagaaagctaagcgccgtgttattagcctgcccggacatgcgggcagataacattgctacaacttatgcagcaggttgtgcggccggttttgcggcttcatgttttacgtgttttttgtgatgctttttagcggcctgagctttttgctcagcagccggtttagcagcggcttttttgtggtgctttttagcagcctgcgctttctgggcaacggcttttttgtgtttcttgtgttttgccggggcagttttggtcgcagccggagcctgagcagtggtcgcggtagcggccggtgcagcagtggtggaggtggcagcatcagcagcgaaagcggcggaagacagacccatagcagcggcaacaaccagagctaatacttttttcatctcgtgatcctcgaattggtttcaacattcaaccccactgcggggccgttgaaaacactatatccctgataattcgcggcttccgtgagtcattggtatcggcgtgtaaccatatgtacaacgccgggtatgatgacccggcgcgtggaggcgttacagataacgcgcggtgagatgctggcggaaatagcggctgttcagcgcttcgccggtcgcgttttcaatcagttgcgacgtggtaaagcggctgccgtgctgccagatattctgccgcagccagtcaaacagggcggtgaaatccccctgcgcgatggcggcatccagatccggcagggcggttctggcggcgtggaacagctgtgcggcatacatggcgcccagagtgtacgacgggaaataaccgaagccgccatccgtccagtgaatgtcctgcatacagccatcacggtaattgcctcccgtggacagccccagccagctctgcattttctcgttccacagcgccggaatatcctccacctcgatgtcgccgttaatcagcgcccgctcaatttcatagcgcagcaccacgtgcgccggatagctgacttcatccgcatcgacacggatataacccggcttaacgcgctggttccaggcaataaagttgctttcgctgaaggcgggctgatcgccaaagcgctgcactaccgacggcaacagctgcttcaggaaggcggcgctacggccaagctgcatctcaaaaaacaggctctgggattcatgaatggcggtggagcgcgccagcgccaccggctgccctggccaggtacgcggcagattttgctcgtagcgcgcatggccggtttcgtgcaccacgcccagcagggcgcttaacagctcattttcgtcgtaacgtgtggtgatgcgcacatcgtccggcacgccgccgcagaacgggtgggcgctgacgtccagccgcccgccgttaaaatcaaatcccaggcgcgccatggtttcgacgccaatctcccgctgtaaatcaaccgggaacggcccctgcggcgcgatcagcggctgctgtgcctgtttctccaccacccgattcagcagatccggcagccaggattttaaatcaccaaacagcgcgtcaaggcgggcgctggtcatatccggctcataaatatccagcagggcatcgtaaggcgagcagcccttagcgtcggcgcgcagacgggcctcttcgcggctgagcttcaccacctctttcagattggcagaaaacccggcccagtcgttggccggacgctgactgcgccaggcgtgttcgcacttgctgcccgccagcgattttgcttccaccagcgcttccggcagcagcgccgcctgttgatactggcgggtcatctcgcgcaggttagcctgttcaatatcattcagattttcttgcgccgcgccttccagccataccgcaacatttttatcggtgaggatctggtgttgcagcacgctcagttccgccagcgcttcgccgcgcgcctggctaccgcccggcggcatcatggtgaacatgtcccagccccccatcgcggagagatgagaaaaacgggacagacgggtaaaaatgcgggtgagttgctgatagttcttattttccataatgcctcatgtcatcgaaggggctgcgaaataatcttacttgagtaaattcttattgggtaatttgatttccatcaaacgaaagttgtgtttttttcaggaagggtaatactgtgtcataatagataaagttcatgttaaccaacaacataagaattcgatgttatgaatccattttattgggtgatattggtagtcttgacgctggatgcggtccgtgaattgatgggtgtatcatccgtaatgggaatattttcgtaagcagacgtgcaagccgggttagcgcaacgccacccggcaaagaaagctaatcaatccagacgccggtgcaggcagcgccccaccagcagggcggcgatcagcagcagcgcgataaacccgcccacgccattccagccgaaacgatgccagaacacgccgcccagcgtgcccgccacgcttgatcccagataataactgaacagatacagcgacgatgcctggcctttcgcccgtcgtgcgcgcggcccgatccagctgctggccaccgaatgcgcggcaaagaaaccggctgaaaacagcagcatcccggcaaaaatcagccataacgaagccagcagcgtcagcagcacgcccgccagcataatggcggtggagccgagcatcaccgggccgcgcccgaaccggctggtcaacatgcctgccttcggggaactccaggtgcccgtcagataggccaccgacagcaggccgacaatcgcctggctgagatgccagggcgcctgcatcaggcgatagccaatatagttaaacagcgtgacaaacgcgcccatcagcagaaaaccggtgacaaacagcagcggcaggccgcgatcgcgccagtgcaggcgaaagttaatagcaagcgtcctgggtcgcaagggcgtcggacgaaagtggcgcgagtccggcagaattttccagaacatcagcgccgccgccagcgcaaagcagccaatcacgcccacggcgatacgccaggaaaaaaaatcggtaaacacgccgctgagcagacggccgctcatgccgccaatggagttgccgctgatgtacagccccatcgagaacgccacaaaactggggtggatctcctctgcaagccaggtcatgcctactgccgccacgccgcttaacgacaggccgatcagcgcgcgcataattaaaatgccgtgccagctggtcatgaccgtcgagagcagcgtacagcaggaggccagcagcaacgcggtgaccatcaccggtttacggccaatggcatcggagagcggaccggtaaacagcagaccgatggccagcatgccggtggaaatcgacagggaaatactgctgctggcaggggacacgccgaactcctgcgacagcaccggcaggatcggctgcacgcagtagagcagggcaaaggtggcaagaccggcggaaaacatcgccagggtgacgcgtacaaacagcgcgctaccgcgtttaatccagggggcgggccgggagagcgcctgtacaccggcatcgctggccgcagcgatgtcaacaggggttgtatgactcacagaacatccttaacttcacatccccgtgattcagggtgacgggtaagaccaccgccacagggtaggaaaatgtaaatattctgtctaatatattaatcctctcaaataatatgtttagcgaatgaatatagaactacgtcacctgcgctattttgtcgccgtcgccgaagaactgcactttggtcatgcggcggcccggctgaatatctcccagccgcccctgagccagcaaattcagatcctggaacagcaggtgggcgcacggctgctggcccgcaccaatcgcagcgtggaactcacgcccgccggaaagcagtttcttgccgattgtcggcagattttaagtcaggtggaggacgccgccgcccgcgccgcgcggctgcatcaggggcagaccggggagctgcgcatcggctttacctcctctgcgccctttatcaggccggtctccgatacgctgtcgctgtttcgccgccgctacccggatgtgcatctgcaaacccgcgaaatcaatacccgggaacagatagcgccgctgcatgagggggccctcgacctggggctgatgcgcaacacgcagctgccggacacgctggcctggcagatgatcctgcgcgagccgctgctggcgatggtgccgcgtgatcatccgctggcggcgaaaaccagcgtaacgctcagcgaactggcgcgtgaaccttttgtcttcttcgatccgcaggtcggcaccgggctgtatgacgacatactcgggctgctgcgtcgctacgggctgacgccctttattgcgcaggaagtcggggaggcaatgacgatcatcgggctggtagccgccgggctgggcgtgtcgatcctgcccgcctcctttaaacgcgtgcagctggacgaaatgcgctggctacccatcgcggaagcggatgcggtgtcggaaatgtggctggtatgggcgaagcatcatgagcagggatcggccgcggcgcgtttccgggaacagctgctggcgaccattcagtaaatttattcatcaaagcgaagggtaaaatgtgcggtaaatcacaaggctaatcaaaaatttgacggcctcattgaactgcttcaccatagcccacagattatttcgaagctcgaaaataagggagtcttaggtggttgctgatagtcagccagggcatattgatcagattaagcagaccaacgcgggcgccgtttatcgcctgattgatcagcttggcccggtttcgcgcatcgatctttcacgcctggcgcagcttgcgccagccagcatcaccaaaattgtgcgcgagatgctggaggcgcatctggtgcaggagacggaaatccaggagccgggcagccgtggccgtcctgcggtcgggctggtggtggaaaccgaagcctggcactatttatcgctgcgtatcagccgcggtgaaattcatctggcgctgcgcgatctgagcagcaaactggtggtggaagagcagcagccgctgccgctggtgtcggatgaaccttttatctcccgtgtcattacccatatcgatcagttctttatccgccatcagcatcagcttgaacgtctgaccgctatcgccattactctgcccgggatcattgatacggaaaatggcatcgtccaccgcatgccgttttatgaggatgtcaaagacatggcgctgggcgaagcgctggaagcgcacaccggcgtgccggtctacattcagcatgacatcagcgcctggaccatggccgaggcgctgtttggcgcctcccgcggcgcgcgtgacgtgatccaggtggtcatcgaccataacgtgggcgcgggggtgatcaccgacggccgcctgttgcatgcgggtagcagcagcctggtggagatcggccacacccaggtcgacccttacggcaagcgctgttactgcggcaataatggctgtctggaaaccatcgccagcgtcgacagcgtgctggagctggcgcagcagcgcatgagccagtcaatgagctctatgctgcacggcaaaccgctcagtgttgaatccctgtgtcaggccgcgcaggacggcgatctgctggcgaaagacattatcaccggcgtcggcaccaacgtgggccgcatcctggcgatcatggtcaatctgtttaacccgcagaaaattcttatcggttcgccgctgagccacgccgccgacatcctgtttccggccatcagcgactgtatccgccagcaatcccttccggcctacagccggcatatggtggtggaaagcacgcagttctcaaatcaggggacgatggcgggcgcggcgctggtcaaagacgcgatgtataacggttctttattgatacgtctgttgcagggttaacatttttcttactgacgtaagaaaaattgcgctacctcaagccgactccttacgccttaacgtagacttccgccactgaattattattctgattaatatttccgaagcataacggtggagtaagtgatgcttaagcgtttctttataacgggtacagatacctcagtcgggaagaccgtggtttcacgtgcattgctgcaggcgctggctgccagtggcagaagcgtggcagggtacaaaccagttgcgaaggggagtaaagagacgccggaaggaatgcgcaataaagatgcgctggtactgcaaagcgtctccagtattgatctgccttatgaggcgttcaatcctatcgccctgagcgaggaagagagcagcgtggcgcacagctgtccgatcagttacagcctgttaagcagcggcctcgcggcccttggcgaacaggttgatcatgtggtggtggaaggcaccggcggctggcgcagcctgatgaacgatctgcggccactctcggaatgggtggtgcaggagcaactgccggtagtgatggtggtggggatccaggaaggttgcatcaaccatgcgttgttaaccgcccaggcgatcgccagcgatggtctgccgctgataggctgggtggcgaaccgcatcaatccggggctggcccattacgccgaaatcatcaacgtgctgagccgcaaaattccggcgccgctgattggcgaacttccttatctgccgcgcgcggagcagcgcgagctggcgcagtatatcgatctgctgacctttaaccgcacgctggcggcggatcgcgttctggcttaagctggactgcccggcggcgctttgcttgccgggcctactgattgtcgcaatcccgtaggccgggtaagcgcagcgccacccggcaaattcagcagcgccacccggcaatacgctcaactgtcggtatgaatatttaacgcccggcgcgttctgccggagcttaaataatcggcgatataatcctgcgaaatctcgccgttataacgaccttcctcatcgacaatcggcatccagctggtattgctctcatagagttttgacagcaccacgcgcaggttatcttccgccttaccggtgacgcggaatggatgcagcagctgcgcgcagtcgccactggcgttacgcgcttcacgacgcttcacaaagccgagcggcttgccgtccacatccaccacggtaatggcgcgaatatcgttctcatccataatggcgaaggcttccgccagcggggtggatttgcgtaccgtcagcgtcggctgttgatcggtgacgtctcccgccgacaccagcagcaggcgcttcagcgtgcggtcctgaccaacaaacgaaccgacaaactcattcgccggtttcgccagcagttcatccgggctggcgcactgcacgatgcgtccctgacggaatacggcgatacggtcccccagcttcagggcttcgtcgatgtcatggctgaccagcatcaccgtctttttcagcttacgctgcatgtcgaggaactgcgtctggatcacctcgcggttaatcgggtcgacggcgccgaacggctcatccatcaacagcaccggcggatctgccgccagcgcgcggatcacgccgatacgctgctgctgaccgccggacatctctttgggatagcggttaaggaattttttcggatccattgccaccatatccatcagctcttcggcgcggcttttataacgcgcgcgatcccagccgagcatgcgcggaacgacggtaatgttctcctcaatggtcatgttcggaaacagaccgatttgctggatcacatagccaatgttgcgacgcagggtgacggtatccatgccggtggtgtcttcgccgttaatcaaaatcttgcccgcgctcggggcgatcagccggttgaccattttcagcgtggtggtcttgccgcaaccggacgggccaagcagcacgcacatttcgccttccggcacattcaggttgacgttatcgacagctttaaaggtctggccgtttttctgtgtaaattgtttggtcaggttttcaagttttatcattatcgtattcctttcggtgtcagggcggtctgcaaacgatgcagcagccagtcaagcacaatagccagcacacaaatcatcaacgcgccggcaattaacatacggatgtcgctgccgccgatgccgttcagcagcagcaggccgaggccgcccgcgccaatcacagcggcgatggccatcacgccgatattcatcacgacggcggtgcggataccgccgaaaatcaccggcaacgccatcgggatctccacccagcgcagacgctgccagaaggtcatgccgataccgcggcccgcttcacgcagaccgggcggcagactgtccagcgcggtatgggtgttacgcacaatcggcagcagcgaatagagaaacaccgcggtaatggcgggcagcgcgcctataccttgtcccaccagcgaaaacaccgggatcatcaggccgaacagggcaatcgacggaatggtcagcagcagagtggcaatgccaagcaccggcgtcgccagccatttgtaccgtacaatcactatacccagcggcacgccaataataatcgccagcccgacggccagcagaaccagccacaggtgctggaaggtcaggctcatcagatagcctgcgttgtccatcatgtaatgaatcgtatccatgggcgctccttacagcaggcctttttcatgcaggaagtcgcgggcgacctgctgcggcgtctggtgctcaatatccaccttcgcgttaagcgtggtgatggcctcgttatccagcaggccggagagggtattcagcgcctcttccagtcccggattagccgccagcgtgtctttacgcaccaccggcgtgacagcgtaacttgggaagaagcctttatcgtccttcagcactttcagatcgaagcccttcacgcggccatcggtggcatacaccagaccggcatcgacaaagccatcgcggatggcgttatacaccaggcccggatccatctggcggatttgcgggcgatccagttccatctgataggcctgttgcagcggcttcatgccgtcgctgcgcccggcgaattccaggtcaaggccgagcatccagttgttgtcgggatcggttttgcggatgtgttcaattttcgccaccatctccgacatggtgttgatgttttccgcctcggcgcgtttacgctgcatggcgaaggcataggtattattcatgtccgccggtttcagccataccagacccagtttggcgtccagctgtttcaccgtggcgtaggactcctccggtgacatgcgtttattgatatggttgaaaataatcagcgaggtgccggtatattcccaggtcatatccacctgcttattaatcattgcgttacgtgaaatcaccgtcgcaatgttggtctgcggcgtaacctgaaaacctttcttttgcagatactgcaccgtcatggccgacagaatatgctgttcagtaaaactcttggtggccagcaccagcggcgcggcctgcgcctgggcgcttagcagggcaatggcagccataaatcctgccagtcgggtaaaccatttcataccggattccttattcttgttatcaggcagtgtgcgggctgagcacgcgtcccagcgcggcaagcagcgtatcgaggatcagcgcaaagagcgcggtcgccgcagcgccgaggatcagcgtcgggaaatcgttcaggtagatgccggggaaaatcagctcgccataactgctggcgccaatcaaaaacgccagcggcgcagtgcccacgttgatggcggtggcgatgcggatgcctgacagcatcaccggccaggcgttcggcagttccacctggcgcaggctctgccatttggtcatgccaatgcctctggcggcttccagcagcgaaggttgcacgccgcacagaccggcataggtgttacgcacaatcggcagcagcgaggcgaggaacagcgcgatgatcgccggcgtatcgccaatcccgaaaatcaccatcgccagcgccagcactgccagcggcggcagggtgttgccgacgttgaagatctgcatgatgtactccgcaaaacggcggcatgccgggcggctgagcaggatcccgctgggaatgccgaccagcagcgcgaagaacatcgaactgaagacgaggatcatgtgctgttgcccgagatacagcagatcaacctgccgctcgcggatagtttgcaggccgatactccagaccagcagggcgatgacaataagcagcgcggccacaaaaagcagcgcgcgaacaaggggggatctttgcattgcagtgtgtctccctgggtgcatgcgttattgcaacagtctgttgcgtgttgttatgccatgtatcggcagggtgaatgagctatagcaagctgccggaaaggatgccagtgtgcggcaagtttctgatcgggcgaatatttatacgaacagctgccatgccttgcggcgtatagcgcgatttgcgggtcgggaattatcttaaattgcgacggtaaaagtgacgttgtaacagtttgcgtttgggattatcacgcagctgaacaaaaaagccgcacggacgacgccgcgcggctcacagaggtgtggcttatttatacagcggcttttccgccaccgggatcagcagatgcgtttgccaggccgcgagggttaagcgcgtcagttcaccgagcgcctgataaaacggatgggcggcatgttccgcgaacacggcgagccagcgcccggcccacggcagcagatgccaggccagcagctgttcgcattcagcttcccgcttttcttccatcagccaggccgtcatcatcagcagcgtgccgatatgatcttccggttcattttgccccggcgcaaaaacaatgttgttgtcacgcatccactggcgcagcgccagcgtcgagtcgccgaacaggacattttcgcgatccagccacaccgatccccatggcggggcgggtaacgcccaggggccgaggaacaggcgctgccaggcgtccggcagcggttcatcggcagaggcggtaaagcgcgccgccagcggcgtcagcgcatcgggcagtagcggccactgttcctgccaggcaggatcctgaagcgccgccaccagcggggcggcctgttcgctctgcggcgggtagtaaaataacgcgcccagaacccgggcggcaacggcaaacgcctgacgctgtgcgtcatccataaaacactcctgatttatccaccaaccgccataccgacggtcatatgtaatccgtaaaacaggccacggcccagcagctcgcccgccagcaccaacagcagcccggccagcaaactgaacacctgtggctcacgacgccacagcagcgggcagatccagcagcccagcccggcggcgagcagcgccagacgccagacctggagcgcggcataatccggcaccagggcggctgcctgctgtactgacgacgagatcgtggcgagatccgcagtctgcatgatcaccaccgccacgcttgccagcagcgccagcacgctgataaaggcaaacacgccgccgttaaaggggatacgcgccagacgcagcaacagcgccgccagtaacgggccgctcagcagcacggtgaggaaaaacgcggcggtggtgtaaccgttatgccaggtcggcacggtgtcgatctgatacacccggctcatggcatacacaaacacgacgccgagggccatgctgacgacaagccagatcctgcccagggcttcaggcattttgccgattaccgccaccagccaccacaggccgccgacggcgaaaaacagcgatccggcggcgatctcgttgctcagcgccgacgcgccgatgcggttcagggaattaaatgcccgcaggggcgatcccagatgcatcatcgaggcgataaagcccacgcccatcagcagccagaggaaaaacaggctgcgggtaagccgggcgcggttttcgctgttatcggcgcacgccatccagccgagcccgccgacgataagcgcgccggtgacgcactggccgatgacggtaaataacaccagcggccattcatgccatccgttgcccatctcacacctcctgcgggttagccagaaagccggttttgtccccggtggggcggctgttggcgttgggtttgatcacgatattaggctttgtaaaatgcccggacggcagcggggcgacggcatcaaggctgccgtatttttcacgcagctcgtcaacgggcgcaaagtccagcgcgcgcagcgggcaggactcgacgcagatcggctttttgccctccgccacccgcgaatggcagccgtcgcacttggtcatatggcctttagcggcgttgtactgcggcgcgccgtacgggcaggccatatggcagtagcggcagcctatgcacacttcttcattcaccaccacaaaaccgtcgtcgcgcttgtgcatcgccccgctggggcagactttggtgcaggccggatcggcgcagtggttgcaggcaatcgacaggtaatacgcaaagacgttctgctgccagacgccgttgtcttcctgccagtctccgcccgcgtattcatagatgcgacggaaactgacctccggggtcaggtctttgtaatctttgcaggccagctcgcaggttttgcacccggtgcagcggctggaatcaatataaaagccgtactgagttgtcatgggttactccttaaaccttctcaatttccaccaggttggtgtgctgcgggtttcccttcgccagcggagaaggacggtgcgtggtcagagtattgatgcaggcgccatgatcgatgcggtcgcccgtcatattggcctgatgccatgcgccctggcccatggcgctgacccccggcatgatgcgcggcgtcactttggcggcaaggcgcacttcgccacgcccgttaaatacccgcacgatatcgccatgtgaaatgccacgctgtttcgcgtcgaggggattgatccacacttcctgacggcaggcggcctgcaacacatcgacgttgccgtagctggagtgggtacgggatttatagtggaaaccaaacagctgaagcgggaaggttttgcgttccggcgaatcccagccttcaaaggtggcggcatacaccggcagggggcttatcacttcatcttttgccagctgccagcttgcggcgatctccgccagctgcgcggagtaaatttcaattttgccggacggcgtttccagcggattcgcctgcggatcttcacgaaactttttataggcaacaaaatgcccctgcggatccttgcgcttataaatacccatcgctttgagctcgtcatacgccggcagcagcggatctttcgcccgcatcttcgcgtataaataatgcagccattcttcctgagtgcggccttcggtaaagcgctgaaagacgtccggccccaggcgttttgccacttcgcttaagatccagtaaatcggcttacgctcgaatttcgcggaggtggcgggctggatgaagatcagataacccatatttcctgcgtaatcgttgggaataatatcttcctgttcgacggtcatcagatccggcagcagaatatcggcatattttgccgacgaggtcatgaagttctcgatcaccacgatcgtttcgcattttgactcgtcctgcaaaatctcgtgggttttattgatgtctgaatgctgattaatcagcgcgtttcccgcgtaattccagatgaacttgatcggcacgtccagcttgtctttaccctgcaccccatccccggtggcggtcatctccggcccacgggcaatggcatcggtccaggtaaaacaggaaattttcgttttcaccgggttttccagtaccggcatgcgttcaatggtgagggtgtaagtggattcacgcgcgccgctgttgccgccgttaatgccgacgttgccggtgaggatcggcagcatggcgatagcgcgcgcggtcagctcgccgttagcctgacgctgcggtccccagccctggcagatatacgcgggttttgcggtgccaatttcccgcgccagtttaataatgcgatcggcgggaatgccggtgatggcggcggcccactgcggggttttggcgataccgtcgttgccgtcgcccagaatatacgccttataatgcccgttggcgggcgcgccttccggcagcgtgctttcatcgtagccaacgcagtagttatccaggaaaggctggtcgacaaggttttcgctgatcaacacatgggcaagccctgccaccagcgccgcatctgtgccggggcgaatggggatccactcatcttcacgcccggcagcagtatcggtgtaacggggatcgatgacgatcatgcgcgcattcgaacgatcccgcgcctgttcaaggaaatacgtaatgccgccgccgctcatacgggtttcggccgggttgttaccgaacatcaccaccagcttcgtgttttcaatgtccgaggtactgttgccttcattactgccataggtgaagggcatggcgcgggcgatctgcgcggtgctgtaagtgccgtactgacccagaaagccgccgtagcagttcatcagacgcgccaccagcgaagcggaaggggatgagcgggtaatattgccgccgacaatgccggaggagtaattaatatacaccgcctcgttgccgtatttttccaccacgcctttgagattcatcgcaatggtgtttaatgcctcatcccaggagatacgttcaaatttcccttcgccgcgtttgcccacgcgcttcatcggataattaagccgatcagggtgattaatacgtcgccggatagatcgcccgcgcaggcaggcgcgtacctgatgattaccatagacatcgtcgccagtattatcggtttctacccagatcacttcgtcatcacgcacatgcagacgcagggcgcagcggctgccgcagtttactgaacatgcgccccagacggttttatcggcactttctttcacagcctgctgcaccgcggcggcggcctggcgcagaccaaaaggtaatgtgaaaccaccggccgccatgacaagcgcaccagctgcagaggatttaacgagggtacgccggctgataccgccggtattatcgacatcggacatcgctcactccctgtttttataatgaatagcattacagctgaaatagttatcagcctgaggaagtgtgagggtactaataagggagtagaaaggtattatcagaggtcaatgtttaagaaattccccctgtaaagacagggggaataagtttactggggttcggtgcgggcgccgtcgctggttgcggtgctgcccgaggcggcgctcatccccccggtgcgggtatagaggatcttccaggtatcattggcgcaatggccgaccacctgcgcgtcaggtttatccgcctgatcgccggggacaatatccagcgtaaagccggattccggtacgccattattcacgatacgctgcgcaatatcgcttttgacgttttcacaggactccggggcggccataaccggagccgctgccagcattaatcctgcgcataaccagtatgtagctttcataaacgatcccttatctcatgaatttatctacagtttagcagtccgcccgggaagcatcgccgttgcgggaaatctcagaaccttccgcataacaggcgagacgggtgaggcggcaaaccgctgtatttgctactatgagggaatattttgcacctctggtaatctacatgaaaaaaacaatcattctggccgcgctaacggtagcgcttgctggctgtgataataatgcgcagggcccggcttcttttacgccggagatggcgagcttctcaaacgaatttgattttgatccgctgcgtggtccggtgaaggatttcagtcagaccctgctgaatgataaaggggaagtggcgaaacgcgtcaccggtacgctgtcgacggaaggctgttttgattcgctggagctgcacgacatcgaaaataataccggcgtttcgctgctgctggacgctaattattatctcgacggacaaaccaacgagaaaagactgcgtttacaggggaaatgccagctggcggcgttcccggcggcaggggtgacctgggacacggatgaaaaaggttttgtggtgacggcgcgcggtaaggatttgcaggtggattatcgttatgacgccgaaggctatccattggggaaatccaccacctcgaaagagatgcacttacaggtggatgccacgccgtcagcggataagcgtaagaaactcgattataccgccgtcagcgtgctgaacgacaaaccgcttggccatgtgaagcaaagctgcgactacgaccgccacgataacccggtcagctgtaagttgctgatcgtcgatgaaagcgtcaccccggcggtcgaacgtcagttcaccatcaaaaataccatcgcttattactgatcccgccgcctactgtgctgtaggctttaacagcgtcctgccgggcgctttatgctcggcaagatactgatgctggaaaatacacatgcggatggtgttgcgatactcgccgttaatgaagaactcatggatcagttcgccttccaccataaatccgagcttgcgataaatatggatggctttctcgttttctttatcgacgatgagatagagcttatacagatttaataccgtaaagccgtaatccatcgccagcttcgccgctttgctggccaggcctctgccctgatgttccggggagataatgatctgaaactccgcgcggcggtggacgtggttaatctccacaagctccaccagccccactttttcaccgtcgcattccaccacaaaacggcgctcgctctgatcgtgaatatgcttgtcatacagatcggacagttcaacaaaggcctcgtacggctcttcgaaccagtagcgcatgacgctggcgttattgtccatttgatgcacataacgcagatcttcacgctccagcgggcgcagcttcacgccgttaatctcactcatggtcaaatccttatgacgaaaatttacggcgcaaccacgcggccggtacgacggtcaagacagcgcagggtgttgttttcccagtaggcattgagattggcgctttgctggcacttatcgcgggcatcaaaagccgcgtcgtctttatcccactctttttccacgcgcttgttcactttgttacgcaatgaacgggtgtcattccactgctctttttccatcaacgcctgctggcggctctgggcgctgtcgccggattcaatgatcagtttgctggtttcagccattgcgccgggggtgaccatcaccgcgcccagcgtcagcatcgccatcaggcacaggcgtttgcgaagagagtttttcatcaggcattccttttaactattgcaggggcatattgcttatattctacaccatcacaagtcggcgacataccggcgtgaggggttatgccgcattaccgttgaccagaagttcactttccacgcggatcacgaaatcggtaaatagcgccgtgggtttaaccgtatttcccttgcgctgcaaatgcacaaaaccatgactctcaagggttttgagggtggtcgacaggttactgacctgacggcccgccagccgcgccagttcgctgattgtttcgggtttatgtgctgccatcatccgtagcagggtgatattttcattgctcaaaatttgcccgatagcattaagcgaggcaaaccagactttcggctcgtccggttccggcgtgtatttaccggcagcgatagcgagcattcttttacgaaggttttcctccgaaatgatgcctataagtgctttcataatgaaccctctatgtctttcataacgctatctacagcggcaaaaaaatcattcagcaactgcgttgccgactgaaaacagtaaacctgtcccggatcgattgcggttgtatggacatggtcataaatcaccattcgtgaccggaaccccccgctacgcggggatgtaatgccatgcgcattgtccatgccaaaaatccggtggttatgagcgttatgcagtgtaaggttgtagcggataccatgaggcctgaaaatcgaggcttcaacccggcgtgcttctattttccaccagtagccattgtcataacgaaactgataaccatccatatcgagtaaagtgctgagtccataatcttttgtatccataaacactccctgtacttatgagcggatcataacaactttatcaaaatacgcaatcaccccggctgcgcctggcgttccgcccgcaactcccgttatgatgcgatactgaacgtaaacagactgactacgccctatgatccggacctcactgcttttttttatcaccgcgctctgtgaaattattggctgttttctgccctggctgtggctgaaacgcggtggcagcgcattgttactgctgcccgcggcggtatcgctgtgcctgtttgtctggctgctgacgctccatccggcggccagcgggcgggtttatgcggcctatggcggcgtgtatgtattcaccgcgctgatctggctgcggctggtggatggcgtaaagctcagcctgtatgactggctgggggcggcggtggcgctgtgcgggatgttgattatcgtcgccggatggggccgcgccggttaatccacgctcagaacgagctgcggatagcgttccagccagcgtttgcgcctgatccgttcatcaaagatggcgcgtttctcctgctgaaaacgcggcgtggggcgcagccgcagggcgaacagatcgtccaggccaaagggcgcgataatatcaatttgatcggatccgcaaagccgcacggccacggcggtggcggtttccggccagtagcgcagggcatcttccacgctgtgataaggccggtcgtgattacgttcatgcatccgcgcctgattttttaccgaccagtcaaagtccgggcgcatctttctcaggcgctgttccagaagattatcaatctcttcaccggtttggcgggcatcaaaccacaccacatccacatcaccgcatggcggccgcgccggtcgctggtgcaggcgatcccacaccgcatcacgcaccagcccggcgccgatccagccattctccaggcccagcgacgccacagttttgagggcttccatacgtagcgcatcctgcaatagcaggcgacgcagttcatcagcatggcgcatcgcggcattcctgttcactcatggggatcttcattctaccgacagaggcgtcattttgtgagccagcgcgaaaaaacagatcttcatacttgtatggtagtagtgcggatggttagatttcatgcatcacaacaaaagaagcaggaattctcatgaagattgttagtgctgaagtatttgttacctgtccagggcgaaattttgtcacgctgaaaatcaccaccgatgacggcattaccgggctgggggatgcgacgcttaacgggcgcgagctttctgtggcctcttatctgaaagatcatgtctgtccgcagctggtgggacgagacgcgcaccgtatcgaagacatctggcagttcttctataaaggcgcgtactggcgtcgtggcccggtcaccatgtcggcgatttcagccgttgatacagcgctgtgggacatcaaagccaaagccgctggtatgccgctgtatcagttgctgggcggcgcatcccgcgatggggtgatggtttactgtcataccaccggccattccgttgatgatgtgctggaagactatgcccgtcacaaggagatgggctttaaggcaatacgcgtacagtgcggcgtgccggggatgaaaaccacctatggcatgtcgaagggcaagggcctggcctacgaaccagccaccaaagggcagtggccggaagagcagttgtggtcgacggaaaaatacctcgatttcacgccgtcgctgtttgccgccgtgcgcgaaaaattcggctttaacgagcatctgctgcatgacatgcaccaccgtctgacgcccatcgaagcggcgcgctttggcaagagcatcgaagagtaccgtctgttctggatggaagatccgaccccggcagaaaatcaggagtgcttccgcctgatccgccagcataccgtgacgcccattgccgtgggtgaagtatttaacagcatctgggactgcaaacagctgattgaagagcagctgatcgactatatccgcaccaccattacccatgcgggcggcattaccggtatgcgtcgtatcgctgattttgcctctttatatcaggtgcgcaccggctcccacggcccgtcggatctgtcgcccatttgccacgctgccgcgctgcatttcgatttgtgggtaccgaactttggcgtacaggaatatatgggttattcggagcaaatgctggaagtcttcccgcataactggacgtttgataacggctatatgcatccgggagataaaccgggccttggcattgagtttgatgaaaaactggcggcgaaatatccctacgatcccgcttatttacctgtcgcgcgactggaagatggcacgctctggaactggtaataaacagataatcgtcagccagggaaggccataatatccaccctacacgaaaggtaattatgtgatggtcagttcagtcgatataaaaagcgatggtgataataccccattaattcggcgtgttgcgtctgcgtctgccattggcaccgcagcagaatattatgatttctttgcctacggcacggcggcggtgctcttttttggacacttattttttccaagcgatgatcctttaatcagtaccctggcggcttttgctacctatgctgtgggatttctggcgcgtccattgggcggcattgtatttggtcatattggcgataaagttggacgcaaaaaggcgcttgtcatcaccatccttattgtggggttagggacattctgtattgggctgctcccgacctacgagaaaatcggtatctgggcacctgtgctgttaattttaatccgtatccttcagggctttggcgtcggaggtgaacaggccggggcggtactgatgacggcagaatattctgctccagagcggcgcggattcttcgccagttgggtgcagatcggcgcgccggtcggttttttattgccgctggcattatttgctatcctgaacgccacgctcactgcagaagccatgatggattacggctggcgtattccattcctgcttagcttactgttggtgatcgtgggactgtttattcgactccgtattgatgagtcgccggtatttgcccaaatccgccaaacgaaggccgaggagtcacgtccgttggttgaggtgatccgcgattaccccggcattgtgacaaaaggcgtctgcgccaaattgatcgaagcctgcacctttgccatgtttaccgttatcgtgctggcctatggcaaggcgaataatctcgacgccaatatcctgatggaaacgatgattgtcgccgttattctggaagtgatcgccattccactgatgggcgcgctgtgcgacaaaataggacgcaagccggtttatattactggtgcattactccaggtcattatgattgtgccgttctttctggctattaatcaggacagtttctggctcacgcagttagtgatgatcattgtactcagcgtcggtcacagtatgtgttatgcgccacaagcctcttatttcccggagttattcccgacacatattcgttgtagcggcatcgcgttaatctggcaaataggttcattaatcggtagcggagtattaggtctggtggcagtgaaaatattacaggttactggtgggcattattacggcctggcagcctacgtcattgtgcttggtattgtgtccattattggccttttgttaatgcccgagacagcaccttccaggcgagacgctgaataccacgaatggcagcaacattaatattccggcaagtcatttatagcgcatttgctgacgaattattcagagagtaatgaccatgaaaagtatcgtgattgaaacacccaataagctgctgattgacgaacgcccgttaccagaacccgcagcgggtgaagtgcgcgtcaaaataaaactggccggtatttgcggctccgacagccatatttaccgtggtcataacccctttgcgaaatacccgcgggtgattggccatgaattcttcggcgtcatcgatgccgtgggcgagggcgttgacgccggacggctgtgcgagcgcgtgtcggtcgacccggtgatcagctgcgggcactgctatccgtgctcggtcggcaagccgaatgtctgtacctcgctggtggtgctgggcgtgcaccgcgacggcggtttcagtgaatatgcggcagtccctgcgaaaaacgcctggccgatcccggataccatcgccgataaacaggcggtgatggttgaaccgttcaccattgcggcgaacgttaccggccagattaatcccggcgagaacgacatcgccctgatctacggcgcaggcccgatggggctgaccaccgtacaggcgctgaaaggcgtctaccgggtgaagcaggttatcgttaccgaccgcatcgaagaacggctggagatggcgaaacgcagcggcgcggatctggtgatcaacaacggcaacgcctcattgcaggatgcgctggatgcacagggcattaagccgaccatcattattgacgccgcctgtcatccgtcgatattgcaggaagccatcggtctggcatcccccgcggcgcgaatcgtgattatgggcttttccagcgaaccttcacaaatcgtgcagcagggcattaccggcaaagagctgtcgatattttcatcgcgcctgaacgcgcacaaattcccggtggtgatcgactggatacgcagggggcttatcgatcctgacaagcttgtcactcatacctttgactatcagcaggttaccgacgccattgacgtgttcgagaaagaccagcggcagtgctgcaaggtcttactgacgttcccgcaataacaacaataaatgcgagtgagtggtacgcatcttactatttcagagatagccattatgacccaagtaaacaatgaaagaacgacgtccgacctggtgaaagccgccgtttctggctggctgggtaccgcgcttgagtttatggatttccagctctactccctcggggcggcgctggtgtttcatgaaatcttcttcccggagcagtcggcggcgatggcgctgatcctggcgatgggaacctatggcgcaggctacgtcgcgcgtattgtcggcgcatttttcttcggcaaaatgggcgaccgcatcgggcgtaaaaaagtgctgttcatcaccatcaccatgatggggatctgtaccacgcttatcggcgtgctgccgacctacgcgcagattggtattttcgcgccggtgctgctggtgacgctgcgtatcattcaggggctgggcgcgggggcggagatctccggcgcgggtaccatgctggcggagtatgcgccgaagggcaaacgcgggatcatctcctcgctggtggcgatgggcaccaactgcggcacgctgagcgccaccgcgatctgggcctttatgttcttcgtgctggatcgggaagaactggtagcctggggctggcgtatcccgttcctcgccagcgtggtggtgatgattttcgccatctggctgcgcatgaatttgaaagaaagtccggtgtttgagcaggttaacgaaggggaaagtattcctgcgaaagtgcaggcatctgaaaccaccctcggggcgatgttcagcagtaaaaccttttggctggcgaccggcctgcgttttggtcaggcaggtaattccgggctgatccagaccttccttgccggttatctggtgcagaccctgctgtttaataagagcatcccgacggacgcgctgatgatcagctcgattctgggctttctcaccatcccgctgctgggctggctgtcggacaagattggccgccgcctgccgtatatcctgctgaatatctcggctattgtgctggcgtacccgatgatttcaatcatcgtggataacagctatacaccgggcgtgatcatggcgtcgattattgtcatccataatttcgcggtgctcggtctgttcgccctggaaaacatcactatggccgagatgttcggctcgcgtaaccgctttacccggatggcgatctccaaagaggctggcggtctggtggcggtaggcttcggcccggtgctggcggggatcttctgtaacatgaccggttcctggtggcccatcgtcgcgatgatgatggtctactcggtgattggtctggtctccgccatcctgatgccggaagtgcgcgaccgtgacctgagcattcgtgaagatgccgcagagaaaagggcgcagcagagcgtggcgggtgtacgtcgtccggtctgactaagcatcgcataaccatgcaggcgctgaatgattaaagcgcctgcattttgatacatttagttaccattctagttggtgtagtcagcaaatcctgtttcaggtcaacattccgctgacgggcatccgtcatcttatggaccagtgtttcatttaataagacgagtctcatccatggaaaacagactgttaaacgcgaaagccacgttaccggcttacgatcgtaatgcgctggtgccgcgcattgtgcacctcggttttggcgcgttccatcgcgcacaccaggcggtgtataccgatattctggccgcagaacaccacagcgactggggctactgcgaggtgaatctgattggcggcgagcagcagatcgccgaccttaacgcgcaggacaagctttataccgtggcggaaatgtccgctgacgcctggaccgcccgcgtcgtcggcgtggtgaaacgcgcgctgcatgcgcaggtcgatggtctggaagccgtgctggcggcactgtgtgagccgcaggtggcgattgtctccctgaccatcaccgaaaaaggctactgccactccccggcgaccgggcaactgatgctcgatcacccatttattgtcgccgatctgcaaaacccgcagcagccgaagtccgcgcccggggtgattgtcgaagcgctggcgcgccgcaaagccgccggtctcaatggcttcaccgtaatgtcctgcgacaacatgccggaaaacggccatgtgatgcgcaatgtgatcaccgcctatgcccgcgcggtggatgcaaatctcgccgactggatcgacactcacgtcactttcccgtccaccatggtggaccgcattgttccggcggtaaccgccgaaaccctggataaaatcgggcagctcaccggtgtgcgcgatccggctggcgtggcctgcgagccgttccgtcagtgggtggtggaagataactttgtggccggacgtccggcgtgggaaaaagccggagccgagctggtggcggatgtgctgccgtttgaggagatgaaactgcgtatgctgaacggcagccactccttcctcgcctggctgggttatctggcgggttatcagcatatcaacgagtgtatggaagatgataattatcgccgggctgcgcacaagctgatgttacaggagcaggccccgacgctgagcgtgcagggtgtggatctggcgcattatgccgacatgctgatcgcccgctacagcaacaccgcgctgcgtcaccgtacctggcagatcgccatggacggcagccagaaactgccgcagcgtatgctggactcggtacgctggcatctggtgcataacagtgacttccggctgctggcgctgggtgtggcgggctggatgcgttacgtcggcggtgtggacgagcaggggcagccgattgaagtctgcgatccgctgctttcggtcattcagcaggcggtgaagggcagtgcagaaggggaagaacgggtgaaagcgctgctgggcatagaggcgattttcggcaacgaactgccccatgaacatgcgtttgtcagtgaagtgaatcgcgcgtaccagttgctgttacgccagggggcgaaagccacggtggcgcagtacgcggcataacgtaaaaagccgggtggcggcgatgccttacccgacctacttattacgattttatcgctcacatgccgggtggcggctgtgccttacccggcctgggttctgaccacgtccacatttctgtaggcccggcaagcgaagcgccgccgggcaccacgtcaaccctttactcttccgtaaaccactcgcggttttcctggcggatcaactgtacggtttcgccgatctcctgcaaatgacgcgtcatcgcccgatccacgccctccacatcctttttctccagcgcggcaaaaatatccagatgctggctgaggagtttttcaggcggcgagacgtgatcaaggctcatgtagcgcacccgatccatggtcgctttaatattttcgatggtgtcccaagccagctggcagtcggcgatctgcgccagtttctgatgaaactcgtcatccagctgaaagaaatcattaagctgcttgcgatctatagcgatgcgctgctgatgcagattctgctcaagctgatagctctggctgtcgttgatcatcgtggccgcgcggcgggcgacggcgcactcaatggcctgacgcacaaaacagccattgcgcacttgctgcatggatattttattcacatagctgccgcgctgcgggcggatctgaataagaccgttttccgccagcttaataaaagcttcgcgcaccggctgacgtgaaacatcaaaacgcaccgagacgtctttttcagacagcggcgttccgggggcgataagacaatgcacaatatcccggcgcagaatgcggtagatttgctggtttacaggctgggttggatttaattgcgtttcagcggccattcgttgtgagttctcagacagttaacccggctaccataccattttttttgcgggcatcccagaaggcgaacgcctccggaacgcccggcaggatcagttgccgtaaaccgcgagcagctctctggccgccagctggccgagtggattggccgcgaacgggctgtcgccggtcagcagatgacgatctttatttacgctgcccttaatatcatcattgatgatattcatccccatcgcttttaattcctcgccaaaataccaggtcagatggccgggcatatagcccatatccggcgtctgtttatcggtggcatccgggaaggcgcagatagaatagccttgcagcggattatcgccgttgcgcagcgacaggaaagccgccgggccatgacacagcgaaatcacgaagcgatcgttgccgatggcccagcgcagggtatcggccaccgcgtcgctttctggcagcccgatcaacgcgccatgacctccagggataaacactgcagcatagtcgctgctcccgttaagtcctttaaccacatcggacagttttgcaggggactggaatctcgcctgatgcttgcggaaaaagggcataatgcacgtatcctgacgcggcatcgcccagtattcaaacttagccatctggcctgaaaccgtcgccacgtcaaattcgaacccggcggcgtgaaggtgccagagcggcaccagcgtttcaactggatgattgcccgtagaaaacaaagcgcccgtgtccgtctttagataacgctcatcggcagcaatcaccaggatctttttgccacccttatgacgagtgggataatcggcatcacttaaatcggaaacctcgctggtaaactcgcccagagaatattctgaggggaaaaaggcattatcttcagcatgatcaatttgtggctgtttacttttatcgttactcatcactcatcctcgctgatatagcatcaattactgtgtgattaattatatgccatgtacaacgatgcagtgaccaggaaaaatccctttaaatataaaagccttatatttactttgtgtgaggatatttcatataaaattcaagggatcaggcgaggtgagtagggaggagtaaataatacatacgccaaaacggcaaccctaatgattaaatcagggtcgccgctactggctgtttcaggataatatgtaactcattaaaaatgcattttcacatttttaatttttacattatatcatgtctgaaacgctattcggattttcttccgccgccatggctgttttgtccgccttttttacctgcttcggaagctttttgctgatcgtttttgaaattcccgccgctatgctggccgcctttgcgacctgcttctgatgccttttctttatcttccgcgaaattaccagaaccgccacgatgttcagtcatatatatttcctctttagataaaataatttgcagtgggaaaaagcacactgcgccatgacaacgctattaaatgtagctcagcctcataaaataacaagcgagaagtccgccagaaatatcacactaagacaattcctataaagatatattctccctggacgataattgcagatgcggtttatagttacataaagagctgtaaaacagggtgttatcgtctggctaaaattacattacagtgaatttacaggtgacgcatgaatatctggtttatacacgctggtggtaaggtaaaagagccattttgcccgttgaggtttggcggccgtatttttttattattacgaagcggcggttcgctatcaaaaccattgatgtggctggaaaaagagaagaaattcttgcgccgcgtataaattatatattctatatttgttcacagaattgtgaggcttcccgtttcgtttagcaggatactggcaggcatattttcactgcaattgtattccgctacatcggggctaagcgaaaaggggttaaacaggaaaaaatatgaaagttcatcatcttaattgtgggtgcatgtgtccggcaggcggcgcgttatttgacggttttagtaagggtatcttcgcccatttggtctgccactgtctgcttatcgaaacggagcgggacgggctggtcctggtcgataccgggttcgggcaaaatgacattcgccagccaggtaaaactttaccaggcttttttcgggtgatgaataatattcagcgacgggaaaccttgacggcgcgttcgcgcattgaagcgctgggattcagcgctgcggatgtccggcacatcattcttacgcatcttgatttcgatcatgcgggtgggcttaccgacttcccgggtgcgcagatccatctgctgcaaaccgaaatcaacacggcgcagcagcggcacagctggctggcccgtgagcgctatcgtccagggcagtggggcggtatctctggctggaacgggtatcaacctcagggcgaaaaatggtatggcttcgaggctgttatggcgctgaaagggctgccgccggaaattttactggttccgctgccgggccacacgcaggggcatgcgggcattgccgtcagccagccgcagggatggttgttgcatggcggcgatgcatggttctatcgcggtgaaatggatctgcaaagcccgcactgtacgcccggcctgcgtttttatcagtggatgatggcgatggataaccagacccggcatcgtacccaacagcaactgcgggaagtattcaaacgttataaccaggaaattactttcttctgcagccatgacgctaaggaactacatgctttcagtgagcatgacgggatgaataaccgagtgtaatattacactataattcatcagggggcgcctcgcccatgtcagtaattttcagggtgaaggatacaggcgcttataaataatgcatttacaggtaatatgtgcagacttaatgtttcaatataaagaaataaggagacgggatatgaatactactctgcaggaatgtatagccgcatgttataaatgtgctgccgcctgtgattactgcgcatcttcgtgccttaatgaacctgatatcgacatgatgagaaactgcattaaaacagatattgagtgttccgcgatttgtcggcttgcggcccaacttatgggcatgaacagcgaatatcacaaacaacaatgcaggctctgtgtggatatttgtcgggcctgtgcagaggagtgcgcaagacatgagcatgaacactgcaaacattgcgcagaagcctgccgccagtgcgcagatgcttgtcttagaatgcttgcctgagcctgaattataccgccgatagctcagcaggaaagagcaactgctttattagcagtgagtccgtggttcaaatcctcgtcggcggatcagcctctgtaggttatatttttaaaaactgattattaaaaaactgattattaatatgtctgctatttcatcctgcttatccattccacacaaaaatccagataggctcgcacgatagcggaagggtgtttatgacgggcataaacaaggtgtaacggcagacaatatttgttgatgtcaggtacaagccgtatcagctctccgctttccagccaggggcgggcagaaaaatccagcagctgggcgatgcccatgccgcccagggcgtaatgaagcaaaccccgggaattattggtggaaaagaacggatcgtatttcactttttccgctcccgaatcccattcaaaaacaccatggttcagactttcccaggccatcaccggcaggcgggccatttctgccagggtctgtggcgtgccgtgacgcgccaggaatgtcgggcttgccacaaacaccgcttccacgtacataacaggtttagcgatcacatcgtctgtatttatttcgcccatgcgcagcgccacatccacgccatcctcaaataaatccacgacccgttcgctggaatgacaaaaaacgttgatatccggatagcgttgctgaaaagcgatcagtaaatcccaccacagtgaaaaatcaggcggcacggacaggcgtaatttgccctgcaacgtatgggcagaggtgaccgccttttgcgcgtcttccagcagttcgacaccgggtcgcgcctgttcatagaattgctgccctttgtaagtgggtttaacgccgtggcgcgagcgttccagaagctgcacgttcagcgcctcctcaagctcattgatcttgcggctcagggtggaaatgggcatgcccattctgtcgctggccgctgaaaagctcccggcattcactaccgtaatgaataattttgctgcgttgtaatccattcttgtttccatatttgggcattatctgtttatttttggtgattccattccattttgcaaagggtaaaattcggactgtgtcattttcaggggatgtaaaaatgaataatcgtgtcactcaaattttaaatattcgctatccacttattcaggccccgttatatttcctgaccaatgccgaactggtcgctgcggtgtcaaatgcgggcggcctgggtacgctggggccgcacgccggtcaggaaagcctgccaggctcacgctgggtggcgctggatcggatgcgcgaagagatccgtaaagtcaaaaaactcaccacaaaaccctttgcggcaaccctgatcaacggcccggatatgggcttctggcggcctactgccgagatgctggctgaagaaggcgtcgaagtggtgcttatcaatgaagtgctggacgcagagatctacgacttttttaaaagccgcggcatcaaaattctctaccgcgccctgacgccgacgatcgccaattcgaaaaaagccgaaaaactgggcgcggacatcatcattgctaccggctttgacgaaggcggcaccgtgccgtcacgggtgattggcaccttcagtatcgtgccgatgatcgtcgacagcgtgaaagtgccggttatcgctgccggtggcatcggtgacgtgcgcggtgtgcgtgccgccctggcgctgggggcggaaggggtatttgcgggcagcctgttcttaacggcggtggaaaaccccgcggcggacaaagtaaaacgcctgattgtcgattccacggcggaagatttgctgctgtttcgcacgctacctgcgtattaccgcaccttacctaccgatctgagtccgacgctggcagaactggacgcgcagggtgccgatcgtgaaaccctgtttaaggctatgaacggctaccactccctgtggcaggccatgcgcctcggtaattttgatcagggcgtggtatccaccggtacgggtatttcggtcatcaaatccattcgtccggccgcagacattgttgccgatctcatgcaggacttttaattaaagaggtaaaccatgtctgatgtaatgccgtttcgggatgttacgcgtgaacggggttacccggacctggagcatcctgccaaccagtaccgcatcgaaaaagcgccgctgggcgaaagcgttacgtttcatcaataagtaacagactcagcagctgccgcagttgctgctgctgagtttcattaagcgtgccctgctgctggggctggggattggcgcgctgtttccgctatcgctgatcgtcacgctcgattacgccatcgcgccgcctcgctggacagcgcctgggccatcatgagcgtcggcatcgtgctggcacggctggcgttgttgtattacggttacaatatcacaaccttagccgcgacagcggaagccaggagtacgccagtgcgcgttttgttcgcccttttattgtcatcgttacttgccggatgcatcacctcatcaccgcaaagagcgctgtataaagcggaatacccgcaccgccaggatattcgtcagcaaaatgtttaccagtttaaaacgacgccgattaaggccagcggcgagcgttactggggcgcgggtgagttaacgcaacttttcagggtcaatgataaagacgcttccaccgttcagcttcgcttcaactatccggcaaaatcactggaagccgtgtcgctggatgcagcaaacagaacgctaagcaaagaaacctttatcttactcgatgagtctgcacccaaaccttccagccctgaaacgaactatttttatctgacaaaagacggccagctggtgcataaaaaccgcaactgcacgcctgacatgagtgtgggttgtcagtggtggaaccacaggctttttatcacacgcaacggagacatggcggtgcattatgaaaatggtagtgctgtgctgctgtttctggttttccccggttacggctcacatgactacctggaaatattctcaaaggtatcgcccgtcgccgacgtcacgccataatttcaaaaatactgtccgcctccggcctgaagcaggctgaggcgggcctcactcataatctgtaactatcgcagcaatacataacgcttccgccggggctgccgataaccgattactccttacattacctggtaaatctgatgcgtatccctgcacttaaacgtttattttccctgaaccgtctgcgttcagccgtttcttataacgcactttgccagaataaacctgtcattgaattcagtccgcaaggggtgatccataaagcgagtccgctttttctctccgcgatgggataccgggctgacgaaattattggtcaacatcatcggttattctgcccgccctcgctggtcaattcgccggagtacgaccagttctggcaacgccttgccaggggggaaagcttcagcggcaaatatctgcgtctggcaaagggggaacgtccggtatggcttgaagccagttatatccccgtcactgaccggcgcggccaggtgacccgtgtcatcaaaatcgcggccgatatttccgcccgcgtgcaggcggcgcttgagcaggaatctgtcgtcaatgccatcagccggtctatggctatcatcgccttcagccctgaagggatggtgctggaagccaacgagaattttctcgccaccaccggttataaacgcgatgaagtgattggtaagcatcatcgtctgttctgttctcagagcctgtataaaagtgatgaataccgccagttctgggagcggttaaatcagggggaattcttttccggtcagttcccgcgcctgaatcgtcgtggcgagccgctgtggttgcgggcaacgtacaaccctgtgttcaaccatgacgggcagctttataaaattgtgaaattcgccaccgatgtcacggcagatgttctgcgcaaccagcgagagcaggaggcggcggtacatgcatgggatatggcggtgcagacccgcggcagtgcgcaggctggcgccggggttatcgaaaacagtatccgaatgattgaccgcattgcgcagggtatgggcgatgtctccagcgatgtttcccggctgaacgatcagtctgacagcatcgacgggatggttgaaaccatccgcagctttgccatgcagacccggcttatcgccctgaatgccgccattgaagcggcgcgggcgggcgcgtccggtcgaagttttgctgttgttgccgcagaagtgcgaacgcttgcggcgagcgtcagccaggcgacagaagacattgagcgggtcgtcgccagcaataatcacctggccaaagaggtgctcagcggcatcgaaaacaacctgatgaatacccgggaaggggtgacgctgatgcgtgaagcgggtgaggtgatcgccagcattcagaagaatgccgccggggtcgagacggcagtgaaggatgtcgccctgtcagtaaaagccggataacgcctaatccgcaccggtgtacggatacgtaaaacatcagttatgcaattgtaataactgctttaattgagcgttgtatccccgggcgggttcttttaacatcgatgatgaaattttaaccccatcccgcaacggctatccagttgttatggaaagatgttcataaggatcaagatcatggaaataagtatccgcacgccgctcatccattctttgccgttaagtcagcacagcggatgtgaggtctggctgaaaatggaatcctcccagccgaccggttcttttaagctcagaagcgcagggcatatctgtcagtattacgcccaaaagggcgctaagggttttatcagttcatcgggcggcaatgccgggatcgccgtagcgcacagcggtcgtaaactgggtttgccggtaacggtcgttgtcccggaaaccacgtcggcgcgcgccagagagcttattgagctggagggcgcgaggctcattgtgcacggaaaggtgtggagtgaagcgaatgagcacgctttatcgctggtaacggatgacattttttatatccatccctttgataatccgctgttgtgggaaggcatcagcaccattgtggatgaagtggtgaatgatggattgcggcctgacgcggtgatcctgtccgtcggcggcggcagtctgctgtccggcatcgcacagggactggaaaaacatcacctggatcatatcccggtgtatgccgtcgaaacccacggcacggcttccctcaacgcctcgctgaatgccggtaagcttgtgcgtcttgataaggtcagcggtattgccactacgctggcggccagccaggtgtgcgaaaatgcctttaccgtggcgcgtcgcctgaatgtcaccggcatggaggtttccgatgaagaagcggtaaacgcctgtcgtcacttccttgatgatcatcgcgtactgacggaaccggcgtgcggcgtttcattgtccctgctgtatgaccgcaaagttcagtttaaccctgcggataaggtgctggttatcgtctgcggcggggcgtcggtgacgcgggaaagtattcaggcctgacggattttgttttcgatacgcacaggctgaatggcagggggtttccattcagcctgtgctgttaaggcctgacactcttagccgcgcgaagcgggcatgtgaatttcctgaattagccctcctgtccttcaaccagcacaaaggtgccggttgcagcaccggctcgtagtaagcgtgcggcctgataccccgggctgtcataaaaacgtttagcctcgtcaaaagagtcgaactcaaaaacaacatgcttttcgtgcgactctccctcaaggttttcatactgcccggaccaggcaataatttttggactgaacccctgcattacctctccggccgcccgggcatattccgcataagcgacaggatcggttacggtcacgtgagcgatgagatagcctttattcatttcttctgttcctcggcaaaaaagcgttacgcgaaatacgcggtgtgaaaagagtctattgagtattaatatcttcataaacaccccaaataatgacgcactgttaccctgagagtgaacaatgaagaaccttgagccgttggtgatttttgcgcgcgtggcagagcttaaaagcttcactcaggccgctgaaagcctggggatccagaaagggcgtgtctcaatggtggttcgcgagctggaacatgaaatcggcgcttcgctgctgcaccggacgacacggaccgtacagctgacggaagacgggcgggctttttattcccgcgcccgtgatctgctgtctgaggcggacgctctgcggtcaatgttcaccgatcccggaatgccattacggggtcggttgcgcgtggatatgcctgctgtgctggcacaaagccttattatcccggccctgccacagttacttgacgctcaccctgaactggaaatagagctttcaagtaccgatcggcgggtcgatctggtgcaggagggatttgactgcgtggtccgtctggggcccgttgtggatgacacgctgattgccaggcctctgggacagttgcgcatgatcaatgcagcaagcccggcctatctggcgcgctgtggtgtcccggagacgatagaggatcttcttagccagaaacaccgaatggttcattacatccggaactttggcgcgaaacccgaagggtgggagtacccgtccggcgatggctataaaacgatcctgctgcctggcgccgtcagggtaaacagtgttccggcctatcatgacgcgggactggccggtctggggctgattcagggaggatactcgtcacttgtcacgcatatcgaacgcggtgcgctgatggaggtgcttcccgatctgcgtcctgagcctctcagcgctgcttttgtcgtcgcacaccgccgcaatctgtcgccgcgtgtcagagcttttatggaatggacggaaggggttttaaaaccttatttcgactgagagctgtgatgagacagggcggatgtgccgccctgtaaaatcatcattcactctctggtaaatcggaacgggtcagtgtcgccctgacctgcggcaggctctgcggataattctgctggataaattcaatcattttttcccgcacgtaacagcgtaaatcaaaggccataggggaattctgcgccgtcatcaacagtctgatggtcatggttttttccgtggtgtcggttacctgaagcacctgagtttcctgatcccagagtcgggtttcactgagcactttttcaaagtgttcgcggagcggctgtaggggcatggagtaatccacataaagaaaaaccgtgcctaaaatttgcgcgttattacgcgtccagttctggaagggattttcggtaaagtaggtgatcggtaataccaaccggcgcagatcccacagacgcaccaccacataggtcaggtttatctcctcaatccagccccactctttttccaccaccacggcgtcatcgatttttatcggttgcgtaaaggctatctggataccggcaaataaattgaccagcgacttctggagcgcaaaaccaatgatgatgcccgccaccccggcaccggccaggatagtggtaccgaattgtcggacgccagggaaactcagtaaaatcagggataaacaaattgtgaccagtaagacaatcgcgaccttcttcacatacatgatctgcgtgcgaattttgcgggcgcgaagattgttcgaaatattaatgtcatagcgtataaaaagcatatcctgcgcaacattaatcagtcgaatcagcaccgaacaaaatgacatgataataaatatgttggttgtcgttctgatgaagttcagtgactcgggctggatatggacataattaatccctacacgaataaacagcaggggaataaagagaaacatcgatccacgaaggtgtttctcaagcgacttgaagagttttctgtcatggttttgccagaaacggataaactgcaaaaggataaatctcgcgagaaaacccaccgcaagagatacagtgacgagcaatacagcaggcacccatgccggagcgccagataactcaccaactaaaaaaggcatgttttccccttatctttgccaacaaatgagtcacgcttgtcatgcacctgtgtgctgacagacgcccattagtatatgaaaaattcagcaaatctcttccgtatgccgggcatcgtattcctgctgagcccgtaccacttccggcccatgtttcagtgcccagtcgtacagcgcactgaagggttcctgtaacgtttttgccaatggggtaagactgtattccacgctcaccggcgacgtgggcagcaccttccggtacaccagcccgttgcgctccagccgcttcagtgcgtcagacaaggccttatgagtaatgccatccagccgacggcggagttcattaaagcgtgcgggttcactgcacagcacggtgagaattaaaatcgaccatttattggtgatgttctccagcaccggccgggtttttccaacttctttcaggttatgaccttcaatctgacacatggcgatatactccgcgatacctggtataaacaaagtgcgtaattgttattaagtataaaaattatatcatctgctttccaccccaaaaggagtaagcagatgcaacaattagagaacaaagtggccctgatcctgggcggcgcaaaaggcattggtcttgccatcagccagcgatttgcccgtgaaggggcaaccacctggttcacttcacgccggagtgaggagttagacatcgccgttgctggcatagaaggcgacgccaggccgctgcgtgctgatgtcagcgaacttagcgaactgacacgcatcgctgacctgattaacgcggagtccggccggatagatgtgctggtgatcaacgccggaatggcggaacacgcgaccattgatgacgtcagcccggcgcactttgatactattttcggtctcaatgtgcgttccccattgtttgcgcttcaggccgcgcttcccctgctgaaagagggggcgagtgtggtgctgataggttcgattgccgatgtcatcggcaccaaaggctatggcgtctacggcgccagcaaagcggcattacgctctttcgcccgcacctggacaaatgagctcgccgcccgggggatacgtatcaatgtggtcgccccgggcccggtggataccgaaatgatgcaggccgcctccgaagagctgcgcaatggaataatcagcgccattccgttatccagaatggcgaagcctgacgaagtggccagcgcggcattgttcctggcgagtgatgaaagcagttatatcgctggcgccgaaatctgtgtggatggcgggctgacgcaggtttaatgaaatccgggtccggctggttgtaaaatggtaaacacgttccgcttctggttcggcgctgccacgcaaaatagggtggcagcgttgagcgagaggcggacatagggtgatcgtcttgcatcaggcactacttgtgagtggattaatctcagccaacagccagctttcaaagcgctccagcgctgcctcatttattcccgtttccgttgttttgactaaacagaatcttttgctcagactatttgatgcaggccatggagaaacaagcatgccgctacgcaattcattctcgatatacatccgcgggagcaaagcaacgccctgtcgtgccatcacggcagcgatggccatttcatgcagatcatatcgcacaccgtgagccggattatcgaggcgtattccgctttcgacggcatagtgatgccatgcatcaggattctgtcgacgatggatcctcggcagttcatttaacagttgattgacattattttttgttatcagtgcaggatggcataccggcagcagattttcctgaaacagaaattgcatacgcattcctgcccatgcggaatgttcaaaatgaataaccgcgtcaaatccacttccaggcaaaataaacggatccgttctggccgcaatatttaacgttatatccggagatacagcgttgaaactgttcaggcgcggaataagccagcgacaggaaaaggtgggcaggacggcaatgtccagactctgactaccttcaggcattcccattatgtactgcgtatcccgttcgagccgatcgagcgtttcccgtacgtgatgcgcatagcgcgtaccgacggggttaagctttacacgactgcccatacggtcaaacaatttaccattcagtaacgcttcaagacgtgcaatctgacggctaatcgccccttccgtcaacgacaactcttctgcagcacgggcaaaactgccgtgccttgcagcggcatcaaaagcctgcagggacgcactactgggtatttttctgcgcataacatcgtttcctttttcaggcccagtattctgccttcattgactaaatgtcactaatccgtgacgttttatcgattttacggggctgaaccatcttgtagcatgatgaaaaatcattaagcaaatgaatctgcttacgcctgtggctcatatggagataaacagatgttttataccgtggaatgttcatataacgatcctgacagcgaggcagaatggaatgccttttatagtcagcaaaaattacccgcgttgatatctgttgctggcttcacgacgtcgcaacgctttcgtgctatcaattccggctgccctgtttaccttgccattcataccattaaagatgcggatattctcaacagtgatgattaccgtttaaaaggaggcggcaatttctctcgatggcaggtctgtattactgactggcaccgtaacctgtacgaaggaaagggcattatcccggccgtatctgccggtgaaattctgctattgagcgcaacgccatcaggcgttttagataaagagttgggatatcgtgggctggaaatgcatgcggtagggctggataaaactcctgaacatcgcgttgcgtatgttctgccggttagcattgcctcgttatttactgaaatcccaggcatgtacctctatgaacctttgaccatgcaattgcaggatacggaataagggaggctaaaacatcatgcccaatctgactttttatattgctgaaaatcaggctgacgtgttgcaacgtgatgatgattttacgcataaatgccgcgccctttgctgtgacatcctgcgcgcagagcctcaaaacgtgcatatcatttttattgccgtaaagcctggatgcggacaaccggtctatgcccagctcttttatcgcctgacaacattacgaacccaggacgtgatggagaactttatgagggaactggacgctgccattcaacaggcctctggtctgacgccccgtattcgttgttttggttccccagcagaacagatatttgcacgcaactgatcccgaggtaaaaatgaaccaaccctttccgagccgtgagactggagattttcaaattacggcgctaagcgacggcattatgtcagccagtctggatttgctctcaggcatagaaaaagcggaggcagaccttattcaacgcaatgcgggtatcaatgagcccggcgatattcatataaactgttacctaatccgtggtcggggacgcatcattttggttgacgctggcgccgggatgcctggcaatatgcaactcacagcaaacctcgccgcagcaggtgtcagccctgacgacattgataccgtgttgctgacacattgccatccggatcatattggcggcctgctggatcctgaaaaaaagccggtttttaaacatgccgaaattatgcttcatcctctcgaagcacagcactggctggatgataagaaactcgaaatagcgaatgagcgcgggcaacgtaatatccggctggtccgccagacattagacgcttatgcccataacgtgcatttttttaacggggataaaattgcaggaagtattctgcccgtttggctaccaggccatacaccgggacatacaggttttcgcatcgatacggatgataaatgcttattaatatggggagacattgtccattatccgcatattcaatcagcacaaccggctgtttctattttattcgacactgatcccatccaggcagagcaaacaaggaagatgattcttgaaaaggctgtcagcgaaaaactgctcattgctggtatgcatttaggtcaggcagggtttgcacacgttctcagggagggtaatggataccgcatttcctgtactgacaaatgaagggatgtatctgttcggagggttattgattccctcaatacaacgttattattgtctgcggctcagaaactgagagaggaagaccctctctcttttcccgtatcacgcctttgcccgccgcaatcactcgcaaaaaggggaacgctgctgcgccgcggagagaagctgcatcgcatcttcaccggccgcggtgtagagcggagcgttttgattttcagccacggcataaatagcgttcgccacatcttccgcgtgcgtcactggcgcgtggggatcgcccgcccgctggataaattcattcaccaggcttccatagaccgcatcgtcccgcccgccagagtaagcccgcgcattttcaccaaacttcgtttccggcgagcgccccggtaatacaacgtgaacgcggatcccaaaaggcttcacttcgacggctaatgactcgctccaggcattcagcgccgctttactggcgcgataaaccccaatcagcggcatcgctttggtggtcacggacgaagacacgttgatgatcgtccctaattttttctctctcatcaacggcagaaacgcctgcgttaatgccagcgtgcccagcacattgatgttcattaattgctgcgcggtggagagggacgtcagttcaacgggaaccgccgcgccaagaccggcattattgaccagcacgtcaatcgcgcctgcctgtttcaccaccccggtaatactttccgcagaggtgatgtccagtggcaatatccgcagccggtcgctggcaggaaaaagcgtcgtatccagcgttctcatggtggcaatcacgtgccagcctttggctaaaaacagctgtgctgttgccagcccaaaacctgaagagcatccggtaatcagtgcagtcgacatggtaaatcctcgctgttggtcagagaagccatgatagtcgtagccatccggacaatatataatcagaaatccacttttcttgagagagagtccagtgtcagatccgttaaccgatattgttgctttactcaaccccaggcccacccataccaaactcgtcgagggggcagggaagtggcgtattgtccgggagtctgccggagaggcgttttactgcgccgtgttgcagggggaatgcctgatgagtattaacggtaaagcgccgacattgcttgttgccggtgatttcgtgctgatccctgcaacttatacctttgagaacaccagtgcgggaacgtctcctcctgaagacattacgctgccgaccctgctcggggacgggcacgtgaggatcggttcagcaaccggggatgctgaatttctcatgaatgtcgggcactgtgaattcgatacgccggacaaacagcttatcgtcgcgttacttcccaacgagatcctgatcaaagggcaacgtcgtttcgtcaccctgttcgatctcctgctggatgagagccgcacccggcgaccggggcgggatgcggtactgatgcatcttttgcaactgttgctggtggaagcgttgcgtagcgatccagcactgtcgacgacggcagggatcctgaaagggttacagcacgataagatcgccaccgcgctgcatctcatccataccaaccccggtgcggactggcaaatcgcgcagctcgcccgggagtgcgcgatgtcccgctcctcttttttcgccgtattcagcgagaccgtcggcatgtctccggggcaatatctgctgttctggcgaatgtcgttagccaggaaagcgctgatgggcggcaaggataaaatagaacagatcgccctgcgtacaggataccagtctgccagcgccttccacgtcgccttcacccgctacaccggcctgccgccgggggaattccgacgccagcatgtggctaatgcgtcctgaagcgcgctgaacgtgacccgttcaaatgctcacaacttaagtgcggcgacgatggcggcttccattttctgcggcgtggtgaagggggcgaaacgcttaagcggtttgccgtcgcgcccgatcaggaatttagtaaagttccatttaatgcgcttgcccggcaggccgggcagtgcgtctttcaggtaacgaaacaccgggtgcgcggcggcaccgttgacttccactttctcaaacatcgggaagctcacgccgtagttgatgtggcaggtctgagcgatgtcgtcggccccgcctggctcctgtttaccgaactggttgcaggggaaacccagcactaccagcccctgcgcaccgtactttttgtagagcatttcaaggccagcgtactgcggcgtgaaaccacacttactggccgtattcaccaccagcaccagctttcccgcatagtcggccattgagaaaggctcgccgcgcaggctggtggcggtgagttggtaaaaggtggtcatggtggaagcctcgatggagaaaattttatggggtagtggttacaggactggactttatcatgactgcttctggcacaaagcgaactataaacgatttatgtcacaatgagcaaaacagaccttaacctaacatcaattagtaattgataactggatacagcaaatgaatattgaattaaaagggcttagatcgctagaacttgaagataggttgataaactattggccaactgaccctgccagtttcggttgttggatcagagcaatgatagggcctaaagaccgtgacggtgctgaagcttttgatatgttggtatgtacgccagtctggcttaaacaagagcttgcatcatataagtccctgtctggcagaggaatgatcattgtcgaagaatatgattatgatgagatcctttcttatatagaaaaaaagatcattgtctgtaatgacaaggactggtcaaaagccgccatcaaactgagccgtttcagtttctgggaatatgaagattatcagccataagccaaatccagtgaatgacttatgacaaatattaagatacggcagaaagtagagcgcgagagccctgacgagcattccattcctcacgggtgatttcccagagttcggaatcaagcagaccgctgacatactctttcttttcagtcctgatgagccgcatgccactgctttctgaaataatttttgaacggctatttagagccgctttaggtgcacgcaacactgtcttatttaacgaattaaaccaatgatccgtagctgcattactggcctctcgcataaagccctggccctgatgctccggagctaaccaaaatccacggttattatcctcaacatcatacagacagattacacccatcagtttgtctggtgtttcaaggtgtctgatagtccagaaccaggctatcccatttgccatatcaggcaaagcaacgttattgacgtaactctcggcaccgttatcagggtagggccatggtactgaagagaccatgtagcgaactatctcccaacgcgggtaaagcaactgaatttgtgaggcatcttcggaggctaatggttttaacagcaagcgttctgtatagagtattggtattggcatacgtacttttccttgctgagcttgatatctatttctgtattacccgttcagtagcagtctcactttagctggatgtataagcggtcatcagatctgtacggctgtataatttatctgcttctgcgcgcactgatcttcttttgccatgctccagtcgaccgggtcaaccctaaatatggtggtagtgcaccctggcttcattgcgttagattgtccgcattataaggatcacaaaaatgaagctctttatggaaattattttgatgcgtcatggaaagccgtcttttacaggttcttcgagggtgacgagtctcgagatggacaaatggatttcacaatatgatctctccgatacgggcagcgatatggccccgcaatccagtaaatcattagcatccagcgcattgcacatcataagtagtcctcttcccagagcgctttcatctgtgagggcattagggcgtgaaccggacctcattgatgaggtcttcagggaagcagacttgcccgtattacgcatgccagcattcaggttatcccccatcttgtgggcgtctcttttccgcgtcatgtggctttgtggcttctcccgtaatgtagagaccctgagcctggctaaacagcgcgccgttcaggctgcgcatatcctcgtaacatcagcagaagaatcaaacgggcccgtactgcttatggggcatggggtgatgaatcgactgattgcaaaggaactcatctcgttgggctggaaagagggccatcgacagggcaatggttactggaacgctcgcacctacagcttacgttaagtaaagatctcaattacacatctgataatccctcaatgattttttgctaaacccttctttcagcctggcccggtttgtcaggggtaaaataaaaaggactacactcatgcgtaccgcaaaaatccgcgccatcctcggtggggctcttttattattgtcagttttagcctccgcgtccgcaacgcagactatgtccataccttcagagcatccgaacccgcagcgtatttctgtacagacgcaaggctcagggccggatgtcatattgatcccggggctggcgtcctctcgcgacatttgggccggtttagtcgcaactttacgtaaaaaccaccgtgttcatcttgtagaacttgcgggctttgcaggtacgcctgccatatccagtccacggggaaaagtcatcgtttcggcagttgacgccatcgctgattacattcaaagccagaacatccaggcaccagcgatcattggccattctcttggcggcgagatggcattgatgctgggggcccgtcatcctgaccaggtcggtcgtttgatgatcgtcgatgccttgccgttctatacgttgatgattgaccctgcggcgaccaccgaaacggctgcccggcatgccgcagctatgcgggatttgctactgcggcagtcgccggagcaactcacagagtttcagaaagcatccataaaccgtttagtgaagaacggggcggtgaaacctgctttggtgactgcggcgatcaattctgatcgcaaaactgttgcggatgccgtttatgaattgatgattaccgacctgcgtcccgagctcgctcgcatcaaagcaccgattgagatcgtatacgcgtatgatgtcttatacgggatcccggcagcctgcgtggatgcgatgtaccgtcaagcctacgcttctgcttccgacatccatttcacgcggatcgatgacagttttcactttgtcatgctggatcagccagaacgattttccaatgcggttgagtcatttttaaacaaataaaggatgctgctgcacatcaggttgacgctggagcagtatcttaagtccggccagcaaacatagctggcctgaacatcaggtcagcacgctgtatgtcctgacatagctaagtctgtgcagtgtccgcttctggcacaaagcggacaggatggctgggctaaaggtctgcttagagcgaggagcggaagtttgcaatcgagtcggcacatggataataagttttgctgtgtattaaagaaaagggagcatgtcatcgcgattagaaatgacggctgacagctttccatttctctacgctcattcagactcgcaatgttgctttcgatgacaggataagcgtacagccgcttgtttaatctgttcgatcacctctgccctgaactcctgatgcacataggttgctctgggatgagcaatcctgaagcaggtcgcattcccagcctcaaacttccatatttttttaggagtgacagatagggtcttagagccgcccaaatatttattcgataaacattttataaaatggtcggttcgtgaaccacatgcaaatattacaaaatcaggttttaaataccctatctgggtagccagaagtcttaatgaaacagacgctatttcctgaagttcgttttcagagcggagcagtgggctctttcggtcataatcccatgcaaataaatttgcatacactattgccttagggggtaattctagttttcgcgccagcaagaaataatactgcataaaacggcttcgtgatttcgtattaggagtgcacttatcctgatgctctttgtagcgagttaccgcttcttcaactacatgttcgacattaatattgggcatcagacccagaacccgagcaattttatttttatgatttccagtattccatcctgccgtttcacgcccaaccagcatgatttttaccggggagcgccagtactcttcagagggaacaggaagaaatacacctgaatatttatcctccatgagtgcaaatgattgagcgttaagacttttaaggatttctatatacgttttgatcagagcttccatacttttacctgtacctgacatcatgatgaattttcttttggcatcttactaaacttcaggcaatgcgattaatgaaatgtccgcctctggcataaagcggacatgatctcagcttagcagggcgcgaaaacgttaccctgtcacttcctcaataactttcacgccatcctctgtgcggatccagcgcggcgcattaatttcctccgccagatacgccatcacatccgccagcagccagcgcagcggttcttcctgttgtggcggcacgctgcggcaaagtaatacctgagccagcgctgcgcagtattcgccgagcgtatcggaatcgggagcaaactgaggtacgtgagtgggcaggctgtccacagtaaaacgcgcctgctgttccggcgggatcggctcgttcagctggggtttgagcagggcaaacacggcagaaaagcgtccgcacaacgccattcgcagcgccggatcgaggctttccgcctgggcttcggcgagctggtggcagtggtcggcaagaatagtgaaatcggtgtcggcatcaaacgggatggtaagtaacgggtgagtctggttgagggtcgtagccataagggcagcctcctgtaacgggtttaaaacccaccacctgaggttccaatctcatggtgatggactgaacggggttggaactaccggcgttacaggcaaccggcgcaccttacggtgcccccgtccagcccaccattgaggtgtaactgagcgcacgacatatgaaagacgctaacgcgtcgtatgtcgcctgtaacatttcgcagggttccaatcccggcacctgattttgcaggtgcgggcgaaagataccgttttcagcggaaaacggcaagacggcggcgtgatggaggcggttcgaatgaataaaatgcataccggctcgcagcaatatgaaagtggtctgaaaggttgagcgcttaaacggccttaacaatcccctaaagaaagccatcccatcctttttcaccaacggcctggatgccggtctcgtccagtcgctcgtctgctgcaatcatctgaataaaggttcttgacccttgaccgacggttcatcacttgcggcatcaaaataagtcgccagtaaaaactggcgatggattatgtttttttaatcaatatttttaagctagtggttctatggatatctttctatcgcccccaaatgaactttttaataattgtgctcgtggatatcttttaattagtgacatgacttcatcgagttcagcgggttcaaataaagggccaagtatcactgatttcacttcataaggatgaaacttcaggtcgctatagtgccccatgctcatcggtctggcataagtagaaatcctccactccttttcgtatgcccaatcttctgtttttatgaatgttatctcagtattaatatattcaagtgctttgttgtctggcttgaaaagcaactcagccataccttcaggcgtgtaagttagaggtattttattagtatacttaataggttttgcaattagccaggcgctgccaagaacgtctaggcaatcaaattcgataactatgcctttatatccatcagcataatggttccacatcggagtgattataggactctcagataagcacaaaattcttctttcattgagcattcctttccacacatctttcatttcttgtattgccgcaggggcgccaagtccgactggtggagcatctactaattcttgaaacttattaatcagttctgctggtatgcctaaaggaaagagtttttggtaaacatctaacagcgttctaattcttggatttaaattttggatgtcttccctaggattaatcaactcctcgatcaccttgcgaactaaagctttaccaatatttatctcatcaactcctagcatgacttctcttggaacatcaaaaggatcattaaatatgaccggagaactccatctaaggctacatgaatcaagtacaatctttgcagtattcaacgtcatgtacttataaaatgttgagcgttcatgcattctgtgaggtgagcgcataaattcctctttttaaatgtataatggctttcatcagtgtattgccagttatattgcatccaaacattttccatttcaattctatagctaaaactcaatcaaataattcacctcttttcgtatttgacgtaggtggccaaatcacgtgatgggtaatcaggttttctcatagaggatctcttctttttcaggggactaaacgcagtatagatacctgatgggaaagccgcctgtgacgctattaccatctggtcactcgttgttaacccggcactgctgagttaagcttaccggatgacgaaaaaagaaaacgaccacgccacgcgcggcacggcggaccacagcgtccgcgatcaggtggtggatgccgccaccgaacatttcagccactatggttatgagaaaaccacggtgtccgatctcgcccgcgccatcggcttttccaaagcctacatctataaattcttcgattccaaacaggccatcggggaagtgatctgccgcaaccggctggcgatgatcatggagatcgtcactgccgccattgccgacgcgcccacggcgtcggaaaagtttcgccgtctgttccgggcgttagcggaagcgggcagcgatctctttttccatgaccgcaaactttacgacatcgccgccgtcgccacgcgcgatcagtgggcatccacccgcgcctatgaagaacagcttaaacagttgattcaggaagtgctggtggaagggcgtaagtcaggggagtttgagcgcaaaacgccgctggatgaaaccgcgcaggcgatctatctggtgatgaagccgtatatcagtcccgtgcagttacagtacaaccttgaggatgccccgacggcggcggtactgctgtcgtccctcatcctgcgcagtctggctccttagcacagagaaaatagccccggctggcgccggggtcttcatatcagccgcggtgcacgctcaggcctgcaaaggtctggcttaccggcatcatttccagtgtgttgatgttgacgtgcttcggcagcgtcgccacccaccagaccgcttcggtaacatcttccggcgtcagggcggtggtgttctcgtaggtttttccggctttgtcgtcgtcgcctttgaaacgcacgttagagaattcggtgccgcccaccagccccggctcgatattggtgacgcgcacgccggtgccgtgcagatcggtacgcaggttcaggctgaactgctgtacaaaggctttggtcgcgccatagacgttgccgcccgcgtacggccagctgcccgccgttgaaccgatgttgatcacatgaccgcgattgcgcgccaccatgcccggcagcacggcgcgggtcatgtacaccaggcctttgttattggtgtcgatcatggtttcccagtcctcgacgctcgccttgtgcgccggctccatgcccagcgccagaccggcgttattcaccagcacgtcgatgtcgcgccattcagccggtaaattccccatcgcctgctcgatggcggcgcggttgcgcacgtccagttgcagcgtcagcacgttgtcgcccagttcgtctttcagcgcctgtaagcgctcctggcgacggccagtggcgatcactttatggccgttcttcacaaagcgacgtgtaataccttcaccaaaacccgcagttgccccggttactaaaataatcatctctctgttccttaacgctttttgtgttgccttagcatagttgcgcagcggcccggtggcaacgcataccgggcgagttagtagtgtggcaaataatctggtcccgtgacggggggatttggtactgtagaaaccgatcaacggttcaggggagtaaacatgtccgtcaccaatccactgtttgaacagagcacgctgccgtatcaggccccgcgtttcgatgcgctgcacgacagccattaccggcccgcctttgacgaggggatgcgccagaaacgcgcggaaatagccgccattgccggtcagagcgacgcgccggactttgccaataccgtcctggcgctggagcagagcggggagttgctgtcgcgcgtcaccagcatctttttcgccatgacctcggcgcataccaacgacgaactgcaactgctggatgaagccttctcggcggaactcgccgggctggcgaatgacatctaccttgatgacgcgctctttgcgcgggtggaagcggtgtataacgcgcgggacaccgccgggctggacgacgagtcccgccgcctgctggaggtcacgtaccagcgctttattctcgcgggcgcaaaactgcctgctgtcgataagcagacgctgaaagcgctcaacaccgaagcggcgcagctcaccagccgctttaatcagcatctgctggccgccggaaaagccgcagcgctggtggtggagagcgccggagagctcgacggtctgacagaggatgaaatcgcccgggcgcgggcagcagcagaggagagaggcctgcacgaccgctggctgatcccgctgctgaacaccacccagcaacccgcccttgcggcgctgcgtaaccgccagacccgtgaaaaactctttaccgcaggctggctgcgtacccagcgcggcgatgaaaacgacacccggcagattgtgctgcgtttaacgcagatccgcgcccgccaggcgcagctgctgggctttgaggattacgcttcctggaagatcgccgatcagatggcacataccccggctgccgcgctgcgctttatgcgggatattgcacccgccgcgcgcgcccgtgccgaaaaggaactggcggatattcagcaggcgatcgacgggcagcagggcggctttaccgcccgcgcctgggactgggccttctatggcgaacaggtgcgccaggcgaaatacgccatcgatgaaagccagatcaaaccctactttgcgctgaataacgtgctggtggacggcgtgttctggacggcgagccagctgtttggtctcacctttaccgagcgcgctgatattccggtctatcatccggacgtacgggtctgggagattttcgatgaggacggcaccggactggcgctgttttacggcgatttcttcgcccgcgattcgaaaagcggcggcgcgtggatgggcaactttgtggagcagtcgaccttaaacggcacccgcccggtgatctacaacgtctgtaactaccagaagcctgctgccgggcagcccgcgctcatctcctgggacgatgtgatcaccctgttccatgagttcggccatacgctgcacggcctgtttgccagccagcgctacgccacgctatcgggcaccaacacgccgcgggattttgtcgaattcccgtcgcagatcaacgagcactgggccagccacccggaggtgttcgcccgttacgcccgtcattatcagaccggcgagccaatgccggaggcgctgcgcgaaaaaatgttcagcgccacgctgtttaataaaggctacgacatgacggagctgttaagcgccgcgctgctggatatgaactggcaccgcatcagcgcggatgccgacatcagcgacgtcgacacctttgaaactgaggccattaaacaggaaaacctcgatctggaggcggtgccgccgcgttatcgcagcagctatttcgcgcatatttttggcggcggctatgccgctggctattacgcctatctgtggacgcagatgctggccgatgatggctatcagtggtttgtggagcagggcggattacgcccggagaacgggcgacgcttccgggcggcgatcctgtcgcgggggaacagcagtgatttagcggcgctctatcgtgaatggcgcggacatgatccgctgccggaaccgatgcttaaaaatcgcggactgagtcagtagcggctgacggtgataagaagcccttgttgaaaaacaagggcattgtcagtatttcatcagctcgccatcttacgcgctttgcgctttcgtggtatgcaggagcttgcggttaaacgtgtaccacaagttgaacaaattgcgccgtgtggatggagtttttccgggtcgaaggtcgtgaaaataaagctatttccatgacatattgggcaaagaaatttgagattgtaaataatccctcacgccagtcaggtggaagacaaacgctaacataaattcctcatcctgaaggatatatcttcatttttgtataaaaaacaagcgtgaatttttaaacagatcttcctcgtttacgctttgttgaatcaggtactgttaaggtcttatcgatccgtgacccgacagctaaatggcgggggtgcgcataaataaaataacgatcctatccatgcaagcatttccgccagcgtaactggcggattttttttgcctgtaaatcacccggcgctgcgggtcagaatggctttgcggtaatcgccgggggaaatggcaaactgcgcgcggaaatgatggcgcagggaggccgcgctgccaaaaccggtctgctgcgcgatctcgtcaatgcgtaacctggagttcgccagagactcccgggcgcgcagcagccgctcgttgaggatccagcgcgcgggcgtggtgccggtggcatcggcgaagcgccgtaaaaaggtgcgcggactcatgcctgcctgacgggcaagggcagccacgctgtgattctccgccagcgactgatgcagaaaatcaaagatcattcccagggatttactctcccgcgcccgcgctaccggacgcaccacctgctgggtttgcgccccgtcgcggtgcggctgcaccaccagcctgcgggcgacgttgttggcgatctccgcgccaaaatcttcgcgcaccacgtgcagacataaatcgatccccgccgcgctgcccgccgaggtcagcagcgtgccttcatcataatagagcgcgtcatccagcacctgaatggcgggataacggctgcgtaacagcggggtgtagcgccagtgggtggtggccctgcgcccgttcagcaagccggtggcggcaagcacaaacaccccggaacagatggtcataatgcggcagccgcgcgtactggccgcgcgcagggcatcgcacagcgcttccggcaccggcgtgtccgcgccgcgccagccgggaatgacgatggtatccgcctgcgccagcagatccagcccgccatcggccatgatgcgaatgccgccggtggcgcgcagttcaccctcgtccaccgccgccacggcaaagcggtaccagttatcccccagctccgggcgcggcagaccaaaaatttccaccgccacgccgaattcaaaggtgcataaaccatcgtaggcgagggcgacgacgaacggacggggcgatgcgggaggtaattttgtcatgatcctggcgttttctggcagaccggcaggcagtggcgcggcgaattaatggatacagtagtgttatcacaaacccggagaaaacacgatgagctatgtaaccgaattccctgccgccacgccggaagaaacccgcctgcattttctgcatcgcctgagcgtggaaaccgactgcgccgatgtccatcacgccatcaccactggcgatcaggattttgtgctgctgcacgtggtggggagcgcggcaacgttcgcccgccgtcatctgcccggcgcgatccatttacctcatgcgcaaatgaccgccgaacggatgcaggcgtggcccgacggcaccctgtttgtggtgtactgtgccgggccacactgcaacggagccgatcgcgccgcgttaaaactcgccacccttggcctgccggtaaaaatcatgattggcggcattaccggctgggaggatgagggctatgcctttgcgcagggggatgactgaatccctgcgatgaaggattaaatctgcgccgcgccgccgtccacgaacagctcgctgccgttgacgaagctgctgtcgtccgaggcgaggaacagggcggcggcggccacttcggatggttccgccagacgacccagcggcgtagtggcctcaacctcattaatcatctgctgattcgcggcatcatccggcgacaggttatgccagcctggcgtggaggtggagccgggcaccagcacattgacgcggattttgcgcggcgccagttcgaggatccagccgcgggcaaaggtgcgcagcgcggctttgctggcgctgtacacgctaaatgccggaatgccggtggtggcgctggtggagccggtgaggataatcgacccgccgtctttcagcagcggcagcgctttctgcacggtgaacagcgtgcctttgacgttggtgtcaaaaatgcgggcgtaatgctcttcggtgatttcccccagcggcgcgaaatccccgccgcctgcgttggcgaacagcacgtcgatctgccccgcctgctgacggacctggtcaaacaggttgtcgagatccgccatctttgagatatcacacggaatacccaccgcgccatgcccaatctccgcaaccgcactctccagttcgctgacccgacgcccggtcaggaataaacgcgcgccttcctgtgcaaagcgtttcgccgaggccagaccgatcccgctgttcgcacccgtaataacgacgactttatctgcaagcttacccatgatgtttctccgcaactctgtgtgagaaagcagtgtaagcacagactttcctgtatactagtacctaccaaaaggtatgtatggagaaaattatggagccggtctgcggccttgatgtggccctgcattacattggcggcaagtggaaaccgctgttgctgttttacgtgcagtacagcccgcgtcgtttcggggaatttaaacggctggtggagggcatcagcgagaaagttctgatccagcagctcaaagcgatgacggaagacggcatcatcacgcgtcacgatttccgcgaggtaccgccgcgggtggagtacagcatcaccgattttggccgttcgctggcgcaggcgttgcagccgctgtgtgagtggggcacccgtaaccgggaaaacatggccgacaggacggcgacggcggcgttaacggaagaaagatgaatttttttcatcatgcgtgagcttttctcatttgctatcccgaacaggatatgacatcttttttggatgtttagccgtccagaaggctataaattcaaataatgaactatcacgccagggtattacttttcactggcggcaaggagataagcatgcaacaacacgccccgtaccgcgccgatgtcgtcggcagttttttacgcccggacgccattaaacaggcgcgaatccagtttgcgcgcggtgaaatcgacgccgtgcagctgcgcgccgtggaagacgacgctatccgccaggtggtggaacagcagtgcgcctgtggcctgcatgtggtgaccgacggcgagttccgtcgcgcctggtggcatttcgacttctttgatggtctgaacggcgtggagcgttacgattctgagcagggcattcagttcaatggcgtgcagaccaaagcccacagcgtgcgcgtgaccggcaagctgagcttcggcgatcaccccatgctggaagacttccgctatctgcaaagcatcagcggcaatgcgcagccgaaaatgaccattcccagcccgagcgtgctgcacttccgcggcgggcgtaaagccatagacgcgacggtatacccgacgctggaccgctactttgacgatctggcgaccacctggcgcgatgccatccgcgcgttttatgacgcgggctgccgttatctgcaactggatgacaccgtctgggcctacctgtgctctgacgagcagcgtcagcagatccgcgagcgcggcgacgatccggacgaactggcgcagatttatgcccgcgtgctgaataaggcgctggaaggcaagccggacgatctgaccatcggcctgcatgtctgccgcggcaatttccgctcgacatggatttcggaaggcggctacgagccggtggcggaagtgctgttcggcacggtgaatgtcgatgcgttcttcctcgaatacgataacgaccgctccggcgattttgccccgctgcgccatgtgcgtcctggcaaacagcaggtggtgctggggctgatcaccaccaagaatggcgagctggaaaacccggaaggtattaaggcgcgtttgcaggaagcggcgcagtatgtggatatcaatcagatctgcttaagcccgcagtgcggctttgcgtcaaccgaagagggcaactctctcacggaagcgcagcagtgggataaagtccgtcttgtcaccgccattgccgatgaagtgtggtaagtgacagtgtaacgtattagttgcccggcggcgcgttgcttgccgggcctacagggggataatcattatcaccgtaggccgggtaaggcgaagccgccacccggcatttaaccccacccggcatcacgctttacaccgccaccttttccttcacgtcctgccatgggctgacccgcatccccagcagcatcatcagccaggccagcacaatcaccaccatcaggatcacaaacagcgaccagcccggcagattcgtcaggatcaccccggtggccagtgggtttaacgccgcgcccagccagcctaacgcctgggcagagaagtagctggatttcatacccgcaggcgcgatgttatcgatcaacaggtattcccccggcgcatagataatctcgccgacggtaaaaatcgccgaggctacgccccagaaccacaaattgctgcccgcgagcataaagcccgccagccccaccacaaaaaacagcgtcccggcggccattaacggctggatattgcgggcgttgatactgcggcccagcgcatattgcaggctgaccaccatcgcggcattcaccgacagcaccaccgccaccactttctcggcgaaattgttatccgccacgctcatcacgtactgggaaatacaggtggcgaaggaaccggcgacaaatgaggccagaaaaccggaaagggtgaaccacagcagcgccttatcccgcagcagcaccgacggcgaccaggcaacgctctcctcgccgcgcatagtgatgggaatgcgctgcacaaacagctgaataaacaccagcgggaaggcggcgcaggctgccgccagccagaacggcaggttgacgctctgcatcaccagcagcgtgccgaggggcggccccacggtccagccgatattcagcaccgtatagttgagggagaatatcttcgctttcgccgacggcgtcagggtgtccgagaaataggccttcagcacggtggagaacaccgaataggcgcagttgatcagcgcaaacagcgccaccaccacgatgacgttattactgagcgggatcgccgagaagccgataatgaagcaggcgatggcgatcaccatatagcgctttttgtcgaatttatccgccagaataccaaaaccgaggctgaaaaagacgccgatggtgagggcaatactcagggcataacctactgcatccaccgtcatgccgtactgacggctgagatagatcgtcataaagggcaacgtggcaccgcgaccaatggtcagcagtaacgaggaggcgagtagtgcgagggtggaacgggtttgtgttgggatcatatgcttgcctgacatcacattaattatcgttatttgctatgacttacagcaataacatgcagatccgggcttgtatagctaccggtttgttctggaatgcgaaaactgacctgccataatttgggatctgcctctgtacattcttttacgttaacgttacttttttacataaatttaaaaacatcggggcaatgatgacgcgtaaagatagtctgctggcgttgctggtcgtggtggtgtggggactgaatttcgtcgtcatcaaacttggactgcacaatatgcccccgctgatgctggcgggattacgattcgtgctggtggcctttccggcgttgctggtggtgtcacggccaaaaatcccgatgcgtctgctgttcggctacgggctgaccatcagcttcgggcagtttgcctttctgttctgcgccattaacttcgggatgcccgccgggctggcgtcgctggtgctgcaggcgcaggcgttctttaccatcattctcggcgcctgcgtgttcggcgagcgcttacaggcgaagcaggtgatcggcattacgctggcggtgttcggcgtgctggtgctggcgcaggcgagcctcaacggtcagcatgtggcgctgcttggctttctgctgacgctggcggcggcgctgagctgggcctgcggcaatattttcaacaagatgatcatgcagctgccggtgcgcccgtcggtgatgtcgctggtggtgtggagcgcgctgatccccatcgtgccctttatggtggcgtcgctgattttcgacggtccggctgtgatggtacaaagcctggtgaatatcgatctcgtcaccgtcttttcgctgctctatctggcctttgtggcgaccattatcggctacggcatctggggtacgctgctcgggcgctatgaaacctggcgtgttgcgccgctgtctttgctggtgccggtgttcggtatgggcagcgcggcgttattgctgggtgaaaccctgacgctgttacagctggtcggggcggcgctgattatggcggggctgtatatcaatatctttggcgtgcgtttccgtaaagcgctgccggtcagataaaaaaaagccccgccggagcggggcaaagcgaaattagccgtgccggttgtaataaggcacgcctaattcgtcggatttgtcgctgccggttcccatatgattaaagtcgaaaggcgactggtcgtgggccgacggcatgatcatcgcgtcgcggtcactgggcgcggcaggatgacgggactgctccgcatagctctgggcgcttaccagcatcagagcggtgagggcggcggagacgataattttcatgatttcctcgatacgtctaaaacaggcgtttctcaattacagtgattaataggcagcagataccgggtttcgccgtgcataccggtggtacggtatttgtgcggcggcacgtcaaagtagttcttgaaagtgcgcgtcagcgtctgctgtgactcaaagccataacgctcggccagatagaggattggctcgttgctctgcttgagcttttgcgcaatttcagtaagtttgcggctgcggatgtattgacctaatgaatggccagtttcttttttgaacatccgttgcaggtgccacttcgagtaacctgaacgctcggaaaccttctccagcgacagcggggattccaggttatcttcaatccagtccaaaatgctatgaatagtgatcgcgtcattattgcgtctggacatcgtcatacctcgttgttttacggcagtacttttttgagtaaatactcaagagttgccacttcgtctgccgttaagttttttgttagttcctgatgcaggtcttgtcctaataactgatggccgcgctcgcacagcgccgcgccatcggtggtcaaccgaatcagtacgccgcgcttatcgtgcgggtttggcgtacgttcgatccagtctttgcataccagacgatccagcatgcgggtcagggcgcccagatcgacagaaagcacttttttcagttccaccggcgtaatgcagccggcgcagcgaattgaacaaagcactttaaactgcgtcgcggtaatatccagcggcgacaggtaatcgttaagcaggcgatcttttttctggttaaccatatgaataagacggccaagtgggatgatttcgttaaacaagtcacttgtgttattcacgatggttgccccggcaagtaagtaatcacggcggatattattgccggggcaagtataagtcaactgaatgaatcgccgaatgccacgaattgctaaaacgtttcacgtcctgtcacttttctgctcctcgcccccctttacagatatacttgacgggtatttacctcatcacaggagtgaaattttcatgctggatcttattcgggcgattggcctcggactggtggttttactgccgctggcgaatcccttaaccacggttgcgctctttctcggccttgccgggaacatgaacaacgcccagcgcaacgaacaggcgcgcatggcctcgttgtatgtctttatcatcatgatggtggcgtactacgccgggcagctggtgatgaacacctttggtatttcgatacccggtctgcgaattgcgggcgggctgatcgtcgcctttatcggcttccgtatgctgttcccgcagcagaaagcccatgaaacgccggaggcgaaaaccaaatctgaagagctggaggatgcgccggacaccaatatcgcctttgtcccgctggcaatgcccagcaccgccgggccaggaaccatcgcgatgatcatcagttccgcctcaactgtgcgccactccagcgagtttccggaatgggtgatcaccgtcgcgccgccgctgatttttgcgctggtggggctgattttgtggggcagcctgcgcagttccggggcgatcatgcggctggtgggcaaaggcggtatcgaagcgatttcacgtctgatgggctttttgctggtctgtatgggggtgcagttcatcattaatggcgtgctggaaatcatcaccacttaccattaaaaaaacagcccctgacctggcggtgaggggctggcaattcagacggtcggcgcgtgctcttccagcgccgtcggccagcggcggaatatcagcaccgcccagatcagcgccgccagcgcagggatcgcgcccacatagccgatagcgctcatcgacccgtgcaggctcacctgattgcccaccagcgcacccgcgccaatgccgatattgaaaatccccgagaacagcgccatcgccacgtcggtggcatccggcgccagcgacagcaccttcacctgcataccaaggccgatgatcatgatcgccacgccccagaacaggctcagcaccgccagatgtatttcactggctgccgcggggagcagcagcgccaggcacagcgccagcagggcgatagcaccgctcaccagccctgaggcgtgggcgttacccagcttgctgaacagcacgctgccgatgatgcccgccccgcccaacaccagcaacagcagggtggcgaagctggcgctcgatccggcgaccgtcatcacaaacggctcgatatagctgtaggccgtatagtgcgctgtcaccaccaccacggtgagcagataaatcgccatcagcgccggacggcggaacagcaccggcaggcttttcagcgatccggagtgctcgctcggcagacgcggcagcagtttgacaaggcacagcagggtgatgagcgccccgaggccgataataaagaaggtggtgcgccagccgaaatactgcccgacgaggcggccaatcggcaggccgagcaccatcgccagcgcggtgccggtggccagcaggctcagcgcctgggcgcgtttgcccgccggggcgaggcggatcgccagcgacgcggtgatcgaccagaaaatcgcatgggcaaaggcaatgccgatacggcttaccaccagcacggtaaagttccatgcgaggaacgacagcacatggctggcgataaacagcacaaacaggccaatcagcagcttacgccgttccacctggctggtgagcagcataaagggcagcgacagcagcgccaccacccaggcgtagatggtcaacataattccgacctgcgcggtttccataccaaagctctgcgcgatatcagagagcagccccacggggacgaactccgtggtgttaaaaataaaggccgcaatggcaagcgtaaccacccgtagccacgcgacccggcgtgataccgtgttggttgtcataaatttctcaggcgtgaatgcaataagggaagacggcgatcttaaaacgattagtggtgaaaatacagccgttttgtgatttagatctcattttcctgcctgcgctgaccgataaaaacggctgcgcgctgcggtgccttatgtcatggtagccatcgggatccgcaacaggagcagacaatgcaggaaattgatttttatatggttgatgcgttcagcgaccgcgcctttggcggtaacgcggcggcggtatgcgtattaacggaatggctgccggatgagacgctgctgaagatggcgaaacagcataaccagtccgagacggcgttctttgtgcgccatgatgacggctatgagctgcgctggttcaccacccagtatgagattgacctttgcggccacgcgaccctcgccgccgcgcacgtgatctttaaccatctggggcatcctgatacggaaattgctttcaccacccgcttcgtcggcccgctcagcgtctcccacaatggcgactggctgacgctggatttcccggcctggcagacgcagccggtggaggacctcccgccattgctgttcagcgcgctgggcatcgaccatgcggtggaagtgcgcgccgcacgggattatctggtggtgctgcaaaatcagcagcaggtggaagccctgcaaccggatatcgccgccatgataccgcttggcaaaatggtctgcgtcaccgcgcggggggataaccatgatttcgtcagccgctttttctgccccggcgaagcggtggcggaagatccggtcaccggctccgcccacagtatgctgattccgtactggggcgagaagcttggcagaacgcaccttgcggcccgtcaggtttccgcccgcggcggcgatctgcgctgtgaatggcgcggcgagcgggtgagcatcgcgggtcaggccaccacctacctcaccgggcgcattcagctgaaacagccttaaccttacggcaggcgggcgatattggcggcgatgacgctggcggagtgacggaacagcgtcagctcatcgtccgccagctgtaattcaatgatctgctgtactccgctttgcgccagcacggcgggtacgcctatggcgatattgctcatgccgtactctccgtccagaatgcaggagatggccagcgcccggtgactgccggtaaagatattacggcagatctcggcgatggtgccggcaatgccgtattcggtgcagcctttacgggcgtaaatatcaaatcccagacgccgtaccttcgcggcaagctggtcgccatccagcggctgcccggttttccgctggtacacctcggcaatgggggagccgtaaaccgaagagtgcgaccacaccgggaactgggtgtcgccgtgctcgccgaggataaaggcatcaatactctgcgcgccaatgtccagcgcctccgccagcgtgcggcgcagccgggtggtatccagccagacgccggtgccgatcacctgattgcgcggcagcccggaaagcttccacacctgccaggtaatgatgtcgcagggattggtggcgacgagaaaaatgccgttaaagccgttagccatcatctgcggcacaatggtctgcacgatacgcgccgtgccggtcagctcatcaagacgggtctggccgggtttgagcgcgccgccggaaacggtgatcaccgcgatatccacatctgcgcagtccgttacttcacgggtggaaagggtcatcatgcccggcatataagcggcggcatcggccagatcctgcgcatgtccggccacgcgctcctggttaacgtccaccagaatcaacgcttcacaaatattctgattaagcagggcgtaggccgcagaggcgcccacgttgccggtaccgataatcatgacctttcgggctttggtattcatggatgttccgttttcaggaaaaagataactaaaagtatcgctcctgatcgggtgagcgcaatgcgctaaccggcgtataggaaaatcctatgacgccgtcccgcgctccgcgagcaaatcaataaaggcctccagtggccgggttttcgcccctcgccgccacaccagccaggtggtcagccagcgccagttctccgccagcggccaggcgctgatctgatgatgccccggcatactttccagcatagagcgcggcatcagggcaagacctgcgcctgcgatcacgcaggcaagcataccgtggtaggactccatctcatggattttacccggcgtggcgtgatccgcctgaaaccagctttcgaaatgccgccggtaggagcagttggcgcgaaaggcgtagatgctcatgccgttcacttctgcggcgcgggtgacaggcggatgcccgccgggggccaccagcatcatctcttcacgatacaccggaatgccctccagccccggatgcatcaccgggccgtccacaaaggccgcgctgagccgcccgtcgatcaccccgtcaatcatggtgccggatggcccggtcgccaggtcaaactggatccgcggatagcgctgattgtattccgcgagggtgacaggaatacgcacggcggcggtactctccagcgcgccgagggaaaacagcccctgcggttcgtcaccggcgaccacgctgcgcgcctcatccaccagcgcaaggatctgctggctgtagtgcagaaaactgtgcccggcgggggacagacgcagccgctggttttcgcggataaagagatcgacccccagatccgcttcaagctggcgaatgcgggtggtcaggttagacgggacgcggtgcacctgctgcgccgcctgggtgatgctgccggtacgggcgacggcgttaaacatctcaagctgggttaaatccataccattctcaattcgtgaacagtggggttaatattattcagttttcagaaatagcagaggcaggcaggatagggcaagtcttacattcattaagcgagaaaataatgacccattcatctgtcacccatgcgctgcccgtcaacccggcaaccggagaaaccctgggcacacgcccgtgggccactgcggaagaagtgaataacgccgtcgcgctggcggatcgcggttatcgccagtggcgggaactggatgttgagcaacgcgccgggatgctgcgcagggtgggcgccacgctgcgtctgcacggcgaaactatggcgcagcgcatccgccaggagatgggcaagcccattatgcaggcgcgcggcgaagtgaaaaaatcggcggatctctgcgactggtatgcggaacatggcccggcgatgctcagaacagagccgacgcaggtggaaaataatcaggcggtgattgagtatcgtccccttggcccggtgctggcggtgatgccgtggaacttcccggtgtggcaggtgctgcgcggcgcggtgccgatcctgctggccggtaacagctatttgctgaaacatgcgcctaacgtgctgggctgcgctgagctgctggcggacattttccgcgaggcgggcgtgccggaaggggtgtttgcccaggtgaatgccaccaatgagggggtgagccaggccattaaggatccgcgtatcgcggcggtgacggtcaccggcagcgtgcgggcaggggcggccattggcgcgcaggccggtgcggcgctgaagaaatgcgtgctggagctgggcggttccgatccctttattgtgcttaacgatgccgatctggatctggcggtaaaagccgccgtcgccggacgctatcagaataccggacaggtgtgcgcggcggcgaagcgctttatcgtcgaggaagggattgccgctgcctttacggagaaattcgttaccgcggcagcggcgctgaaaatgggcgcgccggatgtggaagagaactatctcggcccgatggcgcgtttcgatctgcgcgatgagctgcatcagcaggtgcaggtcagcctgcgtgaaggggcgagcctgctgctcggcggtgagaaaccagcgggcgcaggaaattactatccggccaccgtactgggtaacgtgacgccgtcgatgaccgcgtttcgtcaggagctgttcgggccggtcgcggcgatcaccgtggcgaaggatgcggagcatgcgctggcgctggctaacgacagcgatttcgggttatcggcgacgctctttaccggtgatgaagaccgtgccgcccgttttgcggcgcgtctggagagcggcggggtgtttatcaacggctacagcgccagcgatgcccgcgtggcctttggcggggtgaagaaaagcggctttggccgcgagctgtcccattttggtctgcatgagttttgtaatgtgcagacggtgtggaaggatcgcgtctggtgagcttgcccggtggcgctacgcttaccgggcctacatctcgcccccaggtccgtgcatgtaggcccgcgcaagcgcagcgccgccgggcaatgtcatggtactgtcatttatcttttgtagactcgcgcccattgtgaggttacagaagaatatcatgaacttattgcaaacttttcgccgtctgacgcggcgatttactccacggcagtttggtttgctggccggtattttttgcgtgatcggcctgttttccgcccttcagatctcctcctcactgctgctctcccgctcccttaacgaagcgcagcacaacgaacagcgcaatcagctggcgcaacaacagcaggtcaaactggatgagtcgcgcatcgcgctgttggccgccagcgatctgttaaaccgcgccggcgtctggtttatgcaggatcaggccaccggctctgacggcagctggcacagcctgatggaggaagcgcagcaggcgctggtcacctcccataaggcctgggacgactggctggcgctgaacccggtaaatgatgacgggcttattaacagctatcagcagttctttggcgcgatcaaagagcaggcggacgggctgacgcgcacgcagtccatcgatgcgttttttgccgtgcccgcccaggcctttcaggcggatttcaacgataactttgcccgctaccagcaggccagccagcaacgggcggagcaggggcgtcaggcgctgatgggcagtcttaccggcttacaggatctctatctgctggctccggcgctgctgctggctattgccgtggcggtgtggttcggcatgtcccgctgggtgatcacgccgctgcgtgggctgattaaacatatcaatctgctggctgcgggagatctctccacgcccttgccgcaggtggcgtattttaaccgtgaggtaggtcagctcgctgccagtatcagcaccatgcagcacggtctgttgcagctggtggtgcaggtgaacgacgccaccgcctcgatggtggatcatattaaccgtctggcggacggcaaccagaagctgtatcagcaatcggcgcgccaggcgaaagagctggatgaggtgacggcccatatcgcggcgctggaatctcacgttgaaggcaataccggctacgcgcagcttgccagccagcgggcggatgaggcgcaacaggtggcggcggggggcgatcgcatgatggatatggtgaatgcctccatgcgcgccattgtcgaacgctccgcagagatgcgcggcattgtgtcaattatcgacagcgtggccttccagactaatattctggcgcttaatgccgccattgaagcggcccatgccggaaatcacgggcgcggctttgcggtggtggcgaaagaagtcggtctgctggcacgcaagagcagtcactccacgcagaccattcagcaactgatccagcattcattacagggcattgaagacgggtcccaggcggtcacgcggctggaagataatctgcaacaggtaacggggctggtggggcatctgagtacgctgctcagtgatatttccgctgccaccctgaatcagggagagaatatccaccagatgacccgtcagctgcatggtctgaatcaggtggcgcggcataccggcgaactggtgagcagcgcggcgctggcctcgcagcaactccatgatgattctcatcaactgatgcaggcggtggcgcgttttcgtctgcccgcctgacggacgctctgctatactcccggcctcttatggccggggtgtaaggagcatactgtggcgatgattgataacgacgtactggaaaccatcctgacgcagatcaggccgcttatcgggcgcggtaaagtcgcggattatattccggcgctggcctcggtggagggcaataagctgggtatcgccatcagtacggtgaacggacagcactttgcggcaggcgacgcccatgaacgcttctccattcagtcgatttccaaagtgctgagtctggtggtggcgatgaaccactatcagaaagatgagctgtggtcgcgagtggggaaagatccttccggtcacccttttaactccctcttacagttagaaatcgagcaggggatcccgcgcaatccctttattaacgccggtgcgctggtggtgtgcgatatgctgcaaagtcgtctcagcgcgccccgtcagcggatgctggaaatcgtccgtaagctaagcgatgtgccggatattgcctatgacgcgaccgtcgcccgctcggagttcgaacattccgcccgtaacgccgccattgcctggctgatgaaatcctttggcaattttcataatgacgtgaccacggtgctgcaaaactattttcactactgcgcgctgcggatgaactgtgccgaactggcgaagacctttctgtttctcgcctgcgaagggcgcgcgccgcatcttgcggagccggtggtatcgcccttacaggcgcgtcaggtgaatgccctgatggcgaccagcggcatgtatcagagcgccggagaattcgcctggcgcgtggggctaccggctaagtccggcgtcggcggggggattatcgccgtggtgcctcacgaaatggtgatcgccgtctggagcccggaactggacgaggcggggaattcgctggcgggcattgcggcgctggaagtattgaccagacatatggggcgctccgtctactgatcggcaggcagacgctcatgaccttaacttgttatgccggagctttcattgccggctgataagccatatctgatatttttgattataagagctatttcaataaataatattacattttaggtgttattaggatgtaccattatcgatgaaacgcagcatcttaaaggatcaagatatgtattatccaaattcggtccgttggcgtgagacacaatatggcgggttaaggagattacggctgggtgaaattaatcttgcaagttctctctatggacacagtatttattacaacaaagtatgggtgcattatgatagttatttgcctttgaatcttcaaccaagcgatattggtatggcaccaaatggcgaaatgtggttcagagataagcatgaagatgatttttccatgcctaaaaaaccaagggttgaacaacaacacctttttatgcatgaaatgatgcacgtctggcaacatcagcgtggaatgtgggtgagaacaagaggtttaatttcccgttttgctgattatacttatgatctcgataaaaacaaattactggattatagcctcgagcagcaggcctctattgttagcgattattggttattaaaaacctatggctttaggcattatgcgtatcttatcgattatagagactataataatgatgaaccattttttgagctacttaataaatatgagcgtgtattagggagttttcctggatgagaaaaagattcactacagttctgttagttaccctgcttacaggctgtcctgggaaagacggactgaagatgagcagacagcggtcaatattcctgaatggtgatcatatttgtttttctttagataagcaggctgtacttacacgctacattttgacaacaaatggtgcttactataaagaattgctacatggaaatgctgtcaggctttcctatcctgatacttgctttatcgtccacctggaaaaaggcgtaacttacaatgcagcttttgcccttgatggagagaattattattatacgtttataattgataatgaaaataatatcttagtgccatggaggtaattgatgtcattgccagcttatatgtttctctatgatgaaaatggtatgttgttaaacaatggttctgctgggcttggacgtgaaggcgcagttgaaatattgagcagtagttatggtgttagccaaccagtagacgcttatacgggtagaattactggcacacggcatcatgagccttatattcttcataaggatgtcgataaactttctccgtttcttgtggtgtgtgtctgtgaaggtcgtcgactaaaaaaagcagaaataagatattacgaaataaatgatgccgggattgaaagggaaatctatagagtgacaatggaaggtgttgtcataacatatgtgaatgctaatcatacgtatattccaggttccaataaacacaatatgattgaaacagtcggactaaggtataatagtattgagtggttatatcttgacggtacgatcaggtattcagatgcgtggtcaaagcctctccctgtgcaagagaagaagtaatacaaccgtcaccaaagagcgcctgttgtgtccatcgacactgtggaaagctaaccaccatggttgaagccctaaccatgctaatggggcgttccgtctactgatcggcagagataagcacggataatattaagcgtcagatgattaagatggtaaaggacatgttaagctcctgtaccattttttctgaccttatgctcgccctgtgcgattgtctggaatactaatttaatgcgccctgatgtgatgacgccttttcgtttgttccgtgaagataaaccgctgcgtaacgctgtctgtatattcctgatcaccacgctgttttacgccattggcgcgatgctgcggctggtggaagagctgtcgctgttctggccgctgaatgcggtgatggccggtatttttgcccgtttcgcctggcttaatcgcctgcataattacgccatctgttataccgcgatgatgctctacgacgggctgaccaccgactggggcccggcctcgtttgtgattaacttctccaatatggtgtttatcctcacctttgcgctgctggtccagcgggacaaacatgtccccgtgcaggcggaagcgctctctgtcgccctgcggctgtttaattactgtctgctggcctcggtgctgtgtgccttgtgcgggacttttggttcgctgggtattgacactcaggcgttctggccgctgtttgccgactggttcagcgagcagttctccactggcgtgatgatcctgccctgtattctggcgttctcctggccggggctgagccgtccgtttaaggtgcagcacctgctgccgctgatagcgctggccctgagcattgtcgcctcggtggtgattggcggggcgggcagcctggcgtttccgctgccagcgctgatctggtgcgcggtgcgttattctctgctgaccacggcgctgctgacgctgatcaccggcgcggcggaaatcatactggtggctaactccatcattaatatttccatgtccgcgaaactgcatacctcgcagatgttttctgcgcgtctggggatcgccaccatgaccatctgcccgattatggtgtcagtcagcgtgaatgccattaatgcgttaatgaagcaggtatcgctgcgcgccgatttcgatttcctcacccaggtctattcccgctctggtctgtatgaactcctgcgtcaacaggagaaaattaaccatgccccgcgcccgatgtcggtgatgctgctggatattgattacttcaaaaccattaatgataactatggtcacgaatgcggggataagatcctctctgctgtagcgcagaaagtgcaacaggtggtggggaatgccggtaacgtggcgcggatgggcggggaggagtttgcggtgatcgccagcgtaccggatgagcagcaggcgctgcaactggcggaaaccatccgtcagagtatcgagcagcatcgttttcgctggcggcaacagacgctctcgctgaccgtcagtatcgggctgagtcatgcggtgagcgaattctggcagcgcaccgaaacctttaaccgtctgctcaatgaagccgatgaatatctctatcagtctaaaaaggccgggcgtaatcgcgtcagcgtgcagggcggtgcgcagactttattgatatgactgttaaataacttgccaggtattttcggcgtcaataatatggccgggtaaacctggtgagacatgcggcatgaacggatcggacaaactgaatattaacgccagggtaactggtctgcgatttgttcgccgcatgtatctgatgcgtatgctcggtacgctactctgttttttccctgttctctcggtgctggtggaacatcatcaaccgctgtggctgatggtgctgctgggcgtcaacgcgttcgtctggcccggcctggcgtttctgcgcgcccggcgttctgccacgccgcacaataccgaacatcagaatctgctgctggatgccggagcgggtggtttctggatcgccatgatggcgctgaatccgctgccatcggtggtgatcgccactattctgctgtcggacagactggcggcaggcggcctgaaactgctgcggaaagccgccatcgcgctggtggcaaccggcctgttcgcctggctgataagcggtatgccttttgaaccgcaggtttcccagcgcaccatgttcgccacgctgccgctggtggcgatttatatgctggcgctgagcgtactgaccgacgccattagccgcaagctgcggctgaaaagccgcgagctggagcgcatcgccatgatggatccgctgctggatattgcgaaccgtcgtctgctggaaaaacgtattacccatgaactggacaccctcaaccagcgctgccgcagctcaattctgatgttcattgatattgataacttcaaagaggtaaacgatcgattcgggcataaagtcggcgatgcgctgctggtgacggtctcgaaaatcctgcacgcggcaacgcggcaaaccgataccccggcgcggctgggcggcgatgagtttgtcatcctgctgccggataccaccctggacgaagcttatatcgtcgccacgcgcattatggacggcgcgtcggtgatgaccattggcgcggatatttcattccgcacgaccctgagtatcggcatcgccagcgccactccggcgatggacgacgtcacagactggctaaaagccgccgacgatgcgctttaccgcgccaagcgtgaaggcaagaaccagatctactgtcactgacaaacgcgctgaatgaactagactttatgcatgtctggcgagaagagtgcgttatgaaacaccctgaaatccccccaaatgaatcgcaaaggatggcctcgctgcacgagtccggtttgctggaaacggcatcccgggaacgcttcgacaggctgacccgtcttgcgaaaagaatgtttaatgtgcccatcgcgctggtaagtctggtgggggccgatacgctgcactttatctcctgcgacggcattcctgatggccgggtggagcggaaaatctccttttgtggtcatgtcattctcagcgatatgccgatggtggtggcggatgcccttaaggatccgcgtttcagtgaaaacccgctggtcaccggcgagcctttcatccgcttctacgccggttatccgctgcgcgtgccggatggatccaacgtcggctcgttctgcattatcgatcgtcagccgcgggaatttacccctgcggaacttgcggtactgaaagatttcgccgccatcgtggaggatgagttcgccaccatcagcgtggccaccaccgacgagctgaccgggttgtataaccgccgtggctttgaaaacctcgcgaaattcgccattaccgccgcccggcgtcgggcggagccgttaaccctggcgtggatcgatctgaaccgcttcaaatacatcaacgatacctggggccatgaggagggcgacaatgccctgaaggcagtggcaaatctgttgcgcgagagcttccgcgaggcagatttactggtgcgctttggcggcgatgagtttgcggtgcttttctccgataccagcgaagacggcgcctgggtggcgatgacgcacctggttgagcaggcggaagcctttaatgcgtcctcacaaaagccctggaaactgtcgttctcctgggggctgagcgaatacgatcaccaggcgatgccggatatgaaaagctggttgaaaacggcggacgatcggatgtacgccatgaaagagaaaaaccgttagcacgttgatcggtagccataagaaaacgctatcgcaacgccgttgcgttaaatatttgttatcagcatagtgatcattttgaaaaggaaaacatgatgatcactactgtcctctgccgcccgctcgggcgcgatgaaattatccagcgaattgacgaactctgtgacgtgctcgaagactgcgtgcgcggcggggcgtccgtcagctttatgctgcccatcacccgcgacacggccatgcacttctggcagggcgtggcggaaagcgtggggcgcggcgagcgcgccgtgctgattgctgagaatgccgactttcgcatcatcggcacggcacagattatcctggatcaaccccccaatcagccgcaccgcgccgatgtcgccaaacttttggttcaccaatctgcacgccgccagggcgtggcgcggcagttgatggataatcttgatgatattgctaagaaaaatggcaaaaccctgctggttctcgacaccgccacaggcagcgacgcggagtttttctatgcccgcagcggctgggaacgcgtgggggaaatccctggctatgctcagatgccggacggaactgtgacggggacgacaattttttataagaatttaacatccaacgcaatttaacgactgcaattgatcaaaacagggtttcatggtcgtaaagtctggtaagttatcacaccaatcttcccaggttgtatgactaatcaataaggaacccattgtgaaaacgatcaatcgtcgcgattttcccggagcccagtacccggaacgtattattcagttcggcgaagggaatttcctgcgcgcattcgttgactggcaaatcgatctgctgaacgaaaataccgatcttgacgccggtattgtgattgttcgtccgatccagagtgattttccgccgtcgctgagcacgcaggatgggctgtataccaccatcattcgtggtctgaatgacgaaggtgaagccgtcagcgatgcgcgtctgatccgttccgtgaaccgcgaaatcagcgtttacacgcagtacgatgagttcctgaagctggcgcacaacccggacattcgttttgtgttctctaacaccactgaagcaggcatcagctaccatgcgggcgacaagtttgaagatgcccctgcggtcagctatcccgcgaaactgacccgcctgctgttcgaacgcttcagccactttaacggcgcggctgataaaggctgggtgatcgtgccgtgcgagctgattgactataacggcgatgcgctgcgtgaactggtgctgcgttatgcgcaggagtgggcgttaccgaccgctttcgtgcagtggctggacagcgccaatgccttctgttccaccctggtggaccgcatcgtgaccggttatccccgtgatgaagtggccagcatcgaagcagagctgggctatcacgatgctttcctcgataccgccgagcatttctacctgtttgttattcaggggccgaaatctctggcgtctgaactgcgcctggataaattcccgctcaacgtgctgattgtggacgacatcaaaccgtacaaagagcgcaaagtggcgatcctcaacggcgcgcataccgccctggtgccggtggcttaccaggcgggcatcgacaccgtaggggaggcgatgaacgacagccagatttgtgcgttcgtggagaaggccatttatgaagagatcattccggtgctggatctgccgcgcgatgaactggtaacctttgccagcgccgttaccggacgcttccgcaacccctatatcagacatcagctgctgtccatcgcccttaacggcatgaccaaattccgcacgcgtattctgccgcagctgctggcagggcaaaaggccagcggtaaactcccggcgcgcctgacctttgcgctggcggcgctgattgctttttatcgcggcgagcgtgatggtgaaacctatccggtgcaggatgatgcccactggatcgagcgttatcagcaactgtgggcgcagcatggcgatcgccagctgagcaccagcgaactggtcaaagccgtgctgtccgttaccgatcactgggagcaggatttgacgcaggtatcaggcctggtcgagcaggtgtcgctggatctggacgccatcctgttacgtggtatgcgcgaggcggttaagccgctgtgctgataaccggttaacaatgacccggctgcggccgggtttttactcctcattctatagttacaacatccatttgctgtttagctccctgaactgtggcttcagcgacgtaatcgtctagcaatgaaacaattgcgcgacatttacttagcatttctgttgcattggtcctaagatgagtcctgaacagaggaggaacgcgcaatggaaagaatcgttcagatgatagtggtgctggtcgcctgcgttgcggtattcgccaccgcttacgacctctctcttgttaccgatttaccctgatcatgaaagggggcctgcgcccccttgatgcgttagctggccgggagctggaagaagcgcaccgaatggcgcaactgttcactttgttcggtcatggaaagggcagccaccgcagcctgttcaaccagcgcggcattctgctgcgtcacctgatccatctggtcaatggcaacgctgatctcgcggataccctggtgttgctcatgggatgccgaggagatttccgccacaatgttggtcactttgttcaccgaattgacgatgtcttccatggcccggctggccgtatccgcatagcgcgacccttcagtgattttctctaccgtgccatcgatcagcgttttgatctcttttgccgcttcggcgcttttctgcgccagatttcgcacttcaccggctaccacagcaaagcctttgccttgttccccggctcgcgcggcttccacagcggcattaagcgccagaatattagtctggaaagcgatgccctcgatcacggaaataatatcgacaattttttgtgaactgtcggcaatctgatgcatccgctggagcatatcctggacttcctttccgcctttgacggcggtttgcgaagtctgccgcgccagctcgctggctttgtaagcgttctcggcgttgcttttcacgttttcggtgatctgctgcatgttcgcagaggtctgtaccagcgaggcggcctgttcttcggtgcgctgtgacagatcgctgttgcccatggcgatctcactggcggcatgggatatagactcactgccgttgatgatgccgtgaataatttccgccagcttgccattcataaatttaatcgtcgccagcaaactgtgctgatcctgctctttcagattaatttgagtggccagcttaccggctgcaatttgctgcatgatttccaccgcataacccggttcaccgcccagttgccgggcaaggttacgggaaatccaggcggcgataatgccggtggctatcagtgcgaggatcaataaaccgcacagcacagacaacgcctgtttatatccgtcggcggcttgttgactggcccgattgccaatggctatttccatatccaccagcgtggctaaatctttcatcagctgtgtgcgatatttcgccgacaccgcgccgcttatttggctggcctcctgtaaacgttctgcatttaccgcctcaataacttttgcattcacatcgacaaattgtgtgaagttattgaccacctgagaaaacagcgcctgcatttccggcgtcatatgggacgtcagacgggcatagcgctgctgcgcattgagaaaaatatcctgattttgcagcagctcaaggcgatgtttttcccgctcggcgggcgttgtggagctgatgtactggatctgctgtaagcgcatttccgataacacgccacgcatttcaagggaggaacgcacccctggcatacgattatcgcgaaaagcatcaatattctcattactgacgttgagctgataaatagccaccacgcccagtaacaacatcatggcaatcagaattgaaaagccggttaataatttggttaagaccgttgactgtgcatattttttcataggagtaacttagtgataaaaggtaatactattaacggcataacctttaaaatattgattccgtaagttgatcctcatcacataaccatctatttaatttctggtgtaaatcaggcgtataaatactttaatgcgatgttttaaatatgtatttttgctgtgataaatttgccctaaagcgccccggatactcgggcagattttgccgggggcagggcggtcatgctctgactggctcatagctgtgcgcattttgtcgccttattcttttaatgaatcattgcattatgtgctttactgaaagaaaggacggggcgcaggaggaacggtgaacgtcggtaaatacatcgcgggtgcgttgtcgctcaactcttcgctggggcgcagcattaccttgtttatgagcggattgctaatcgcaggcatcgccaccagcgcctggacgctgaaccgttcctgggagcgcgccatcaaagagacggagcgcagcgcaatcaacctttcggtgtcgcaggctcgtcaggcggaagataccttcgtacaggcggaactggcgctgcgtgatatccgtcgtaacgtgccgcaaagcgggatcaccggtatggatccggttaaatttaaccgctttctggccgatatcaaagagcgcctgccacagctgcatggcctgttcgtctatgacgcccagggttttatgcgcgtgacctcttttggcaagctgcctgccattaccaataatgccgatcgggaatattttgtttatcaccgcgctaacggacacggcagcgtgcacatcgggcatgtgatccgcagccgttcgaccggggatctgattattccggtgtcgctgcgcattaatgacgcctacggcggctttgccggcgtggcgctggccaccgtgaaactcgactatttccgtcacttctataattacttcgagctggggccgcgcgatctgttagcgctgctgagcaccgacggcacggcactttatgccaggccatttgatgacaacgtcattaaccgcaatctctctgtcagcccgttattcacccgtgaactcccgaaacacgatcgcggcaacgccacctggctgtcagcgctcgataaagtagaacggatttatggctacgcgcgcctggaacgattcccgctggttgtggcggcggggtatgacaaaccggcgctgtggcaaagctggctcacggaaagcctaccggatatcatcctcaacgcgatgctgttgctgggcacggtcattatgggggcgctggttttccgccaggtgagacgcaacgtacgcgatcaggcggagctgactatgctgcgggatgagctgaccagcatcaaccacaccttacagaccatggcgctggcagatggcctgacggggctggcgaaccgtcgccagtttgatctgttccttgcccaggcgctgaaaacgtcggtgcatacgcaacggcccgtgtcgctgatcatgatcgatatcgatttctttaaacgctacaacgatcactacggtcacgtggcgggcgataactgtttgcgtcaggttggcgaaatactaatgaagctgaatctgcggcagagtgatttgatcgcccgttacggcggcgaagaattcgctatcgtcctgccggagaccgatctgcgcgaagcctttatgctggcgcaaaatgcggtggatgcggtgcgctatgcacatatcaaacacgaacattcctccaccgggcgcaaagtagtgaccatcagcgcgggctgcttcagcatgacgggcaccggcactgatgacgatgcgcggataataaaagagggcgcggattccgcgctgtatgccgcaaaaatcaaaggccgagatcgtgcttttgtggtgtcgccagcgccataagcattttcttaccccgaaaaagcatgcccgacggcatgcttttttttgggcgacgttttatagcccttcaataaaaccacagtgggcgtaacaatagtttaaccatcctgcctaaatatcccaacaaccagtaccatctgtaaatgaaatattgttttaatttactatatatattatttcaactgtgatgtggctagcagatctgcgacaatcggcagtgctagtatcccggcgggttctttgcatggaaacccaaaaataatggtgtaatcagtcgtacctactgggatgagaataatggatatacttttagggcttgttaaaacgcccgccgttatcatagcaatcgtcgcctttctgggattgttatttcaaaaagcctcaatttcccgtttaattacaggaacctttttatcttttatcggttttacgatgatcaaagtgggcggcagcatcttaatgaaagtgctgacggcctttagctcactgttttctaatgcctttaacatcgttggggtggtgcccagcaacgaagccatcatggcggctaccattgataagctgggctcaatcgctgcgcttatcctgttgttttccatgattttaaatatactgctggcccgttttacccgttgtaaatacatttacctgtcgctgcatctggtgttgtttatggcatttgccatcaccgcggtgctgatgcagttcggtttcagtcataccatgatgattatcattgcctcgctgcttatcggcacctatatggcggtatcgccatttatcctgagccgctttagccgtgaaatcatcggttccaatgaatacgctatttctcatgcggctatttcttcttatgttattggctcttatatggggaaatggttcggtaataaaaatagcgataccgaacatttaaatatcagcaataaatttgattttattcgtgagccaaatattgcaaccttgttaacaatgttggtgctgctgctgatctcctgtatttttgccacccagccgcagattaaggatgccatgaccgtggtgtatggcgcaggggcaggggataagaacgtggttatctttgtgcttgagcagtcggcgacatttgcctgcggcctgtatctggctaaagccggggtaaatttatttaccgcagagatcgtcccggcctttaaaggttttgcccgtgtatttgcgcctggggccgtcccggcggtggatgtgatggtgttattcaccaaagcgccaaacgccacgctgattggcttcctcatcagctttgcggttgagctggtctgtatcttcctgttcccctttatcggtctgccgattatcgtgccggggatcatggcgagttttatcaccggcggtgcggcggctatctttggtaatgccaccggaggattccgcggcgcggtgatcgccagcagcattaacggattactgctgtgcgtattaccggcgctgacgttgcctatcttctcgcagctgggcgcgaaaggcgtaacctttgcggatccggactttacgctgccgtcattgattcttgattatctgctgcggttattcagctaaaccagaaaccgggggagcaggctcctccggttttctgaatcctgttgccgcgctttaactcgtgagagccttgcgcaacaattgcattacgccgcgccggacagtatggtgagcaggattttttctttcttcgggatcaccatggcagagcatgtttccaaagacccgctgcacggcgtcacacttgaagccttactgaccgatctggtcgcccgttttggctgggaagaactggccgcgcgcatcaatatcaactgttttaaaaaagatccgagtatcaaatcaagcctgaaatttttgcgccgcacgccctgggcgcgcaaagaggtggaagatttgtacgtcagcacgctgggtgaaaaaagcgtagcatcgcctggggaagatccctgggctaaatggaagtagggcgaccatataccgcatgccctggccgtgccggtcggggctgataacatcgcggcacggcacatttgtaaattcccttttcaaatcactgacaaaagtaatcttgctaattaattcttaacagtccactatgcgtcatcggtttggcatacagaccttatgaaagcagttttagtaaagcagtcctcatttcaagcgttatccaaagatactcttctgcatgagcctcctcctaagcgcccaataagtcatcatctgcaacaggccatgttcgccacgacgtgtggctcaaataattaaaggaagtatctatgtctaataaaatgactggtttagtaaaatggtttaactctgaaaaaggcttcggctttattaccccagccgacggcagcaaagatgtattcgtacatttttccgccattcagagtaacgattataagaccctggatgaaggccagaaagttgagttctctgttgagaatggcgctaaaggcccggcagcggctaacgttaccgcgctttaaccgcgaaaatcgcactgacgcttacgacagcgatgacggtataagcctgagcagataagtgaacgtgataaaaaaacccgccatgagcgggttttttattattttagcggcaggatttatacgccattattcaggcagcgcatagaccacgacctgatcgccaacctgatccttcaggatagtattcccgcctgccacgaacgccacatactgacggcctttatattcatagaccgatgggttcgctaccgcaggggcttccacctgatcggaccacagctcttcaccgctctcaaccgagtaggcgcgaactttggcatccatcgacgcgccgataaagaccacgccgccagcggtgacagccggaccgccgatagtcggtgagccccagctttccggcataaagaagccgtactgctgagacgcgccaaccggacgacgccatttcacatcaccggtatgcatatccagcgcgacgatttcgccgaacggcggctgccagcacggcatacccagccagttattcgccaccatcagacgcataccgtaaggcgcgccttcctgcggtgcgaaaccgctttcgttaccggaacctttatccgctttatcgtaatcttcgcggctgtaaagcttcacatactgcacaatgtgcgaggtgttgacgatggcgatctgtttttgcggatcgaatgccacgccgccccattgcacgccaccggcgctgtccggataggtcagggcgccttcgcctttagtggttggcggcgtatacatgccttcataggtcaggttatcccacagacgggagcactggcccgcgcccaccatatccgccagtttccagatttccggctttttcgattgatcgagcagcggggcgggtttggtcgggaacggctgcgttggcgaaagcacttcgccctgcaccgaaccatcgccctgcggcaccggacgttcttcgattggccagacatcctcgccggtcagacggtttaccacaaacaggaagccctgtttggtcgcctggatcagcgccgggatctgtttgccgtcaacggtgatatccatcagcgtcggcgcggagttgatatcataatcccacacatcatgatgcacccactggcgtgaccagaccactttaccggtgttaatgtccagcgccgtggtggaagtgccgagcgggatcggatcgacgcggttaccgccccagtagttaggggaaggagaggagaccggcagatagaccagaccatgggcttcatcggcagacatgtgcgtccagacgttggcggtaccggtacgtttacgaatttcttccgggatcgcctcaaaggtccattcgcgctcgccggtctgcgcattaaatgaaaacacgctgcccggaggcgcttcggcataagcccagtctttaccggcccagccaaccagcagatgattaccgacgaccgttggcggttgcagtatcgagagcggatatttggcgtttaccgtgttccactgattaatatccagcacgcctttatcagcgaaaccttcgcacggcttaccggaatcggcgtccagcgcaaagagtttgccatccaccgtacccatatagacgatcttctgacaggcctctccggcgaccggattttttgcctgccagtaagagacgccacggtttttcagtaccggctgcgtcagcgctttgcgggaagatttggtgtcatagtgccacttttctttgccggtgcctggatccagggcaatcagacgatcaaagggtgtgccgatatagatcgtttcgttggcgaaaatcggcgtggctgaccagacggtggcaggcgtatcgcctttgccatccgacacatcgccggtatggaactcccagactttcttcagtttaccgacgttttccgccgtgatttgcttcagcgggctatatttctgggcgttaagctggccgtggaagctgtcccaggtggcggaagacggcaccagagatgtcgccggattgccggcagattcaacttttttgccgtctgactgaccggaagacgcctcgtcagtggtttttgtggtgccgggatcttgctgatccgctgcgtccacgttcactttttcctgtgttcccatcgaggcttcagcggctttgtcctgcgcctgaagggagaggggcgcgaccagtagcgccagcgccgtcatgctgactttcattaagggatagtgtttatcgttatacacgggcgattcctcagacttttacgcgatggttgtgatgcgcggggttgcggctcatcatgatcagaccaatgagaccgactaccattgcggccgtaatgatgtactggtgcagcagcgccgctgcaaaaccaataccgaccagcatgatcagcgtaataatcaccagaaaaatgcgcataccgcggcgggatacggcacgtatagcaaaggccagcagcgccaccacgacacagtcgatagccacgcccagtgcgccgatggtaccggtgacgccggtaagcggcgtcagccaggcgtatagcgcgacgacgaagccgatcacggcagccagcagcagcagccagctgccggtgcgcgaggattgagtttgtaacatccaggaagtccccatcaaaaataaaaaaagagtaacaagggtgtatcggtgaattttgcagctgacatgcgcagcggcaaagttcactgaacgtaactcagtatagaagatggttttttttatggggcgctcaaatctgggagttgccggtcagcggttcatcataaaggtttaagatgcaggcgtgccggaatgttaactttagctaaacttaaatctcagctcttaacgcaaagaggagaaggtaatggctgatccaatacttattgatacgctggagtttggcaatgatggtgcgaccgctcagaagtatgagatttatggcgatgatgagcaaagacctgcctatgcgctgatttaccggcaagatcagggcgagtggatcaaacttgatgaaacgcttgagtttgcggcccgggaggagcaaaaagcagcgtcgtctaccatggattatggatccagtgacggcctgccagaactacgcgatctccccggtgaagcgaaagagcgctgcaaaacacactggcaggaaaaccagggaaccggtgatggcgcagcttcgtcagcgtaaagcgtcaacgccggtaactgtgcagcatgctgaaatgaacgtccgcgccaggcgggcgtaattatgttaaatgtagagcggcgatattccaaagtcatctcattgtcttaccgcttcaaagtcgtatcccttcattaacagctttcaggctgtaatattgataaaacagcctgtagggtgtatcttcagaatacagcctgagagttgtatcagctcccgttaaagtggcctcctcattatgaaaaatgtttacccgttaaaaacgcttaaccagctgcgtccattactccttggttttcgcaaagcgcatggcctgacgcaaaaagaggtgtccgaaaggttaggcgtaacgcagcagacttacgcccgtctggaggccaatcctgccagtgccagcattgagcgcctgtttaaggtgttttccgtcctgggtgtcgaaatcagcctttcctcagcgacccttgcctcagagaacaggcaggcggagggaaattcagatttacattcacctgcacggctggagaaatggtaacgatatgagcaggataaagccgcgtttagcaatatggatgaatggcatccacgtcggattctgggagaaaagcagaggggaagatttattgcgctatctgccggaatggattgctgacgggcagggcaggcctttatcactgtcccttccttttacacccggtaatcaagcctggcgcgggaatattgtccgcgactattttgataatttattacccgacagtgaagggatacgccgacgcctggcgatgcgctatcaggcagaaagtcttgaaccttttgacctgctgacagagctgggaaaagactgcgtgggcgcgatacaacttttgcatgaagacgaggagcccacggatttatattccgtaaaatatcgtccgctttctgcatcagaaatcgcgacagccttgcgaaatactacccaggtattgctgcccggcaggcaggatgatgctaacgatctgtgtttatcgattgccggcgcgcaggaaaaaacagccttactgtggcatgaaggccagtggtgcatgcccgaaggtaatacgccgacgacccatattttcaagttaccgctcgggctggtcggcaatatgaaagctgatatgagtacgtcagtagaaaatgaatggctgtgttcgttgcttcttgaacactacggcatccccgtggcacgaacggagatcgcgcagtttgaagatcagaaggccctggtggtagcgcgttttgaccggaaatggtccgccgatcggcagtggatcattcgtttaccccaggaggatatgtgtcaggctctgggcgtttctcctttacgaaaataccaggcggacggtgggccgggtatttcggacattatggaaatactgagtcattctgacctggctgaacatgacagagcgcagttcttcagagcgcagattattttctggctgatggctgcaacggacggccacgccaaaaatttcagtatcgcgatcgcgccgcagggccgttatcatctgacgccgctgtatgacgttttgtcggcatggtcggtgatcggtcacgggaataatcagatcgcctggcagaaatgcaagctggcgatggccgtccggggcagcagcaattattaccagatttaccgcatacaaaaacggcactggatcaaccatggcaagctggctggcctgggtgagcagcagatagaaaccatgctggatgaaattatttccgtgacgccgggcgtcattgaccgtgttatggcgttacttccgcagacgtatccgcaggaacttgctgacagtatttttaatggcatcaggcagcaatgcaggcatctggaagaaaaatagttatgcatcctgaggacgggtcacggaaagctcaatgccacacaatctgcataaatgcattctggtgcgcataatgtatattatgttaaattggatttatggttacgcgcaccgcctgtaagtctgtccccgcccctcatcatcacgagccgatctcttatacaccgcttaaaacaaacccggcacgacagccgggtttatattgcaaccttatgcgactcacgcaataaaccgttattccacgtctgcgccagcagcatccggcaacgcctgttccagcacgtcggtacacagacgcacggtttcgcgtaatcgcgcttcgctgtaccctgcccgcgcactggcggaaagtccggccatcacggttaccataaaatccgtcagccgttcggcttgatcgggatactgtcgcgcaatgaaatcgcggatcatggtttctgctgcctgatggatttcgcaggccgcttcgcgcgcttcccgatcgtcactatgcgtgccctcgaccaccatacagccgctggcgatgggatcggcaacgtagcgccttgccgcttcattcagcacagccgccaggcactgcgctaccgggcgatctgtacgcaaaatttcggcaaaagggatcgcgccctggcgggaatagcgcgccagcacacgttgatacaggccgaacttgctgccgaacgcggcgtaaaagctgggtggattgatgcccagcgctctggtcaaatccgctacgctcagggcgtcgtatccctttgaatgaaaaagtttttgcgcagttgcgatcgcctgctctgcatcaaacttgcggggacgccccggtgttttactttgttttgtagtgaccactacataactccttgacaggctgcgtgaccgttgaatattgtaatcatcactacaatatcacaaggacacgcacatgacttcatttcagcataaatccgttctggttattggcggcagccgtggtatcggcgcagccatcgttcgccgcttcgctgccgaaggcgcatcggtcactttcagctacgcgggatcgcatgatgctgccacacagctggcggcagaaacaggcagtaaagcggtgcaggcagacagcgccgatcgcgacgcggtgatcaatctggtacgcgcggccggaccgctggacatcctggtggtgaactcaggcattgcgctgtttggtgacgcgcttctgcaggatagcgatgtggtggatcgtctgtttcgcatcaatatccatgcgccctaccacgccgccgttgaggctgcgcgtcagatgccggaaggcggacgcatccttattatcggctcggtcaatggcgatcggatgcccctccccggcatggcttcttacgccgtcagcaaatccgccctgcagggcatggcgcgcgggttagcgcgggattttggcccgcgtggcatcaccatcaacattgtacagccaggtccgattgatactgacgccaacccggaaaatggcccgatgaaagatctgatgcacagctttatggccatcaaacgccacgggcgtcctgaagaagtggccggtatggttgcctggcttgccgggccggaagcctcgtttgtgaccggcgccatgcataccattgacggcgcatttggcgcgtgatccgtcggggttcggcatcgccgaacccctcattttgccgtttctgccctgcccttactccagcgccagcaatgcaaagctcgccagccagtgaccgccgctgtaatggcttcccaccacatgctccacgctggccgtcagatgacgcgccacggcttcgcgcagcggcgtctgcgccggatggttttgcggtaaagcttttgcgatatgcttcatacaccaggcgcggctcaggttgagcccgtcaagatgcgcgattttcggatcggtacggtcgctcacttccgccgggttcatcagcgccgacaccgatcccacatgcggcaggaatgcatcgaaccacgccgggaatttatccgccactttactcatcagcagggcttccgttaacgcgccggaaatatactcatcaccccctggctcataatgcgcaggataatccgtatcggcctgataaaagcgcgtcgccgcatccagaatggcctgctccagcggacggtcagtcagcgccctggcataatccagccccagcgccagcgcaaaggccgtgttgtaatgcgttccgacgcggatcggatacgtcagcttgctgaggtaatccatcagccggttgcgaatatcctgggttaatggctccagcagttgatgccacttctgcgcctgcggcagtgaggattgtttcagctcctgcgccagcgccagcagccagccataaccgtacgggcgctcgaaggatgcgcggaacggcgcgttaaagtacgccagttcctgggccacgttttcttccgtcatgtgttcgtcaaacagcgcaacgatgtcatcacggcaggacaactccgggtatagccgcacgcagcgtaacagcaaccagtaaccgtgtaccgccgagtgccagtcaaaacagccataaaaaatcggatgcagcgcgcgcggcggtaagacatcaccatcatcattaagcagatgcataatgtgattagggtattcctggcgcagataggttaaaggcattctggcgaatgcatccgcctgatgttgcgttaattccataacagctccttagctcaatgccgcgcttagcgaaacgcgaggaaatacattaaaatgacgttcaccaccagcagcgtcagcgccgttgggatctggatcttgatcacctgatatttatctttcagttccagcaacgcggcgggaacgatattgaagttcgcggccatcggcgtcatcagcgtgccgcaataacccgcatacataccaatcgccagcagcggcgccgggttgccgtgatgaacgttaatgaggaatggcagcgcgatccccgcgctcaacaccgggaatgcggcaaaggcattacccatgatcatggtaaacagcgccatgccgatacagtagatcaccaccagcatgaagcggttatccggattgacgaacagactcaccactttttgcaccgactcgccggtattcgccaccacaaagaccccgccaagcatggcaagcatttgcggcaggatcaccgcccagccgatagtgtccacaagacgccgcgactggcggatcgcatgcagcggcgttcctttcgtcagccaccagcccgtgaggatcgcggcgacgcaggcgacacagagcgcggccagcgtgagctgcttctgatctagcagatacacgccgccaatggaaacccctttcaggaacagcgtgccgatcaccgtcaccacggggatcatcagcgccggtaaaaacagccagtttttcagtcgccgggatgaggcttcccgctcttcatcggtggacattttatagtgtcctttgcccaccagcccaaagcctgccagcaacgcaatggcgatcacgccgccgccaatgatccggtaagccagcgatttgcccagctcctgcaccatcagatcgccgaacaggaaaatgccgccgaatagaaaccagaatagcgcggtggtaaagcgtttcgggttagcccgatcgcgcagcgtcataatgaccagcagcatcacaacaaagccgatgaggtaatagacgcggttaatggtgatcaaggtgctcatcgtgtcgcctcctgtgcgccctgctctgctttccaggccatgacgtcgcgacgaatactggcatcaaggcgcaacaagcgggtcatatgaataattaatgcggcgatagcggtgggaatagcccacaggccgatatgcagcggttcaatgccctgaatgccgctctctttcaggaaggcgtcaatcagcagtaccgcgccaaaggcaataaaaatgtcctcaccgaagaagacggcaatattgtcacaggcggcggcatgggctttgatcttatcgcggatatgttgcggcagttcgccgtattcattgagcgccgccccttcggccatgggcgcaagtaacggacggacggtctgcgcatggccgccaagggacatcagtcccagcgcggcggtaccttcacgggcgacaaaatagagcatcagaatacgtgccgaggtggcgctggctatcttcgccacccaggcctgcgcccgctctttcagcccgtaatactccagcaggccaatgaccggcaggatcagaataaaggtggccagtgagcggctgtttacaaatttttcgccaaaggtttccagcagcatgccgaaatccattcccaccagcagaccggtcgacaggccggcaacgaccaccaccagcagcgggttaaatcgcagtgcaaaaccaataaccactatcggtatcccgatgagcggcagcagcgtagaaccgtccataacttttatcctgtctaaagtgagcgttgcgcgccggcggctatttttttaatacttcacatcaaggcgaagcgtgatccataacggcgaaagatgttgtgttttgccagggatctgtcattcgcacagagcctgtactaaaaatctataactgaacggcaaaaacatgtaaacaatttatcaataaaatgttcttattttatcgctttgcgtttacatttttggtgaagagtcacaatccgataagggacgttatgaccacaaaaaagagtgccacctcaacgcatcacgacgatattgctgacggccgtatcgtttcctcccgccatctggtttctgagcgttgcgcagagttatcggagctcgagtacgcgctgatcatgaccagcaatgcgtttaacaaatggatggtgcgctgtatgaccgccgccggtgagccggatatgggcgcttttgacgtttcgcttctgcatcatgtgaatcaccgcaatcgcaaaaaaaagctggcggacatctgctttgtgctgaacgtggaagacacgcacgtggtgacctatgcgctgaaaaaactggttaaggcaggctatgtgaccagcgaaaaggcaggaaaagaactctttttctccaccaccgatgaaggtaaagccttatgcatgaaataccgtgatgtgcgtgaagcctgcctgatcaacattcatgctgaaagtggcatagcaggcagcgccattggcgacacggcacagttgctgcgtaccatatcttctctgtatgacaccgccgcgcgggcagcggcatccttgtgacgcagcgttactgcacgggcgtgaactgacgggtcacgtccccctgtttgatctcgccatcagacaggctgagcgccctttccccctgactgaagtcgattttattgagatccacccagaccgtggagggagaatccgccagatcaaacatcatgatgttgtttttaagatcgcttatcccgcgccagagggtggtactgttctccggattcctttcggttgagatagcgaacggcgtggacagcgtgcgcatgacggaaagcacgctcatacgcgcctgcatggcgaaattcttaccgggaaccaggttaataatagtgtccatcttgtcagggctgatttgttccagccagcctgtcgcgcgcataaaacggtctaccgagtggggagaaccaggcatgtttctggcgagattcttttcgttataataatcatatattttcagcatggattcataactgggatcgttggtcattacggcgttgcctgctttgggatatattttcagtttacccccggcaatttcaataatcatattcgcgccgctgcggtcggtaaccatataatgcagtcctgcgtgcatgcccttgctaatcatatgtatcggctcgcttttaagcgctttttctgcctcctcaaccgttgcgaaattatccagcacgtactgaataaaggtttttgcctccagggttttctctgccggtgaagccttgccgtatttcgcctcgccgagatataaaagatcggcctgcaaccccttttcattcatgcctgattgcggcccaggtgacacgggtgcaggcgtcagaggatgagagtgtgcctgctgaaagtatggcgctgcaaaaaagagcaatgactttcttatccataatgtagctcctgaatttcctttttataatgaccagtccaaccttagcagtcagcggttttagaaaaataagcaaattaaaagatgttcagtgttcactgcaaaagacattaaatgcgctttataaaagtaaagaaattaacctcactgctaaaatggttattagcgttgctacactattatggtgagatagctgatcgtattatttcacccttcatgatccagatcatatttatgtctgaatgatgcttttactgcgaaattgcggtgcagaaagccgccgtaaagccgatatgcaatgatgaatatcaaagcgggttattagtttcgcaggagagatcatgaagttgaataatatgagtgtgggtatgcgcatgggaaccggctttgcccttcttttgctcatgtcagtcattatgggaagtagtgcattctggctgactatgagcagtgagaagaaagtagaagaaatgatctcctggcatcttgttaaagaaagaatgattgaagactggacaaggcttttaaatactaacagcggagtagccatgacggcgatgagcaccgccgatcctgccctgcgcaaatcgttgcaggaaaccgtggagaaaggatccgcggacatcacccgtgttcaggaagaactgacgccgttattgcgcttaccgaccgggcaacgcctgctggcgaaagttagcgcggcgcgtgaaaagtttgtctccttacgacaggaaggacttcagcttgcaggaaacgggcaggatgaacagatcagcgcttttatactgaatcgcttttatccggcaacccaggaatacacccaggcactgaccgagctgcgtgattttcagaaagcgctcatcgataaaacctatgcggacattcggcgggacgcgaatcaatcagaaaacatcattctgacatttattattgccagcatcatcctgggcatcattatcgccgggtatatcacccgtagtattacgcgaccgctgtctgaggccgtaagcgttgcaggcaatgtttccgcaggggatttgacggtggaagtgaatgtccgctcagacgatcagctggggatgatgatgcagtcattaaaggatatggttgccgggctgggcagtaccgtcacggatgtcaaacagggcgcgctgaccatttcccatgccgccagtgaaattgacgccggtaatcaggatctggcgtcacgaacggaagaacaggccgcaagcgtggaagaaaccgccgccacgctggaacagcttacttcaaccatcaaacggtcggcggataactcccgccatgttaaccagctgtttagcgaaaccggggacgtcatccgcaaaaatggtgcgcgtatgaatgacgtgctgctcagtatggaagatattcataatgcctccggcaagatgaccgacatcgtcaccgccattgaaggtatcgccttccagaccaatatcctggcgcttaacgccgctgtcgaagcggcacgggccggtgaacagggccgtggatttgcggtggtcgccggtgaagtgcgcaccctcgcccagcgaagctcctcttcagccagagagattaaggagatcatcggatcgtccctcagcaaaatcgacagctgtcgtgaactggtggatgaagccgataaaggaatgaaaggcatcgtgaataatgtgatcgacgtgcagcagctggttgatgaaatcgcccgcgccagcgccgagcagagcgacggcatcacccagattaatattgccatgggtcagattgataccaccacgcagcagaacgccgcgctggttgaacaatcttccgctgccagcgcatcgctcaaggagcaggcgcgtctgttgttaaacagcgtggaggtctttacctgtcatgacgctgacagggtgcaggcctgagataacttcccgccagccgtggcgggaatgcttaccctttcccgccggtgattaacactcttcccttttctgccgataaccattccggagacctctggataataatcatctgtacccggtgatgggtgagcgataaaaaatgaactggcaacctactcaagcgcttaacgctgtaaagaccgacaccctcagcatagtgaagaaatcaatgctgattatgatcctgatgattgcggtgatgtttatcctcgccatcacggccacttatcatgtggcaggcgatcaaaatgcgcgttccgatttccgcagcgggaatttgctgaaaaaagcgatagaaaaccggaccgccaccatccgcgatcatctggcggactatgccgactggggagaagcctacattaatcttcaccagagtatgaatttacagtgggcatgggaaggacagaacctcggggattcgctgtacaaattatttcagtacgaaggggtttttgttatttcacccgacggtcaaaccaaatacagcgtgctctacggcgaacgcgtgcaggatccgttcgaaaactggctgggtaagccggttttacaggcattgcagaatgagctgatgttcactaaaggcctgccgctgacgcgcatggtgattgccaaaggtcagccggtgattattggcgcggcctggatcaaagccggaagcgatagccgcgtactcaccacctctgataaacactcgctgatgatctttgtcgataaactcaccccggaaaaacttgtcctgatgggtaacgagtacggcgttgaacaggtgagctataacaggcatggcggcacgccgtatcgccagggcgaggtgtccatccccaccgatgagggcagcatgatcctgaactggaaaagcgatgatccgggtggagcgctgttaaagtgggagttaccgttattgctcggtatggcagccattacgctgttactggtgctggcgctgctacgcaacgtattagccaaagcgcgcagcaacgataacaatatcgggctattaaaacagagtcagctggcgctggcggcgagtgagcggcgttttcgcgatgtcgccgaagccaccaccgactggatctgggaaatagaccatcagcgtaaacttagctggatctcagaacgtttcccggcgatcaccggctatccaacccgtcactggctcgggcgaagcctgaccgactttttgccccagtctgccgccgagatttcgcagtggttcagcgatccccgcgcggatacgctttttaccttaaaaaactgccgttatgtctccgccagcgggcagacccgttattgcagtctggtgataaaacgcgtcgatctgccgggtggcagcacgacttacaggggcacggcgacggacgtcaccgccgagctggaagcccacgaacgcgtgaaattcctctcctgccatgatgaattaaccggcctggcgaaccgcatgtatctgaaggattttctcgaaaccagagtgcgtgagcagccctattttggccatcagattgcggtcattaccctggatctggataaattcaaaccggtaaacgatctctttggtcacgccgccggcgatacacttctcaaacaggtcgcacgcctgctggaaggctgcatcaataaaaacgatctggtcagccgccacggcggggatgaattcgtgattattctttccgatattcagcacgtagcgcagatcgatgcgatatgtgaaaaaattaatgcggcgatcacagcgccctttaagatagtggagaacaacgatatttatatcggcgtcagcatggggatcgcgctctatccgcaggatgcgcaaacgccctgggatttaatgcgcttttctgacatcgccctttatgaagcgaaaaaagaggaacatacccgctggatctacttccgccagaatatgatcgagcaaatcatccagcggcgggaaatggaaaacgatctgcgctgcgctatcaatgaaaaccagttcattttgtattatcagccgcgctacgacctcaagcagtcgcgtattaacgcggttgaagccctggtgcgctgggaacatccccgcctggggctgctgatgcccgaccagtttattccgctggcggaaagttccggcctgattatggggctgagccgttgggtgctgaccaaagcctgtatcgatatcagcgaaagcctgccggagatgatcctgtcggtgaatatctccgccgtggagtttctcaatcccggactggtgcagcgggtgaaggaggcgctgaaggtttccggcctgcctgccgcgcagcttgagctggaagtcaccgaaaacgtgacgctgtcacaaccggagcgcgtgctggagatcatgcatgaacttaaatccatcggcgtgcgcttcctgattgacgattttggtaccggctattcctccctgaactatctgcgtacctttccttttgacggcatcaagctggataagtcctttatctttgccatggagtcttcagagaccgcgaaagacgtgatcgagaatatgattaatctcggtaaatcctactccctgaacgtcacggcggaaggcgtggaaaccaccgggcaactcaccatgctggagaagtataagtgcgatgaggcgcagggctactacattggcaggccgatgccgctggataaaatccagctcaataaaatgatgtgatacgggagccgcgaggctccctgttttacccgcaggctagcgcgccgggcgcaggttaaccgccagttccgcggcagacgccctgaacgctttaaggacgttttcatccggcagcgcggccaacgcccctttggcggtggtggccagcgcgccgcaggcgctggcctggctgagggcctgcttcagctgcgtcagatccgctaacgcattcccctgcgccaggcttgccagcaatcccgccataaaggcatctcccgcgccggtggtatccagactgtccaccttatatgcgctcatctcaacgatctgatcctgccataacaccacagagccatccgacccgcaggtcacgaccttcaggcgcgacggatacccgcccaaaatcgccagagctttgtcatgctgcgtggtgccggttaaccagtacagctcctcctgtgaaagcttgaggatatcggcctggcgcgcaaaatgacgcaccgtgtcggacatctcctgcgcatccggccacatctgttcacgcagattgatgtcaaaactcagcagaccaccgcgctgtttaatgctgccaatggcgcgcaccagggtttcgcgacaggtcgtggctaccaacgccagcgaacaaaaatgcagaatgtcgtcggcaaattccggcagcccgtccgccgttaaaaactgatcggcggagggatcgaccagaaaagtgaaactgcgatcaccctcgtcccccagcgacaccagcaccgtgctggtacggtgctgcgcgtcaaactgcatatgacgggtatccacgccctgctcagccagcgttgtttgcagaaaatggccaaagggatcgtccccggtacggccaataaagccacaatccgcgccaagtttcgccgcgccaaccgcgacgttaaccggcgcaccgcccgcacaggcgctgtactgcatctctccctgcggtaacaagtcgatcaccgcgtcgcctaatgcccagatcttcatacactccccttaacctgattatcagaacaaatatttaaagcgcacccgcgcgccatagcggtcgtcattgctgccgctttcagacgccgaggcatccagccaggaggcgtaagccccgaggtaaatattgaaattcggcatatccatgatctccggcagctgccatgaggtatgcagggtgtggatgtcgtaacgaccgggggcgaggatcgcgcagtcgctgtcacagtcggcatcgacgcccgccatattgaagcggtcgattttgttatgggcgtagatatagcccagctcgacgcgatgccagagggcattgattccggcgctgaagtctttttcgtctgccgcatccaggtaggcggtgctcagattcaccaccgcgccgttttccgcgtcgatccgctgggtgttccagctcatggtcataccgtaaccggtgcggctggactgatcgcgaaagcggccgttctcctgctgatagccgtaagcgttattgaccagattgctctccagcgcggcggccaccgtccaggggccggactgccaggcggcgaccgggcgcacatagaccacgtttttgcggttatcgagtgcgtttccatgatagttctgatcgacgaacagcgaactgccgtcctcaaccagcgtattgacctcgaaataccagttatcaaggtttttactgagcaggaaattgccgccgctgttgctgcgtccgcgcccttctttcatcatgtagatatagccgtagccatcgctgtagagatcgttggcggtattaccggaatattcaataaaggtatcctgattaaacgggaacatatcccaggcttcaaaacgccctattttaattttccagtcatcctgctggccgaagaaaaaagccgcgtcgtcaagattcattttgccgctcatatccgccagcggctgtacgctgaatccggcatatttgccgtctgcgccctttctcatcccgtcgaagccaagcagaatgcggccgtttatatcccagcgctctttttcacccggcgtccagtctttattagcgctggttttaagggacgtcagccctccggtgcggctggcgccgtccatattaaattccacatcgccatagaattttaattcgtcggtgtcattcacctgtaaagagggttttgccggtgcagcgctggcaaccgcacggggcgcgtcctgccgttttaaggcgcggatctccgcttccgcgctggcggctcgcgcttcggtggccttaaggcggctttccatttgcgccagacgcgcttccagtgaaagattttcctgcgcacagaccacgctgctgaatacagacgtcaacacacaaccgatccataatattttcatcggggaaccttttttattatttcgctattcaatcattaatggtgcagagggtattccggcgacagcgacagcaataacccgcccgtcgccagggacgggttattgataatctgagtgtgatttattccagctgccaggcgccgccgtcggttaatgaagcgcttccgctccaggcgaataaacgtaattcccggtttccggcatccggataaatacggctgctgaggcaggcttcgccgttattcacaaaaacttcaacggaggagctgtcgataaacagccgcacactgagatcgcgatcgggggataacggcacgctgcgcgtcccgcataaagcgtgctgcggataataccgctccagcaccagccgctgctgctgggcatcgacatacacccgcaggccgtcgccgaggctgatgccgtattgttcggcggtgctgtcggcgctattccagttcagcaccacttccatggccccggcgttttccgccacgctgatctgctgatttttaagggtgctgaccggccacgggaaccaggcctgacgcaggctttccacctctttcgccgggcgcatttgcaggcggttatcatggctcaggctaagttcccgcggcagggagagcatgcccgcccagccgtcctgctgctccggcagcggcgactcccacatatccagccagccgatcacgatgcggcgtccgtccggcgttgcgaaactctgcggcgcgtagaaatcgtggccgtgatccatttcggcaaactcaccggcgcggataaaaggctggccgggctgccagtcgcccaccagataaccgctctggaacagattgcgatttttgaagccgtcggcgttcatgccctgcggggagaacatcagcacgcgcctgccgttcagggtgaagaagtccgggcactcccacataaagcccatgccggcttccgcttcatcgagcacgccttcgtcctgccactggcgcagatccgccgagcgatacagacgcacctgtccggtttcgcccagacgtgcgccgacgatcatgtaccagctatccccttcgcgccagactttgggatcgcggaagtgatgcacgcccggcggcgtattcaccacaatgccctgccgctcaaagtggatcccgtcgcggctggtggccagacactgcacctgatagaggttgtcttcgttaccggcgtcgccgtgaaatttatggccggtgtaaatcagcgcgagggtgtcgccgtccaccaccgccgagccggaaaaacaaccatctttatcttccggtccttccggggcgatggccaccggcaaatgttcccagtgcaccagatcctgactgcgcgcatgcccccagtgcatcggtccccattgcgtggaataaggatgatgctggtaaaaagcgtgataccagccgtcgaaccacaccagcccgttgggatcgttcatccagcccgcacgggccgccagatggtaatgcggataccagcgcaggttgagcgcgtcgcgctttaccctgagttcctgttcagcgtcagcaattgagtaggtcatagtcttcactctttattcagatagcggaaagttggggtacctgcggatccgctgaagccttgccggatcgcagtaaaaagatggagataaaggtgatgccgaacaccagcatgcccataaacagataggattcggcgaagccatatttttcgtagctgtagcctgccagcggcgacagcaccgaggcgatcaccgaactggtgcaggcaaatcccaccagatagagcgtggatgagaggcgtttgtcgaaattcaggctgttgtatttgaagatcgccaccagcagcaccggcagctcgacggcgtgcagcagtttggtgatggaaattagcagcggcccttccaccagcccggaggcgatcatgcgcattgccatcaccatgcccgcgaagatcaggccgtttttcgcgccgacgcggttcaccagccagggcgcgcaaaacatcccggcggcttcaagaaacacctggaaggagttcagatagccgtacatcgcattgccttcctgcgacgtggcgaactgtgacgagaaatagaccgggaactgctgatcgtagacgccataaatacaggtgccgacgacaaagaacaccagcgcccagaagcgcggcagcgtcaacagacgcagcgcgtccgccagggtgactttaccgcccgccaccgcctcctgcatggcatggggcgcggaggagacccgcagacgggccagcagcaccatgaacaccagcccggaacagctggcaaccgcgaagttcagccgcggatcgatgttaaacagcagcccggcgaaaaaggtcgccaccgcccagcccagcgatccccacatgcgcgccttaccaaattcaaactggctctgacgcgccacgcgttcggtgtaggattccagcacgccgatgccgccgttaaaggtcaggccgataaaaatgccgccgaatacgctgccgagcagaatgttaatggtcagcagatgcccgaacagcaaatacgccgggccggagaggatcagcatcgccgtcagataccacagcagatgcttgcgcagaccgagtttatcctgcacaaagccgtaacagatctgcgcgaacagcgccgaaaccgacagtacggcaaaaataatccccgtatcccccgccttcagcccgacttcctgatgcagccagatggaaagcagcgagcctgaggaggaccaggtgacaaaaaagaagaacagcaaggcactgagtaaagggtaactgtgagaatgatggactttcatcatggcgatctcgtgttggagtaatgcgctaatggtaacgttaacaaaatctcaccttcacgccgttttgctgagattcatgatgttaatcacaaaagttaacgttaacataatggagatgagatcgcgatcaacatttcagacccacagactgcgacacagcggaaaaggaatagcgtatgatccttttacatcagcaacttagttatactgccgctggcagcgcggcaatgatggagtaaaagaatggcctccctgaaagatgtggcaaaactggcaaacgtatcgctgatgaccgtctcgcgtgcgcttaacagcccggaacggctaaaaccggaaaccctggctcgcgtacagcaggccatagaacagaccaattacgtgccggatctgtccgccaaaaagatccgcggcgcccatgcctcccccagcaccatcggcgtgctggcgctggatactgtgaccacgcctttctcggtggagatcactctttctattgaagaaaccgcccgcgcccacggctggaacagttttgtggtcaacatgttttccgacgacagcccggacaccatggtcgatctgctgctctcccaccgaccggacggcattatctataccaccatgggcctgcgccaggtgccgctgcccgccaagctgctgacgctgccctgcgtgctggcgaactgtgaaagcctgcacgatccggtggccagctatattccggatgacgaacagggtcagtacagcgcagtgaaagcgctgctggcggcgggctatcgccgcccgctctgtctgcatctcccggaaaagcatctggcgaccatccgccgccgtcaggggctggagcgcgcctgtcgcgaagcgggtatcgatccgcatacgcttaaccacgcgtatatggaatttggcgatgaacactaccgcgatatgcccgccctgctgctggcgcatatccacgacggcagaccgcagttcgacgcggtgatctgcggtaacgaccgcatcgcttttatggtctaccagacgttgctggcacaggggctgcgcattccgcaggacgtggcggtactgggttacgacaatatggtgggcatcggcgatctgtttgtgccgccgctctcgacggtgcagctgccgcattatgagattggtcgtctgagcgcgctgcatatcattcaacagcaaactcatcgcgatactgtccgtgtggaaagcccgctgctgctgcgcgagtcgttgtaaaacgcgcccccggacaggcgggcgcgtgtgccgggattactcttttgcgatcggcgtggcgttctcgtcgattttcgtctcgccctgaatggcggtaattttcttctcaacgtccgccacctgttcactgctgtgcaacagggtgtaggtcagatcaaactgcgtactcgcccctggctggagctgcttcacgcgtttctgctcgcgctcgatggtcaccggataggcaaaactggtgcccggctcaatgccggtgacgtagccctgtttgagggtgtcggtatttttccatagcgtcagcaccggcaactggcgggtgtcgaactggatggatgcgcccttatcacccgctttgttcaccacggccgccagcgtctgatgatcttcccctgccagcggctgaatgttgaataccatctcgtcaaagcctttggtcggcccggcgtaggtctgccagtttttcaggccctctttggcatagtcattgaacggactgatagcggacatcggcgcgaggaagcgcgcgccctcttccaggatcggcatgccgaagttgctgtgatagatgatctggtaatcgtgcggatagtccgcatcgttggtcagcacatcgtgcaggctgaaactgttgctgcccggcacgtagcgcagctcggtcagggtctgcaaatccgctttcttgaaggtgctctctttaatcaaccctcgaatgcggatctcatagggcgcggcgtccgctacctcgacttccacctgcgaggcgggcgtattccccgctttgccatggagcgtatagatttggccgtcagcggtgaccggatgaccggtccattcgtagccgcagcgcaccatcatttcgttgaaaccttccagccagcccagcccgttacggctttccagattaataaacgccgggttaaccacctctttcaccggcgactcccagcccatttttgagccgaagccttccacacgcagcagattcataccgcgcgtcggactgagggtgatggtaagcccgtccttactggtaaggatgagtattttactcccttcctgcttaccgccatgtagcactttttgctcaatgctgaaactgtgatctttgacgttcagctcctggctggaaatcttccagtttcctttttccacgccctgttcagcgctggtcagcacccaggtttttgccgccacctgtcccgaaatcattactgcaagcaccgttaaagccagtttaattttcatttttcgtcctttttgctgaatcgattattgactgacccgcccgaatctactgattagcaggttaaagaaatgtgacgaggttcacctgccgggaaaagcagcgtttttaagggaaattatgtggttttgatcgcatgaggaatgaaaaatccccgcacgattgccgtaattatgcggggttgaacagataatgctttaacgattcagcggctaaacaggctggccgggcacgggtgtggcgcgaaaggcgttaaggctgcggtccagtatgacctggtgatccgccccggaatccagcaccgtattgtgcgtggctgcggacgccaccagcacggctgtcaccgccagcgcaacgcggcgatccgttgccagcaaggcccccacctgggtggtaaaacaggagccagcgtcagcagactgttcagcacctgcttcgcgggtggcgatgatatgattactagcgatgtaattcccctgcccgacgacgagatgaatgatcaccggccttgtgtccggcggtgtgctaagcgccgtgtcgggggacgcagagatatgattaccgatcacggaattgtgatcgccattgatatgcaccagcccgaagctgtcatcaaggccgttatcgtagccctgcatcggcggccacggctcgcggtcacgcagcaaatggttggcggaaatcaggttctccgagcagttatcttcaaggatcaccatgcccggataaaaggcgtgaaaacggttgccggtaatacttgatcgcgccacccccgagaaatgcacgctgcttttaccgcgcggaaagatattattggcggcgatcagcagcccgccaaaattctgcgcataaatggagtagcctttgtagcctgccccgatcaggttatcggtaatttttgaggcctggcccgcgccgcgcagttccacgcagttaccgcattcggcaatgaaattatcatgcaccgacagcgcgtcggcgtggtaaatggtcaggccgtgctccagatagacaaaacccatgccgttgatgcgaaacgagtcctgggcgctggcgatataaatccccgtcttaccgttcacatagctgttttccggatcgttatgccccaggtcgtcatcgacgaaatgcagcccatcgatgcagaagccggaaaactccaccgagctgatgcgcggctcgccgctgcgctccacataaaaggccgcccctgcatgctccggctgcccgtcgcctgcggcaatatccaccagaatacggctgccgcccggccagatttcatgccagttcggccattcattttgcggcgcgttaaagcggatgctggaagacgtaaagccatgcccggcgcccatgattttcaggtaactgatgtcgatgagtatctgcgtggtgaggtgataatcacccggcggaatataaatgaccgcgccgggcttgccgccgccgttactatcagtctgcgtttgtcggcttttaatatcggcgatgatgctgttgatcacctcgccaatatctctgtacgggttaccggtatgccagcgggtgacatcataatggttattgctcgtcatcagtagatcctcatttacatgacagaaagttcgcgtttagccaggtcgactttgattctttccagcagttgattgtcgagtttgaaataacgcaccatccaggcgctgatgaaatagctcaccatcggcagtaaggagaacatgataataatgccctggagggtttgcggattttgttgcggctggttggcgacgtagccggtaaaggagaggatccaggcgacgatagccccggcgactgccagccccattttcagcataaagagattgcccgcaaaggagatgccggtcagacgcttgccgtatttccagtcaccgtaatcatccacgtcagacatcatcgcccacagaatcggaccggactggatcaaatgcagaatattgatcacgataaacagcgccagcagcggcgtcagtgattgcggatcaacgaaccacagcgcgaatgacagaatgccgagaataatattgataatgcggaaaagcttaattttatcgaaacggtcggtaagcggtttggcaatcacgctgccgaacatattgcaggcaacgccgagcgccataaaaaaggtcacaaatcctaccgaggcgtgcatcacataggtggcgtaataaatagtcaccgccccacgaataaaggccgggaaaacgtttaaaaaggtaatagagatcatcagcagccactgatcatttttgatgatgtctttcagatcgcgcattaaggagtcattggcttttactgatctcacccgctctttaatactgctgaagcagaacaggaacattagggtggcggcagcacccatgatcatcatggtctgctgaaaacccgccgcgcggtcgccctctcccagccattcggtgagcggcagaatagacgaggacacaatcagcgtcgccagtccgttcaggaagaagcgccacgacagacagcccagccgctctttctgattcagcgtgatcacacccgccaccgagcagtagggaatatttatcgcggtataaatcagcgacatcaccagataagtcacccaggcatagattattttgccgctcatcgtcagatcgggcgtggtaaacatcaccaccgcgcccagaccaaaaggcaccgccatccacagcaaccacgggcggaatttgccccagcgacttttagtgcgatcgcatattgcgcccatcaccggatcgctgaaggcatcaaatatacggatcaccagaaataaggtgcccacgacgccggcatcgaggccataaatatcggtgtaaaaccaggtcagataaagtgccagcacgctccagatcatgcaggaaccggcatcccccatgccgtagcccactttttctttcaggctgagcttttcataagcgctgtgctttgatgttgtttttacagacagagtgacagacatatcgtgtaccttttcattgcgcagtcgtgaacgccgggcacgggtcatcagaccggtcccatccgggataaatgtcgtggtaataaaattcagataaaaaattaacgcgtcataaggtggtgatattcagcctgacgctgctctcgcggataattaaccgcgaaacgatctccaccatgtcgatactttccagctggctgttatttttcaccatctgaaacgccaggtgcgcaatttcatttattggctgcgcgacgctggttattttttgtgtttgcgccagcacagtattatcaaagctggcgatggcaatatcgtccggaacggtcagcccctgcgctttcaggccatcgataatgtagcaggcggcgacatcgttatagaccagcagacaggtgcagcgcgccgggtcatttttcagtttatcgatgatcacgtccaggttatggatatgcccggaggttctctccccctcgcctttaccgatccagaactggtgcgccagcgccagttgcaggccgtgcccggtaattttcctgctgtaggccgacaccttgcgattatccaccccgtcctgggcgataaaaccaaaggcagtgtggccggtatgaataaaatgcccggcgatattctccgcgccacgggtctggttaatggacactgaattaaaaaagcgggagacctgcgtgactaccgccaccggtatgtgggtggcacgaagccattccgataattccgcctcggcttcagtgggcacccacagcagactgtctatgcccatgccaatcagactatgaataatctgtttatcctgttgcggctgattctgatgcgttttcacaatcaccgatttgccaatatagcgggcctcttcttcaaaggtggccagtaattcgcaaaagtgagggttgaccagattgggtaataccacgccaatcagacccgaacattttccgctgagttgcacggcgcttttcagtggcacataacagagaaaatccatggcatcccgcaccgcctggcgcgtttccggattcacgcccggatgattattcagcacccgggatacggtggcggttgatacaccggcttttttggcgacgtctttcagggatgccataagaagttactgtgtctctgtttgatgtgcagtaactatagagtgtgatcaggctcaaaaatgttagcccgttcacatgtcatttcgttacatcggcacagagatcgggatctcatttttcatttgattcaggagagactaccatcattaccagttatctaactcattgacttaagtctgaataccatgaaaatgacgccacccacaccgcttaatgcgaatccggagactatcatcgcccgttatcatcgcttgccgcgcctgcgccgcgttgcccgcgtggctgcccttaccggctgcgctctgctgcttgccagctgttcctccagagcgccgcattcgctggtcaccccgctgccgccggtgacaaagcagccgctggcggataaatcatcacagtctgacgaaccggtgcgcggggtctggctggcgacggtgtcccgccttgactggccgccgcgtgagtcggtcaacggcagcagcagcgcggtgcgcatccggatgcagcaggaagcgctgaaaaccaagctggataatttgcagcggcttggcatcaacaccgttttcttccaggtaaaacccgacggtacagcgctgtggccgtcaaaaattctgccgtggtcagatatgctgaccggaaaaattggtcaggatcccggttacgatccgttgcagtttatgctggatgaagcgcaccggcgcggcatgaaagtccacgcctggtttaacccttatcgcgtctccaccaatatcaaaccctctaccgccagcgagctgaacagtacgctggcgctgcgtcctgccagtatttttgtgctgcaccgtgactggatccgtaccgcaggggaccgctatgtgctcgatcccggcattccggaagtgcgcgactggatcaccagcattgtggcggaagtggtgacaagttacccggtggatggcgtgcagttcgatgattatttctatgcggaaacgcctggttcgccgcttaacgacagccagacattccggcagtacgggcagggatttgcttcgaaagcagactggcggcggcataatacgcaacagctgatcgaacaggtgtcgcgcaccatcaagcagctgaaacccgaagtggaatttggcgtcagcccggcgggggtctggcgcaatatttcccacgatccctccggttcgaacacgcgcggcgcggcggcctatgacgaatcctttgcggatacgcggcgctgggtacaacagggattgctggattatatcgccccgcagatctactggccttttgcacgggatgcggcgcgttacgatgtgctggcgcactggtgggcaaacgtggtgaagccgacaaatacgcgcctgtatattggcgtcgcattatataaagtgggtgaagcgtcgaaaaatgaacccgactggacaattaacggcggtgtgccggagctgaaaaaacagatcgatttgaacgagtctgtgccgaatatcaacggcactattctgttcagggaagactatcttaatcagccccagacccgggaggcggtcagctatttgcgtggccgctggggaaaataacgcttacttaccgtgaaatacgatggtgaaaccctgttcgtgccagtgctcaaactgttcctgctggcggcgcgtcagggttttacctgtccagataaaaatatgctgccccgggaagagttccggacgcggcagatccagcggttcggcgagcacgtcaatatgccagcctcgctgcgaaagacgccaggcttccagccacagccgggtacggtcgtcagtatcccagccaatcaggagcgcctctttacctggttttaaacgtgcctgcgcgacacagctcacggcgtattcaatcagcgcgccatccagcaggctgctcatcgcgcgggcagtattttgatcgagatttaaacgctgacgcaccggggtataaacatgatcgattaaggcatcgaccgggtgctcacgccctgcttcattgattttggcgcgtaagttcgcaggattcacgcggcgcagcacggccatcatctcttcctgctgtaatgaccagccgtcgtccaccgccacttcttttgcttccagcaatgccttcacctttccgaccggtacgccgcttttgatccaacgcttaatatcttcgatgcgctgaatatcctcttcatcgaactgtcgatggccgccttcactgcgctgaggtttcagcaatccataacgacgttgccaggcccgcagcgttacaggattgattgcgcatcgttcagcgacatcgccaatactgtaatgagccataggtctcctttgtacatctatttaacacttcaccttaaactaaccaatatcctgagcttgtacaaacccttttttgttgtacaagaattatgtgactgtttatcaacactatttataattttcgaatgaaaaaaaagccccgcttctgcggggcttgtacaaaggtgtagcggatgattataagtcggctttcttttccggccaggccacctgcgggatttgatcaaaggccggacgggcaaaaagatgtccctggaactggctgatgccagccgactccagccacatccattcttctgctttctcgacgcccaccgcggaaacggcaatttccagcgagtggcagcatttaataatcgcctgtatcaccgcctgccgcggaccgcttgtatgcacgttcttaatcagctcgcggttaatcttgatcctgtccggctgaaactgcgtcagcaattgcagaccggcaaaacctgcgccgaaatgatcgatggccacgctgatacctgcggctttcagctgacgcaccgcgccggtaaaggcgtcaaaaccggatattacctcgccttcggtaaactccacgatgatctgttccggcaccagtccgctggtggcgataccctctaacaacacatcaaccgcttcgggtattttcaccagcgtcatcggcaatagatttaccgacaacgcctgctcatgcaggtttaatccccccgccatcgcaaaagcgacttttttgctgtgcagatcggcaaggtatacctcatccccctgcatacccgcaaaatacgcctgcgggccgccgccatccggtgtacgtaacaacgcttctaccgacgcgatttcacgggtcagcgggtcgataatgggctgaaacgcaaagctgtactctgttgacgttgatttcaacggtgcgccaagttgtacaacctcatcatcgggtacaaattcccatgcatcgccggcagggatctcaaaataattctctttttctgtggcttcgacaaaggtgcggaagaattgcagcgccctgtcgttatacgttaactgatatttcgacgtgcctttgtccagtacgacctgcaaaacttcctctttttcggactgccgtaaatcaaacaattccataccggctttgccgaagcgtcttgcaggagcgtaatcatacagaagctccactacgttatagtggcgttggtcgcgacagatatgacggtaaatttccaccacattttcttcagggccttcaagcaactggaagaagtgcgtgccgttgaaaagtaaaatgcccgtaacatttgcccgactatttatctggtttgcacccgctaccatttcttccagcgatttaactgaaacgttatcgcatatatggctgcggtagatgatggttgtgagcattttttccccgagagtgtgatatctgcggccaacattaacagatgccaggctattcgtcttgtccgtctgtggtcttcagaaaatatatttttgtccagatattacagtggcttaagcccgatacgaaagtcattctgagtacaaatttgccttgtataagctgtacaactccccatttacaccgccaatttattttcgaccctaacagactgaaatgaggacgatatatcctccagactccaaaatacctaaaaacctgtacgctggctatgtacaagtttagaaagtttgtataacttagtcgacaagttaacaagttcagcacatttaacaggagcgaccaatgcaacaggacgggtataccttcgattcatctgctgccattgcacaatattttagtaaagccgctctgccgactcagcaggaaacgctgggtgaaattgtggtggaaatcctgacgacaggtcgccatctcaatcgcaaaaatctttgtacaaaattactggtacgccttgaacaggccggcagccaggaagaagaacaacattatcaggcgctgatcggcatgttatttgaacggcagatttgatgtctttcacttaagaaatcattagatttcgaatgaaagcaaagtgtctgtatattccctgacttcagtcagccaataaactcttaaccgcggtgaaataataatgaattccatgattgcacagcaaccagacgtattttcagcactgcacaaccccgctttatccgcttatgttcgcaacgcctctgatttaatgccggatgaatccgccctgctggctaccgctatcagaagcctgctggtgtcccagggacatgccagcaataaagacattatcctgtggttaatcggtacgctggaaaccacgcacgatgccactaccgctgacgtgatccgtcactgccttgaactggtggtcagctacaccatggacgacatctgagacagatttaactctgcatcaggccaatggattggccccccctctttacctcgccttttgcttccccggtttttgcatttcatcccccactgtctggtttattcattcagccaatcaatgtgattcagcccacactccgccatgaaaccggttgcacgcgagtcgttcactgctagcatgaaaccggttacacgaaaagtcacataaaaatttacccataaaaaaggtacatgaataatggcagttatcagggattacaataagttagccagtgacatccttcgcgaggcaggcggtgaaaataacatcagcagctttacccgctgcgccacccggttacgcctcgtactcaatgaaactccggcggaagctaaaacgcgcattcaggatctgcccggcgtcatcgccgtggtggaaagcggcggtcagtttcaggtggtgattggtacccacgtcgccgacgtattcaacgcgctctccgccctgctcggcgaaaaccatgccggtgcaacagcaaaaccgaaaacccgctggctggatgcagtgatcggcaccatgtcggcggtgttcgcgcccatcgtttatattctggcggcagccgggatcctgcaggggctgctgattgtggtcgggcttatcgatgccgatgtaaaaaccaccggcaccttcgccattctgaactttatgtcatggacgccctttgcgttcctgccggtatttatcgccataaccgccgcgcggcatttcaaatgtaacccctatattgcggtgctctgctgttgtgcgctgatcaacccggaatggtccgccatggcgggccgtatcgcgggcggtgaaaccattactttcctgttcatcccgctggcgaaaacggtgtacacctcgtcggtgctgccgccgttgtttcttgtctgggcgctgtcgtggctggaaaagcgcgtcgagcgcatcctgccggacgtggttagcgccctgttcactccgctggtgtgctttgtgatcattgtacccttgacgttgattatcatcgggccggtaaccacctgggcggcgatgggcattgcctccggctataacgcgctctttgcggcagcccctgcggtggcagcggcggtgattggcggcgtatggcaaatagtggtgatttttggtgttcactggggcattacgccggtgatcatggcgaacttcgacacccagggctatgactccttccaggcctaccagaccatcgcggtgatcggccagatggcggcggtgttcggcgtcttcctgaaaagccgcaaccgcgaactcaaaaccacctcgctgtcggcgggcgtgacggcgattttcggtattactgaacccgctatttatggcgttacgctgcgctttaaaaagccatttatctgtggttgcatcggtggcgcggttggcgctgtcgtcgccagcctgtttggttccctctattacgcgtacgccgccctgcctggtctgttcacgctggtgaacgccatcagcccggacgcgccactgtcctttattggcgagctggcgggaagcgccacggcgatcgtcctgaccattgtgctggtacagtttgtcggctttgaggatccggtggctgaagaacagcgtagcgaaccggcaaataatccagtgacggctgcgcctgtcagcctgaaaatcatgagcccgctggacggcgaagtgatggcccttgaagatgtcgccgacgacgccttcgcgcagaaagcgctgggtgatggtatcgccatccggccgcagtcgggcctggttgtcgctccctgtgacgctcgcgtagaaacgctcatcgactctcatcatgcggtcgggctggcgtgtgataacggcgcagagctgctgatccacgtcggcctgaacacggtgaatttacaggggcaacattttcgcccgctggtcaaagaaggcgatatggtaaaagcgggtacgccgttgctggagtttgataaagaggctatcgagcgtgccggttacgacctgaccacgccggtactggtgatcaacagcgacgactaccgcttaaccaaacatcagtctcacggagatatccggcagaacacgccgctgatgaccgtggcctgaggcagtcatcctgcggcagagtggccaattcgctgctctgccgcacaatttccgctgcaaaatccccttactatcatgctcctgctgcataataggcagaggtattgataacaagcaggaatttatggtcacgatactggatgttgccagaaaagcgggcgtctcaaaagcgacagtgtcacgcgcgcttaacggtaaggtagtggtcagcgaggacgttaaagcccgcatctttcaggccattgaagaaaccggctaccggcctaatctgctggcgcgcaaactggcgaccagtgaatcgaattccgtcgggctggtgatcaccaacggcctgtataacggccccttcttttccgccatgatttaccaggccgcgacctgtagtgaagatcaccagcgccagctggtgctcgccgacggcaagcacagccgggaagatgagcgtaatgccataaatttcctgctgcagctgcgctgcgaggcgatcatgatctatcccaaatatctcagcgttgacgaacttgatgacatcatcgatcagaatacggtgcccgttgtggtgattaaccgcgagctgaagcgtaaccgcaataacgccgtgtatgtcgatcatcaccgttgcagcatgcagatgatgaactatttgctggaacaggggcaccgcaccattgcctttgtgggaggcgctgaaggttccccaacgggcgacagccgccttgccgggtatcgcgatgcattaaaccaggcgggaattgtcccggatgaatccttgatcgtgcgcggcagctggagcacggaaagcggctatgaagccgggtgcgcgctgctgaaacagcgtcgcgacatgacctgcattctggcggccaacgatgatatggctatcggcgtcaccaaagcgctgaccgatcagggtttccgcgtaccgcaggacatctccgtcgccggttttgatgattccactatcgggcgatacttcaccccgacgctgacgacggtacatatcccgatggatgagatgatcagcgacgcggttcgcattctgttatcccccaccgccgaaagcgaaaccgacccgctgccgcgccacgagggaacgctgattattcgggagtcggtggctgcacgtcgctaaatgtgcatgaggtgttaataaaatgcctcctgcgaaaatgcctggcctgcgtttattcaggaaatgttctttttatttgcgttaagtcttgaggtcgttctttaaataagagtgccgatatttttatttatcaattttataacacgcttatttaatccctgcttaaaaaatatttcttccgcctactatccgtcgcattgcgcttagtagaaaatgccacgccgaaaacaaaaatatgcactgcccgacacttattttcagggtttacctgaaacacttcatcgtggggattttatgaagcgtaacactcctgttacacaaaaagagtatttgcttaaagatggtatgacattaatgtcgaccaccgatacgcacagccatattacgtatgctaactccgcttttattgacgccagcggctatgaagaagaacagctgacgggcgaaccgcataacgttattcgccatcccgatatgccagcggcggcctttgcggatatgtggtttaccattcaacagggcgaaagctggacggggctggtgaaaaaccgccgtcataacggcgaccattactgggtacgcgccaacgtcacgccggtttatcagcaggagcggcttaccggctacatctcggtgcgtaatattccgttgcgcgacgaaattaacgccgccgaaaaactctacgctgcggtaaatgaaaataacctcaaaggtcaccgcttttataaaggcctgctggtgcggcggggtttattttccttcctgtcgctgtttcagtggctcagcctcgcccggcgaattcatcttggaacaggtattagtctgctggcgatagtagcgctgcaaatgacgcccgtgatgctgccggtgaaaataagcgccacgatgcttatcctggcgctgttatcatggtttctcaccgcgcaaattgcgcgaccattaaaaaccattcttacccagatgcagaaagtgatctccgggcgcaaggccgattacgtgcagtttaatcgcgtcgatgagatcggtttactgctgcgcatggtaaatcagtccgggcttaacctgaattccctggtggatgacgtcaatacccaactgcacggcatccggcagatcagccagcgcatcgccaaagaaggcgtctccctgcatacccgcacggaagaaacttcagccgatttgcagcagacggcagcggcggtggaagaaatcgccagtgcggtaaaacaaacggcggaaaccgcaggcgaagcgatgctccgcgccgatgaaaccagcggcaatgccatgaacagcggcaacatcatgaaacagaccatcagcatgatgcagtccgtatcccgtgataaccggcagattgttgacatcatcagcgtgatcgacagtatcgccttccagaccaatattctggcgctgaatgcggcggtggaagctgcccgcgcgggcgagtccggacgcggttttgcggtggtcgccgccgaggtacggcaccttgcgcagcactcggcgtcggcggcgaaagagatcaaaacgctgatcgagaaaaatgtggccaacgtcagtcatggcgtggcgatggtggagagcaccgaatcgcacctgacggccatgatcgacaacgtgctacagatgtcacagatgatcaaagagatcggcaccgcgacccgggagcagacccaggcgctggcgctgatcaatgagtccgtctcacgcatcggggtaatgacgcataacaataatggcatggtggagctggtcactcacgccgcaggagatctctctgcccgcgccgcgcgcctgcagcgggcggtgcaggtttttggcagccactaatctgctatagttttcagccttatcagacctcaaggctgacattgtgctgcgatcgttacgcatttctttccttatgatactggcggcagccgggtcgttcagcgcgatggccgctggcgcacagtatctgccgcctgccggttttaccctgcccgttcgccctgccgcgacgacagcagttacctgcccgccggtgccgccgccctttaccggtgcgctgcgtttgcgcagtaaatatgaaggatccgacgccgcccgcgccacgctgaatgccggtgcggagcaggcctatcgtgacgcgacccgcacggtcgatgcgatggagcgccaggtcagcaaactggtacaacggggcgacagccattgcgctatagacgcgcttaaccgctgggcgcgggccggtgcgctgacctccacagacaccacgcataccggcagagcggtgcgaaaatgggcgctggccagcttttcatcggcctggatccagctgaaattcgccccacagtacccactcaaagacgatccggctgccgcttcacaggtggaaaactggctaagccagctcggcacgctcgtcgcccgcgactggaaagggctgccgctcaacaaaatcaacaaccacagctactgggcgggctgggcgctgatgtccacggcgctcgccaccgggcgggacgatctgtttgctgatgccgtcgctctgctgcgtaccgctttgcgccaggtggacgatcgcggatttttacctaacgaacttaaacgacggcagcgggcgctggcttaccataattacgccctgcaaccgctggtgatgctggcgctgtttgcccgcgccagtcaggttccgctgagcgacaccgaaaccgccgcgctgaaacgtctgggtgagcgggtgattgccgggctggacgatcccacaccgttccgcgacgccacgggcgttaagcaggatcgtcactttttaaatcagccgaccaatctggcatggatggaagcctggtgctctctctatacctgctccgcggcagtcaataaccgccttgccccgctgcgcccgctcaataacgtgcggctggggggatcttatgcgtctgacagagcaaaatctggtagcgaggggccactagtcaaacttcggttcccccgttacactcactgtattcattcacctgataaatataaaaggaggttacttatgctgtgctgtgaattgtttatccattcacatcattttggcgatcgccactgctcaagcgttaccagtatcgtgctgcgataactgaagcttgagcgaagctatcacctgactcccttctctcgggcttaccgggttatcgtcagcgatgtttgacgaggcacgcgcgtgcctgtaactcttgagtaagcaatgagcacattactaactgcacaatcccttcgtgtcgatacggctttcggttcgctgtttcgcgatctctcttttaccgtcaaaaaaggcgaccgcattggtctggtgggctataacggctgcggcaaaagtacgctgttaaaagtgctggacggcaccctttccccgaccgctggcgtctattctgtggcccgacactgcctgctggcgcgggtcgaacaacacctgcccgatgagctttcttctctctccatgcttgacgcggtgctgtcgcaactgccgcaggcggaacgcgatgcccggcgctggcaggcggaaacgctgctcgccagccagggcttcagcgagcgggagtgggaattatgcgcgggtacgctcagcggcggccagcacacgcggctgttgctggcgcgggcattgatccgtcagccggatctgttactgctggatgagccgagcaaccacctcgatctgccgacgctgctgtggctggagcagtttttgcagcgctggaacggcagctttgtgctggtgtcccacgatgcgcgactgctggatgcggtgaccaacaccacctggatcctgcgcgaccagacgctgcactgttttgccctgccatgccaggccgcacgacaggcgctggctgaacgggatgaagccgacgccctgcgtcagaaagccgaacagaaagagatcgaccgcatcaccgccagcgcgaaacggctggcgacctggggacaggtctacgataacgaagatctcgcccgcaaggcgaagcagatggaaaaacagatcctgcgcctgaaagaggtgcaaaccgacgtcaccgccggtagtcactggacgctttcccttcagggcgatgcgctgcgcgccgaccgtctgctggagttgagcgaacttgatgtcgctccggcagcggatgctgcgccgctgttcagattgcccctgggccgtatcaaaagcggcgatcgggtggcgattatgggacgcaacggctgcgggaaatcatcgctgttacgtctgctgtggcagcattaccgtcaacagcggctaagtgaaggcgtggtgctgcatccgcgcgttaccatcggttactacgatcagacgctccatcagttgcatgatgaggatacgctgttcgatgcgctggagccgttcgccccgccgccggaggtgcggaaacaggcgctgatcgccgccggtttcgcctgggcgcgtcacgggcagcgggtcagcaccttaagcggcggcgagcgctcgcgtctgctgtttgtcggcatgtcgctggcgcgttatgccctgctgatgctggacgagccgaccaaccatctggatatggaaggcaaagaagcgctggcgcagacgctttccggctttgacggcggcgtactgctggtgagccacgatcgtgatttgatcgccagcagctgtaaccgtttctggctgattgaggacggcgagcttcacgagtggcacgacgtcgaggcggtgtttgcgcgactgcgggagccggacgcggtgacggcacctgtcgcggcgggatcttccccccggcccccggagactgatggcgatcggctgctcgctgagctgattgccctggaaacccggctggcggaagatttggcgcgcaagccgaaacatcagaagccgcaactacaggcgcagtggcgagccgctattgacgacatcaaccggcagctggagtagcgaaacccgcgccgggtcacagactgttctgaaacccggcgcggccattgatatttggcatggaatgacccaacatcaaaggtgccgcgcacttttcgtaccgcgcggcattggctttcgctatgggattacgctcacccgtcaatgttgcgggcgcgtccttgaaacttgtcacaggattaaggagtcagcatgaaaacgaatcgtcaggcacgtcacattctgggtatggactacaaagtgtctaaccagagaaaaatcgttaccagtgaagatcaaccgacggtagtcacccaccgcaccggtcgccatcgtcgcgcgaagtcataatgttatcgcccggcgacgtacgtctgccgggcctgctgaacccgcctcgcaattctttaacattctccttacgattagacgcatccgggaagtatttgccatcggcatgctttatacttgcgccgccgccgtccccgtcagcatgcaggcgacgggatcgttttttaaggagttttgagatgttactgaagtataaaaaaaaccgttctctgtacattccctatgccggtccggtgttgctggaattcccgctgctcaacaaaggcagcgccttcagccttgaagagcgcagcaacttcaacctgctgggcctgttgccggatgtggttgaaaccattgaggagcaggctgaacgcgcctggttacagtatcagggcttcaaaacggaaatcgataagcacatttacctgcgtaacatccaggacaccaacgaaactcttttctatcgtctggtcgataaccatctcgacgagatgatgccggtgatctacaccccgaccgtcggctccgcctgcgaacgtttttccgagatttaccgccgcgcgcgcggggtatttatctcctatcagaaccgtcacaacatggacgacatgctgcaaaacgtgccgacccacaatatcaaagtgattgtggtaaccgacggcgagcgcattctggggctgggcgatcagggtatcggcggcatggggatccccatcggcaagctctccctttacaccgcctgcggcggcatcagcccggcgtacaccctgccggtggtgctggatgtcggcaccaataatcagcagctgcttaacgatccgctgtatatgggctggcgtcatccgcgcatcaccggcgatgagtattacgcctttgtcgatgaattcattcaggcggtgaaacagcgctggccggacgtgctgttgcagtttgaagatttcgcgcagaaaaacgccatgccgttgctgacccgttaccgggatgaaatctgctcctttaacgacgatattcagggcaccgctgcggtaactgtcggcacgctgattgccgccagccgtgccgcgggtagccagttaagtcagcaaaaagtggtgttcctcggcgcaggctctgctggttgcggcatcgccgagcagattatcgcccagatgcagcgtgaaggcctgagcgaggaagccgcccggcagaacgtctatatggtggatcgttttggcctgctgaccgaccagatgccgaacctgctctccttccagagcaaactggtgcagaagcgcgacaacctgcagcactgggataccgatgcagaagctatgtcgctgctggatgtggtgcgtaatgtgaaaccggatattctgatcggcgtctccgggcagaccggattattcactgaagaaattattcgtgaaatgcataagcactgcccgcgccctatcgtgctgccgctgtcgaacccgacctcccgcgtggaagccaccccgcaggacattattacctggaccgaaggccaggcgctggtcgccaccggcagtccgtttatgccggtccactggcaggataaaatcatccccatcgcccagtgtaataacgcctacattttccctggcatcggcctcggggtgatctcctccggcgcgtcacgtatcagcgacaacatgctgatggccgccagcgaaaccctggcgcagcactccccgctggccaaccacggcgaaggcatggtgcttccggcgctgaaagatattcagaccgtgtcgcgggcgattgcgctggcggtggcaaaaatggcgcaggaagaaggccttgcggtgaaaacttccgccgaagccttgcagcagtccatcgaagaaaacttctggcagccggaataccgcagctaccgccggacgtctatctgagttttatggcgccagcgataacccgctggcgtcattttaatcagctatgatagaatgtacggcaatttaccgtacatacgaaggttgaccatgtccaccgcgaaaaaagaacgctttgatttccggcttgatgaaagtctgaaaaaacaaatggaagaagccgccagcctgctaagcataccagtcagtacttttgtgatcgatgcggtgcgggagcgggcagcagaagttattaatgagcaccggcgtatcgtgctggatgagcaaaactgggagcgcattcagaccttgctggacaatcccccacagccaacggaacgcatgaaagcaatggctgcacattatcatgacaaagacagctggacgtggcagaagaattaacgttaagcatagagtcatacgatcctgcccgaacctatcggacagaaaatttcagttgtggcgttgaggcgctggatgtgtttttaacgtcccagatgtctgttcagcaagagcgacgtattctgcgttgctacgtgctggtcacaaacgaagccgttcctgaaattatgggattttataccctctcgggggcttcatatgaaaaacagcacctttccggatcccagcaacgcaaactaccttatcgtaacctgccctgtgttctgcttggcagaatggcggttgatcgacgcctgcaacgacggggtttcggtgagaaattattgtttgatgccctacgccgcacctggttaaccgcgggcatggtcggcatctatgcgcttttcgtcgaagccaaagacgaggccgccgtaaaattttatcagtcattaggcttcacgctttcaaaatcgcagccgttaacgctcttctaccccgttaatcagttcgaatttttaatctgatccctggctagcgaaaatagtgttataaattcgccttcggtattcagaaaaataacggacgagggatgacccaaaaaagagcaacgctgaccggcttactggcgattatattatggagcaccatggttgggctgatccgtggcgtcagcgaaggactgggaccggttggcggcgcggccatgatttacaccctcagcggtttattattactcctcaccgtgggttttcccgatattcgtcgtttcccgccacgttatttactgataggtagcctgctgtttgtcagctatgagatgtgcctcgccctgtcgctgggctatgccgcgacgcgtcaacaggcgattgaggtgggcatggtaaattatctgtggcccagcctgaccattctgtttgccatcctgtttaacgggcaaaaatccagcctgtgggtgatccccggtctgttgctttccgtgcttggcgtcagctgggtactcggcggtgagaatggtctcaacccgcaggatattatccgtaatgtggtctccagtccgctgagttatattctggcattctgcggggccattatctgggcagcgtactgtacggtcaccagcaaatatgcccgcgggcataacggcatcaccttttttattttgctgaccgccatgagcttgtggatcaaatatgcgctcggcgagcagccgccgatgatgttcagctggccggtgacgctaaaattactcctggtggcctgtgcgctgggttttggctatgcggcatggaataccggcatcctgcatggtcacgtcaacgtgctcgcggcggcatcctatttcacgccagtcctctcctcggcgctggcggcgttgctgctgagcgccccgctgtcactgtcgttctggcagggggcgctgatggtctgcggcggatcgctgctgtgctggtacgccacccgacggcgttaatccgtctggcggttatcggtacccgcaaggctaaaccagatccccaccgccaggataaacagcatcacgcctgcgctgcttaaggccacactgtgcgagctgataaaggccgtttttgccgcctgcataacagcggcggcaagtccaggctccagcgtctgcgccagttgtaccgcctcaccaatggacgacgtcgcctgcgccgcctgactgacggtgagcgcatccggcaggacgatggacgtagcaaaactgcggcttagcaacaggccaaaaatggcgatccccagtcccgcccccagctcgtaagccatggtttcgattgcgccggcggcggccgctttctcttttggcgcggcggccataatcgccgcggtggaggccagcagcgcgctggcggcgctgaaacctaacagcgccatcagcgcggcggcctgccactgctggctgctgaagtcagtgaccgacaggccaaggaaactcagcgcgctcagcgccatgccccccgtcgccacccggcgcagcccaagccgcgacaccagcagaccggcgatggggccgctgaagccgctcgccagcatcaccggcagcataaacaccccggcggcgaaaggcgtaaagccatgcacaaattgcagctcctgcgccattaacagctcaaatcccaccagggtgatcatcgaagtgatagccattatcacgccgcttaaaataatgcgattcgtaaacaggcgcatatcgatcatcggcgtgcgggcggcaagctggatacgcacaaaggtcaccagcaggatcatgccgagcaccgccccgcctgccagtaatcccggcgcgaccgtggttttcagcgccattttgacgcagtagaccagcagtaatatcgccacaatcagcatcactgcatgaccgaaattgagcggctgatcgcggcgaccggtctgtcgcggcaccagccaggcggtcagcgccatcaccaccagaacaatcggcacgttaatcagaaacaccgagccccagtaaaaatgctccagcagcagaccgcccactagcgggccaaaagccgcaccgccggagccgactgccgcccagatgccaatcgccatatttcgatggcgggtttccgtaaaggtggcgcggatcccggcaagggtggcgggcacgatcatcgccgcccctgttgccagcaacgcccgcgccaggatcagcccgctggcgctggaggcgcttgccgccagcagcgaggccacaccaaaaagcgcgctgccacacagcaacagccgtttaaagccaatgcgatcgccgagcgcgcccatcggcagcaccataccggccatcaccagcgaatagatatcaatgatccacagcagctcattgctaccggggcgcagggtaatactcagcgtcggtaccgccacatgcagtacggtggcgtcgatcgccaccggaatatagaccagaacaataatccacaacgtcagccactgacgaaacatagccctctctccctaatttggacacccgtccagaaatggcgatcttacgtaaagttggacgcatgtccagcttattgttatattcttttcgcccattattcagagagccgctatgaactacctcaatcgggaagaccgccgggaaaatattctgctcgccgccatgcgcgtggcgctggacgagggattatccgccatgaccgtgcgccgcatcgccagcgtggcgggtgtggccgcaggccaggtgcatcaccactttgcctctaccagtgaactgcgcgcgctggcgtttatccgtctgatccgcgtgctgctggacaccgaagtcgtgcccgaagacgccagctggcgtcagcgcctgcattccatgctgggcagcgatgatcgcggctttgagcgctatatcaagctgtggcgggaagcgcagttgatggcgatgcgcgatccggaaattaaaggggcttacgtactgaccatggagatgtggcatgaggaggcggtgaaaattatttatgccggacagcaggccggcgagttcacccttagcgacagcgtggaaaacgtcgcctggcgactgattgcgctggtgtgcggtctggacggcatgcacgtgctgggacttgaggggctggatgacgaagctttcgatcgccacattgaccgggcgatcgaactggagctttaccgctgacggcggccctgttacttctcccgggcggcgatccccgccattactgcgcttagctgtgacaacgtcacgccgtgccgggcatcgtcagtccccagaccgaagcgggtctgtaagaattcatggagcgcgggcacatccacagcgttaaactgctctaccacctccccgtcctgccagtgggtgaagtgaaaattattgagcgtcagtttgctgccatccggcagatgacgacacatcagcagatgatggcggaaatgcgagtgcgggaagtgcgcggtataaagattcccggtcacaaaatcagagaagtattgctggcttaaatcgaagcggtacatctgctgccagcgatcgtgatgcctgaactgtaagatccagtcatcgccttctcgttgcaggcgataaagaccgtgcggcgttttctgctcaacatccgtttgcagccggattggcgcggtgatggtctgcccaccaaaaccgacatccgccagccagggttcgccgtccagctccaccagcagtatgcggtgcgtgcgcggcggcatctgctccgggttggccatcaccacccgaccaagcagactgcgaacactgaagccgatttcccgcagcccgcgttcaaacaggccgttcagctcaaagcagtagccgccgcgccgggcgacaaccagcttggcgaacagcgcctcgtccgtcagttcaatttcccgcggcaacagcacgtcgagattttcaaaagggatagcgctgttatggtgctggtgcagcgactgtagggtcggcagatcggcctgcgggacacccgtccagttcaggcgttgaaaccaggctgttaaaaaaggactcatttcacactccggcaaaagatgagtcctatttatacactggatgaatattttgatgcggcaatttgtgcactgccgcttatgcccggccttttcgctgcataatgcccagcgccgtcagcatcaggatcagcccggtgaccagcgtcagcgtcgccatcgccatgccctgcccaacggaaccctgctcaaactgacgccagataaagattgcgacggtttgcgtaccggcaggcgccagcagcagcgaggtcaccagctcccgcgaggcgatggcgaagaccatcagcatggccgccagcagcgccgggaacaccagcggcagaacaatcagccgcagcgcctgcaatgcgctcgcgccatgaacgcgggcggcaggctccagattaccaccgagctgccgcagcgcgctgccgacatagcgcactggccagggcatcagcagacagcagtaagagagcagcaaaatcatccagctgttataaggcgacaccggccagaaggtgcggttccacagcaggatcagcccgacgcccaccacgatccccggcagcgcggcaggcatcaaggacagcgcatccagcaccgcgcggccccggattttttgcaccaccaccagccaggccgccagcagcccgagcacgccggtgaccagcgccgagcccagcgccagcgacagactggtgccaagggcggacagcgcatccccctgttgagagaacaacgcgtgataatggctgccggtcacgttatcccaggaaagtccgccggagagcgtggacataataccggtcaccgccatggagatccccggcagaccgaccgccagaaaacccacgccgcccataagcagcatcaccggcacggtggcgatacctaatgacgcgccggtattttccgtgggtttgcccgtcacgctggtcacgtctttatcccccaccagctgacgttgcagccaccagccgccaagcgcgataacgatcagcatcagcgacagcagcgacgcgccaggcagatcaatcggccagtcggccagctttttctcaatgccgacggtcatcatcaccacgccggatcgcgatcccagcgccgccggtacgccatattcttcaacggccagggtaaaggccagcagcatgcccgccgccagcgcgggcgagagcatcggcagcgtgacgtgccagaaggcgcgccaggcgctggccccgtgcacgcgggcgacaatcgccagccgctgcccgctggcaagcaaactgcgggataccgcaaaatagaccaccgggaaaatgttcagcgtcatcaccagcacgatcccgctgcggctgaacagcagatcgttgagatcaaaccccgccacctgcgccagatagccgttggtctgcaacaccagcatccacgaaagcgcggcgatatagggcggcgtaaggaacgggatcaaaaacagcacatcccacaagcgcggacacggcaggttaaatagcccgcgcgccacgcccagcggcaaaccgatcagcgcgctcagcagcgctacgcctgcggcgatccacaaggtgccgccgagcatggagggcagttgcggatcgctgaattgcggcaatatggcgctgaacggcgcggcaaaagaaccggcgctgaatgacgggaaaatcgcctgtaaaacaataaaggacagcggcagcgccaccagtatcaccagcagcgccagcgtcaggacagaaagcattctctgattcacaacggatcctgaagacggggtcgcccccgtcggctgaatttacttgctgaaaagggtattgaagcgttgcagcacttcgctgcgctcgctgttaccgtcctgactggttggcagaatatgcagatcgttgagcagcgggcgtttggcctgcacgtcgctgcgcgcgggcatcagccaggcatcggctaccattgcctgaccttccggcgacagcacgtaatccacaaaagctttggcatcgtcagcatgctgggtcgttttgaggatcatcatgggtcgcggcgcgatcaccgtgccgctggccgggaaaatcaccttcagggattcgccctggctgatattaccgtaggagacgtaatccaccgcgccgaacaccgccgctttcgccccctgcatcaccggcgtcaccgcctgggcgtttgggccgctgaccaccataccgttctgcttcagcgcgtcaaacagcgcccaggctttatcgcccatgctgttttgcaggccgatcagcagatcgagcgacgcaccggacagcgccggatccggcgtggtcactttatctttaaacgccggggcggtcagatcctgccactctttcggctctggggtaccgcttttggtgttccagacaatacccagcgccgacacgccctgcgccacgtattcgctggttttcagcgctgcgggcaccttttcggcattgctgctctggtacggcagcagccagccgcgggtatgcagatcttctgcggtatcccaggaggcggagatcaaaatatccgcctgcggattggcctgttcggcttccagacgtgccatcactttgccggtggtggcctggaaaatattcactttcacgccggtctttttctcgtacccgctggcgagactttttgccagcgaacccggacctgcggtatagaccgtcagcgcgtgggcgctggagatcatgacggaagacagcatcatggcgagagcaactcctttcttcacagacattacagctttcatgcatattcccctgaggatggtgtgacagcgcgtacagcggcaatgctgcccgcagaaagatgcacgatgcggtcggccagcagttcggcttcccggcgatcgtgggtgacatagacggcggtgatgccgagctggcgcagcaggcgcgacatctcaaggcataacgactcacgaagttcactgtcgagattggagagcggctcatcaaataacaacacgcgcggctcagcgacaatcgcccgcgccagggcgacgcgctgttgctgcccgccagataagcctgccggtttacggtcggcgaaatccgccaggccgacgcgatccagcgccgccagcacgcgggccacccgctcaccgcgcggcacgttgcgcatcttcagcgggaaagcgacgttctgcgccaccgtcatgtgcggccacagggcgtagtcctgaaacaccatgccgatgtcgcgcgcttccggcggcagtgaccagtggggtttcgccaccagacgatcgccgaaatagatttcgccttccgcaggctgcgtaagcccagccagcaggcgcagcagcgtgcttttgccgcaccccgacgggccgaggagcgccacaatgctgccggcgtcgacagtgagatcgatctgattgagaacggtatgtgagccgaaggcgaaagagacgccctgcagccttatatcggtgaatgcgttcacgatcgccctcccgcagcgggaagccgacacgcgcccgggatcgacatccgccgggccgcactcacctgtggaaaacacaggggagtaaacatattgttatcctctttgggacttagtaaggcgagactatagggagggagtgtgacggatagattacgcttaggttacgacttgctttccggacgctttcagtcccttaatgcgtcatcaacctgacgaggacaatatcatgagccattttcgccctgtcgccctggagcatgccagccgcctgcttaatcacgggccgaccattatgatcaccagccgcgacgaacagattgaccgccggaatgtgatgtccgccgcctggtcgatgccggtggagttctcgccgccgcgcattgccattgtggtggataaaagcacctggtcgcgggagcttatcgagcgcagcggcatgtttggcattgttatccccggcgtcgctgctaccaactggacctatgcggtcggcagcgtgaccgggcgggatgaggataagtttaactgttacggcataccggccattgccgggccggtactggggttacccgttgtggaagagaaatgtctggcttggatggagtgccgcctgctgcccgccaccgccgcgcaggaaaaatacgatacgttatttggcgaagtggtttccgccgccgccgatgaacgggcgtttatcaacggtcgctgggattttgatgacgataagctcaacaccctgcaccatctgggcggcgggaattttgtggcgagcggaaaggcgttgagtgtgaagtaagcgccgggtggcgctaacgcttacccggcctacaaaaaccaggcgtgtgacgtgtaggccgggtaaggcgcagccgccacccggcgcaaaaatcacatcgaataacccggttttttgattaactcatccatttgcgggccgatttgcgtatcccacacctgcgctttccagtcgtccggttgcacctggctgtacgccacgctcaccgaactctccttgctgtcaaaatgactgacgatcacctgggtgatggcctccgccagcgcggctttttgttcatcgttaaaatcacgcgggaaacttttaatatcaacgtgtggcatagcaggctccttattgagataacgttaaacctaacacaccgcaccgccgcagattatcaattgatgccgttattcagaaagtccctggtctggcgcgggctgcgcagacgcacaaagcggatatgcgcaaaggccggatccgccatatccgcttcataacgcgcgcggttgctgcgccaggttttcagcgtccacagcagaattgactcacggctgaaaaacgactgccgaaagctttcacggttgccggtgcccggccagagttcctttttatgccaggcgcgtttcagggcgcgcatgacggcctgacgcagggtacgggcaaatccataatccacccataccaccatatccaccttttgccatttcacaggccgtgtgcggttgtaattaccatccagcacccagcctggcgtggcgttcagcttttcgccaagcagcgccagcagctcttcatcggaaacgccctgccagttgggtcgccagtacagcgcatccatttcgatataaggcacatccaggtgacttgccagacggcgggcgagcgtagttttaccgctgccgctggtgccgatgacgttgattttcatgcgcaggctgactcttcatttttcattcatggaaattatgaaactaaggatccctgaattagccggatggcgcaagctcacccggcgctgaaaagggtgcgcttaataagtgatccccggcgggttgatttgtgacgttgtcactgcttctccggcttccccccagcgtgccagtaccttctgatactctccccttgcgatagcgccatccagcgccgctttcagcgcctcaaccagcccgttgccttttttggtggtggtggcgacataggcttttttcggaccaaggccgaccactttggttttaccggtcagcgccgctttataaaacgccactgactgcggaccgaaaaacacatccgcgcgcccggactgaatatacagattgcccgaggcgtcatcggtcagatagaccggcagcgcgggttttcgtcctgcccgttcgttttccgtgttccagccgagcaggatcttctcctgattggtgccggagccgacaatcaccttgcgccccgacaaatcctcaggtccgtgcactgcctcaatgggactggtggatttcaccgaaaacgccagcgaatcgacgcggtaggtggcgaagtcgtacttctctttgcgctgctcggtgacggcgatattgaccagcgccacgtcataacgcccggcggagatgcccagcggccagtcttcccacgccgtcggcaccagctttaacttcagcccgaggctgtccgccagcaggcgggcaatgtccggatcgctgccgatgcgggtacggttatcgctggcgagcagcgccagcggcggcgaattcagcgccgaaatagccaccgtcagcgtacccggttcgacaaaggcaaaattcggcggaattctggcgatcgccgcctcatcgcgctggctgtgcaacggcgtctcgttagctttcagatcgataccctgcgcgccgctgagcgtactgaccagcaacagcgcccataatccctgtttcatgctctctccttacaacactttggataagaattgccgggtgcgcgggtgctgcggatggttcagcacctcgtcgctgctgccctgctccacgattttgccgtccaccataaacaccacgttgtcggccacctcgcgggcaaagccaatttcatgggtgaccaccaccagggtggttccggaacgcgccagctttttgatcacatccagcacctcgcccaccagttccggatcgagggccgaggtcggctcgtcaaacagcatcacccgcgggcgcaacgccagggcgcgggcaatggcgatgcgctgttgttgcccgccggaaaggtgccgtgaccaggcatcggctttattacgcagccccacgacgtcgagcaattcataggcccgctcgatggcggccttacggctaagctgtttgtgggcgatgggcgcttcgatcaggttttccagcaccgttaagtgcgggaagagattgaagttctggaacacatagccgacgttgacgcgctggcgcaggatctccttctccttgagttcatagagtttgtcaccctggcggcggtagccgatgtaatcgccgtcaatctggataaaaccttcatcgacacgctccagatgattaatcgcccgcagcagcgtggattttccggaaccggacggtccgaggatcaccgtcaccgaacccggcgctaactccagtgaaatatcatccagcgctttgtgacggccaaagtatttgctgacgccggtaatggaaatatggccttcatgagaggtgtgcatggactggctcctgtggctgagcgacgcgacccggtgcggcaacgcgggcgacgcgggtggaattgatagctgagcggcgctcgctgcgcgccatccagcgctccaccagatgctggatcagcgacagcacgctggtgatcaccagataccacaccgcccccaccatcagcagcgggatcacttcctgggtgcggttgtagatcatctgaatggtgtaaaacagctcaggcatcgccagcacgtacaccatcgccgtacccttggcgaggctgatgatctcgttaaagccggacggcaaaatcgtccgcagcgcctgcggcagaataatgcgcagcgtgcggcggctggcaggtagccccagcgcggcggcggcttcatactgcccgtgatcgacccccagaaaaccgccgcgaatgatttcggcggtgtaggcgctctgcaccagcgtcagccccaccacggcggtggagaattgccccagcacgttaatggtgtcatagctcgcccaggtgatgccggtaaaaggaatgccgatggcgagcgtgtcgtagagataggagaaattataaaggatgatcagcaccacaatcagcggcagcgaacggaacagccagatgtaaccccatgccagactgctcaacagccaggacgacgacagcctggcaagggccagcaggccgccgaagatcacgctcagcaccgtgccgagcagggtcagcagcagcgtttgccccagcccttcgaggatcaccggatcgaagaaccagcgggcaaatacgctccattcccagcgcggattaaaggcaaccgactggatcacaatggccagcaccagcagcgccacggccgcgccgacaatacgcagcggataacgcgcggggatcactttaatgggttcagatgttttcatgttgattcctcaggctgatttccccagcgccacgccgagcgctttggtaaagcgcaaccgtccgtcataaggcggctggctgtagatttccggatcgcgctcgacatcaaactgcgcctcatagccctgactgagatagagcctgaccgcttccggctgacgaaaaccggtggtcagataaatacggctgtaacccgccagcaccgcccgccgctccagctcgcgcaccacccgcgccgccagcccctgctgacgcagggttttgtccgtccagatgcgttttatttcggcggtatgcgcatcaaagggtttatacgcgccggtggcgatgatcttcccgtcgcgctccagcacaataaacaacccctgcggcggcaaataccattcggtcagctccacctcggcgtctttcgaaaaataatccccgtagcgcgcggcgtattccgcaaataaaccttcgatgaccggctgaagttccggtgcttccggtgagagatcgcgaaaatgttcgctcatgggccgctccttaatcgccaaggcctggcgggttgatttccgatgacgggatgcgttcgacgccttctccccagcgggcgagtactttctggtagtcgccgtttttgatcgcgccgttaagggcggtttgcaccggctccgccaggccactgccttttttcagcgtcacagcgatgtgcgccgctttcggccagccgccgtccaccacgcccaccagtttggttttttgcgtcagcgccgctttccaggcacccgtgacgttcgggccaaaaaaggcatcggcgcgacccgattgcagcgccagcgtctgggcggcgtcatccttggtgtacaccggcacaaaaggcttcagccccttctgctggttcgctttatcccatgccagcaggatcgcttcctgattggtgccggagccgacgataatgcgcagtccggcgatgtcttccgctttctcaatgttgctgattgggctggttgatttcacgtaaaagcccagcgaatccttgcggtaggtggcgaaatcgaacttctctttgcgctctttggtgacggtgatgttgctaatggcggcgtcatatttgccggacgccacgcccagcggccagtcctcccaggaggtcggcacgacatttaattccagtcccaggctgtccgccaccaggcgggcaatgtccacctcgctgccgagcagggttttgttgtcatcggaaaacaccgtcagcggcggcgagttcagcgcggcgaccgccacggtgaatttccccggctgcacaaaacggtgatcttttggcaactgcgcgatcgcctgcggattggccggagtattgatcggcgtcttattggcctcaatgctgacgccggtgccattgatagtgacctcttttgcatacgccagcggcgttaaggcgagggtcatagccagtaagagtgaagttttctgcatagcgttattctctattttgtttttataaactgattcaccggcaattcgaggcccagactttcgcgcagcgtggtgccggggtagtcggtgcggaacaggccccgtgcctgtaacagaggcaccacctggtcaacaaagcgcgggaaggtatccggcgtaccgccctgaataatgaagccatcggcggcgtactggctgaaccactgttcaagaccgtccgccacctcctccggtgtaccggcaaaacgcgggcgcggtgaggcggcttccagcgccacctgacgcagcgtcaggccacgttctcgggcattgcgtttgatctcatcggtggtgctgcggaaactgttttgccccagatcgccgatgtccgggaagggttcatccagcggatactggctgaaatcgtgatgttcgaaatagcgccccagatagttcagcgcatcggtaaccgataccagcgcggccgtggtctgatactgctgctccacgtccgccgcgtcttttccgacaatgacgctgacgccctgaaatatatgcagttcatgcgcctgacggccattggcttcaagctggagcttaacgtcgcgataaaaggctttggcttcttctaacgtatcgtgatgggtaaatatcgcgtcggcatgtttggcggctaatttcttgccatcatcagacgcgccagcctgaaatacaattgggcgtccctgcggcgtacggccaatattcagcggccccgccaccttaaagaattccccttcatgattaagcgtatgtaatttcgctgcatcgaaaaactgcccgctcgctttattacgcacgaaggcatcctcttcccaggaatcccacagcccttttaccacgtcgagatattcatcggcgatgcggtaacgcagcgcatgttccgggtgtttatcgcgggagaaatttttagccgacccttccagcggcgacgtcaccacgttccagcccgcgcggccattactcagatgatcgaggctggcgaactggcgcgctacggtaaagggttcgctgtaggaggtggagagcgtcccgaccagcccgaggtttttggtcaggctggcaagcgccgataataccgtcagcggctcaaagcgatttaaaaaatgcggaatggatttttcattaatataaaggccatcggcgacaaataaaaaatccagtttgccctgttcggctttcagcgcggtttcttttacaaaatcaaaattaatactggcgtcagcggcagcggccgggtgtcgccaggcggacatattccctgacgcgccatgcaaaatggtgcccaggcgtaattgtcttgcgcttgtcatagaatgtcctcagtcagtatgtaataacgctttttctgccagccgggcgaaatatcgcgccgccccttccagtaaggtgtcgtcgggattaaacgccggatggtgtaaaccgtattcgctggcgctgccgatgctgacgaacgcgccggggatctgttgcagataaaccgcgaaatcctcaccgcccatatgcagctcagcgtgataggtgcgatagccctgctcgtcggcgacgcggcgggcaaaggcggcccacttttcatcgttaactaacgcctccgggccgtcgaaccaggtcaccgcgatctccgcgccgaacgcctgtcctaatccggcggcgatctcgttgacgcgatctttgacctgctggcgcactgcacgcttatgggtacgcagcgtgccttccagctcgacggtttccggcagcacgttccaggtattgcccccggcgatgcgcgttacgctcagcaccaccgaatccagggtattcacgttacggctggcgacgctttgcagggcattcaccagctggctggcaagcaggatggcgtcgttgccttcatggggccgcgcggcgtgcgcgcctttgcccttcaccgcgatcacaaaacgatcgacgttggcgtaaaacggcccgccgcgggtggcgaactcgccgacgggtaagcccggttcgttatgcatgccgaaaatcgcgctgacgccttccagcgccccggctttgatcaggcgtttcgcgccgccaaaattttcttctgcgggctggaaaagaatgcgcacccggcctgccagttgctgctcgttcgcttttaacagcagtgccgcgccgagcatcgcactggtgtgaatgtcatgtccgcaggcgtgcatcacgcccggattcagggagctgaaaggtacgccgctggtttcggcgatgggcagcgcgtcgatgtcggcacgcagcgcgatgattttttcccctgtccccacttccgccaccacgccggtgggcagatcacagggcagcaggcgtagcccggcgacttccagccactggcgcacgcgacgggtggtttcgaactcctccagcgacagttccgggtactgatgcagctcgcgccgccagtcgattagctgttgtgcaaaactcatccggcgacctcctgcaaggcgtttgctgaggcgtgcgcctccgccagcagacgcagggagtcgaaacgcggctggccctccgccaccggcgtatcaatgacaaattcatcgatgccgtggtcgcggtgcagttcgtcgagggcggcaagaacgctccgggcggtgcctttgatcactgcggattcccgccgcacgatctgcttcgccgggctgcccgcctgccgggcaaaggcctgcgcctgggattcgctcgccacggtgacgcgctgcccgttttccagctccacgccccacaattcgatctgcgccgcctgccggtcggcctgttgctgcgtcggggcgacgatcgcctgcacggcaaccagcgtgttgcgcgcgctgttctgttgccagatgccgagcacctcgcgcagcaggtttttgtcgccgttaaggtgcgcggcaaagacaaaattccagtccagagcggcggcgaggcgcgcgctttccgggctggcgccgagtaaaaaaccgtcgacgcgctgcggcggcaccggggtggctaatacggtttcggcttcctgttcgttaacgcgcagcgacagccagtgatccagctgcgccagttgatcggcaaagctgcccttctcctgcgcgttaacgccctgctgtaacgcccgcgtggacagcggcagaccgcccggcgctttaccgacgcccagatcgatacgccctggcgccagcgacgccagcaggttgaaattttccgccactttataggggctgtagtgttgcagcatcacgccgccggatccgacccgaatacgccgggtttgcccgataatccaggcaatcaccagctccggcgacgggctggcgagctgtgcggtgttgtggtgttccgccacccagaaacggtgatacccccactcatcggccagtctggctaattgcagggtacgcgccagcgcctctgctgcggtttcgccttccgcgaggggacttttatccagaatactcagacgatatgacatgcgcacactcactctgcttaacatgtcaccattaataaatgcctatgaaacacttgtgaaacaactaaataacatttgaaaagctaaaaagtggcaaagtgccgtttcagggttatgaaggctgtcaatttttggcaggccaggctttgcgtagcttacggtttgcaggtaggatgctgcgccatgttttgtcttatccatacgcagaatgactggaaagacagtgcattaattcgtcagggcaatcgtttgttctgtcctgacgggtgaggaaatccttcgatgattcagacaggtcaacaggtaactcaatgaacaaaaacaacaacagcgcagcggagcatcatgctgcaaaacgtcgctggttaaactctcatgaagagggatacaacaaagcgatgggcaaccgccaggtgcagatgatagcgattggcggggcgatcggcaccgggctgttcttaggcgcgggcgcacgattgcaaatggccggtccgtccctggctatcgtctatgccgtttgcggtatcttctctttcttcatcctccgcgcgctgggcgaactggtgttgcatcgtccgtccagcggcagcttcgtctcctacgcccgtgaattcctcggcgaaaaagccgcttatgtagcgggctggatgtacttcgttaactgggcgatgaccggcatcgtcgacatcaccgccgtggcgctttatatgcattactggggcgcgttcggcgatgtgccgcagtgggtgtttgccctcggcgcgctggccattgtcggcaccatgaacatgatcggcgtgaaatggttcgccgagatggagttctggttcgcgctggttaaagtgctggccatcgtggtgttcctcgttgtcgggacgattttcctcggcaccggtaaaccgctggacggcaacgccacgggcttccatctgatcaccgataacggcggtttcttcccgcacggtctgctgccggcgctggtgctggtgcagggcgtagtgtttgccttcgcctccatcgaactggtgggcacagcggcaggcgaatgtaaggatccgcagaccatggtgccaaaggccatcaacagcgtgatctggcgtatcgccctgttttacgttggctcggtagtgctgctggtgctgctactgccgtggacggcgtaccaggcgggacaaagcccgtttgtcaccttcttctcgaagctgggcgtgccctatatcggcgacatcatgaacatggtggttctgactgcggccctctccagcctcaactccggcctctactccaccggtcgtatcctgcgctccatgtcgatgggcggttccgcgcctaagttcatgtcgaaaatgagcaagcagcaggtgccgtgggcgggtattctggcgacgctggtgatctacgtcttcggcgtggtgctgaactacctggttccggccagcgtgtttgagatcgtgctgaacgtggcggcgctgggcattatcgcgtcctgggcctttatcgtggtctgccagctgcgcctgcgcaaagccatcaaagaaggtaaagcggcagatgtgtccttcaaactgccgggcgcgcctttcacctcctggctaacgctgctgttcctgttaagcgtgctggtgctgatggcgttcgactacccgaacggcacctacaccatcgcctctatccccttcctcgccgtgctgttagtggcgggctggttcggcgtgcgtaagcgcgtcaacgaaatccagagcaccgcgccggtacatccggaagacggtaaagacgggaagttaacggaagagttatcccgttaagacagtgtgccgggtggtggctgcgccttacccggcctacataaaccgtaggcccggcaagcaaagcgccgccgggcaaaaagacacaaaaaaggctccttacggagcctttctttttttcacatcacatcacagcgcaatacggatcacatcatccggctgcgtggcttctttctcgcgggtggaggcctgcttcacgctgacgtacagcgttttaccgtctgcggacaacgccaggctgttcgggtgcgtcggggtgtcgaaggttttcaccactttgtagcttttcgcatcgatcacgctcactttaccggcctgacggtgggtgacatagacttcattacgcgccggattaaacagcaccgccagcgattccggggcggcgatcttctcgatcacgttaccgttgcgggtgtcgatcaccactacttccggcgctttggaatcggtcaggaaggcgcgatgtccggcggtatccaggctcaggttaagatagaaatgctctttgccgtcgtcctgcacttttttgcggctgagaattttattggtcgcggtgtctatagtgatgaattcaccgtcgccgttagtggtgtacaggcgtttggcggcgctgtcgatagccagaccggtggcaaaagtgccggtgccgttaatggtggttttcagtgcgatattgtcgccatccaccacccagatcgcactctctttgccgacgccggtgatataaacgctgttggtgctttcgtccacgaccagctcacgcggctgcaacgggcgcacggtttcggaacgtttacgctcatccagcaccagacggcctttcacatcgccggttttggcgtcaatggcggtaacggcgctgctggtcgtgttgccaaaccacagggtctgcgtcctggtgttgatggccgcgccaaacggttttaaatcgttatggatcgcctgggtcacgttcagcgtgaccggatccagacgataaaccaccccgcccttgtctgttttacggctctgcgatgtcgcaagccacagcgcgttttcctgctggctgaacgccatttcataggcccctttccctaccggctggcgcagcatttcttccgctgcggtggcgttgaacgtgccggcaagcagcagagaacctaataacagtgaaccacgcaggcgcggtgagcttaaatgacgagtaaacatgacgactccctttgataacgaatgtatagctgcatcacatggcttccggtcagcgaagtcgcgcttcgcttgtttttctaagtgagaatagtaatcattaattgattaaaatggcactctttcttgccgaatccgccattcaggccataatttctcccggcgattattcacagtaagtgccgttaaagttttcaatttctttacattacccgtaacatgttggcgcatgttccatttggtacgttttatttttaaccggtttaaccatgaaaatcatttttgcacgcccggcggccctgccgtttttgttacttcccgcggtctttcaccctgccttcgcggcagcggaacagaccatgatcgtcaccgcgtccccgcaaaccgtctccgaactggatacgcctgccgccgtcagcgtggtccagggcgaggatatgcgtcaggcgacgccgcgcgtgaacctctcggaatcgctgaccagcgtgccgggcttacagatccagaaccgtcagaactactcccaggatttgcagctgtcgatccgcggttttggctcccgctccacctacggcgtgcgcggcattcgtatgtatgtggacggcattccggcgaccatgccggacggccagggccagacgtccaacatcgacatcaatagtattgaaagcgtcgatgtgctgcgcgggcccttttctgccctgtacggtaacgcgtccggcggcgtgatgaacgtcaccaccgaaactggtcgcgaacccgccaccattgaagcgagcagctattacggcagctttggcagctggcgttacggcctgaaagccacaggcgcggtcggcgatggcacgcagccgggcgacgtggattacaccgtttcctccagccgtttcgccacccacggctatcgcgatcacagcggcgcgcagaaaaatctcgccaacgccaaactgggcgttcgcattgatgacgttagtaagctaacgctgatccttaacagcgttgataccaaagcgaacgatcccggcggcctgagcaaaagcgaatggaaagataacccgcgccagtcgccccgtggcgatcagtacaacatgcgtaaaaccatcaagcagacccaggcgggcctgcgctatgaacgccagctcagcgagcaggacgatctgagcgtgatgatgtacgccggtgagcgcgaaactacccaataccagtctattccccgcgccccgcagcttaatccgacccacgcgggcggcgtgatcgacttaacccgtcattatcagggcgtcgacacccgctggacgcaccgtggcgaactgggcgtgccggttacttttaccaccggtctgaactacgaaaatatgagcgaagatcgtaaaggctacgagaacttcgtgatgtccggcagtacgccggtatacgggcagaaaggccagcagcgccgtaacgagcgcaacctgatgtggaacgtggatccttatctgcaaaccgcatggcagctgaccgacaagctttctctggacgcgggcgtgcgctacagctccgtatggtttgactccaacgatcactatgtcaccccgcgtaacggcgatgacagcggtgaagccagctatcacaaatggctgccggccggatcgctgaaatatgcggtgaccgatgcctggaatctgtacgtggcgggcggtcgtggctttgaaacgccgaccattaacgagctttcctatcgttccggcggccagagcggcctgaatttcgatctgcaaccgtccaccaacaccacctgggaagtgggcagtaaaacccgtgtgggtaacggcctgctgaccgcggcgctgttccagaccgataccgataacgagatcgtcaccgatgccagcagcggcggccgcaccacctataaaaacgccggtaaaacccgtcgtcagggcgcggagctgtcggttgatcagcagtttgccggtaactggcgcgcgaaaatggcctggacctatctgaatgccacctaccgcactaacgtctgtaatgacggcgactgcaacggcaaccgtatgccgggcatcgcgcgtaatatgggctttgcgtcactgggctggcagccggaaagcggctggtacgccggggcggatgtgcgttatatgagcgacatccaggccgatgacgaaaacaccgctaaagcgccgtcttataccgtggttggcctgaacagcggctacaaactcaattatggtaactggatgatggacgtgtttggtcgcgtggataatctgtttgaccgggaatatgtcggttcagtgatcgtcaacgaatctaacggtcgctactacgaacctgcgccaggccgaaattatggcgttggcttgtccgtggcctatagcttccagtaaaacgattccggcctgatcatcaggccggatttttttattagtgcatatcgttgtcatactgacgaagcagaattgtttcacccacctcgatagcatctattattgcctgtttactttccgcgcactgacctttttccagcgaggataataattcatcgtaagcgccgtgactgcgcattaaactttcggacgaaggatagagataattaaagcatgggccgaggcgcacccagagttgctcaatgatggctgtcagcgtgggcatttccgcataatcataaagacaaaaacggaacgtacggttggcctgtaaggtctgttcaatattgccgctggccagcgcttcctgataacttgccgccagctgttgcagctttttcattttatcggcatcgagattagcgcaggccacttccaccgccataccctcgacttttttgcgtatcgcattgatttccagatacctttcccgacgcacttccggcaccagaaacgcctgtgcgggggtggcatgcagcgcgcctgcggaaaccagccgtaaaagcgcctctctcaccggcgtaatactggtacccagttgatcggcaatttctttagtgatgagccgcgcgccaggctttaatgcgccaacaataagtgcgcttttcaggcttacttccacctgcatagtaaggctcatgcgttgcgctttgaccagatcaagcatattccgttcctgtccaatacttaacaatctcaagcgggctagtgtaattaaatgcacgaaatcgtagggatatattctctttatgcatgcctggtatggttcgtctctgaaaggttagtataaattttggttattcagagttaattaaagacgctaatggaaattttgcctggaatttgatggcggcattgaccgccatcaatgttgttatgaccgttcggcaaccttaatcaccagtttgccgaagtttttcccttccagcagaccgataaaggcatcgggggtgttttccagcccgtcggtgatgtgttcgcgatactggatcttgccctctttcacccaggggatcatctcgttgcggaactcgtcgaggcgatggccgtaatcctgattgatgatgaaaccctgcacgcgcagacgttttttcaggatggtgcccatcagcagggagagacggtccgggccgtccggcaggtcggtggcgttatagccgctgaccagaccacatacgggcacgcgcgccgcgctgttcagcagtggcagaacggcgtcgaagactttgccgccgacgttttcataatagatatcgatgccctcagaacaggctttcttcagctgttcggcgaaatcgtccgcccggtgatcgatacaggcatcaaagcccagtttctccactgcgtagcggcatttttcttctccgccagcgacgcccaccacgcggcagcctttcagcttaccaatttgcccgacggtggcgcccaccggcccggtggcggcggctaccaccagggtttcaccggattttggctgcccgatatccagcaggcccatataggcggtaaagcccggcatccccagaacacccagcgcccaggacggatgttccgtttcctgaagcttcaccagcccgctgccgtcggaaatctcaaactcctgccagccgctgtagcccagtaccagatcgccttcggcgaagtcagggctaaaggatttcaccacctggcttacggtaccgccgcacatcacctcatcaatctgtactggcggcgtgtaggacggcgcatcgctcatacggccacgcatatagggatcgagcgacaggtagagcgtgcgcagcagcacctggccttcccccggcgtggcgatgtcatcttcttccaggcggaagttttcttttaccggtgcgcctttcggacgggatgccagtacccagcgacgattacgttgtgaattttgactcatacggatttcctttcgaagtaaaccttaaacaagggtagaagcttaaagccaggtttgctttcacattacgagccagaatggtttaagcgcaccaccagatagcggcagatctctgcggaatcgttgataaatcggcagtcattgggcgggccgagctccagacagtcaccggcgtgcatctgatggcgggtatccccttcgacaaacgtcagctcgccctcttgcaaccagatcagctgacgcgccagcgcataggacgacgcgggcatgggaatgtcgctgcccggcggcagctccacctgcaccagatcaaggggcagatcggtacgtggcgaaacatggcggcgcaggtaatgggtttgcggatcgcgccacagcggttgatcggcaaaacgcagcagtttgccctcctgcatttccgcacgggcgatgagcgtcgacatgctgatgccgaaagcgcccgacagccgcgccagcagcgtggcggtggggctgctctcgcccttttcaatcttgtggatcatcgcccgcgacaccccggcccggttcgccagatcgcttaacgaccagcctctggcttcgcgctcaagacgaattcgcacactgatccgttgatttatgttgtctgtaatagtattcatatcgtaatactatagtgaacaactccagaggttcaaccatgaatattcgttacgcgcacaaagacgactgcgcggccattgctgaaatttttaaccatgcggtactgcacaccgctgccatctggaacgacgccacggtggatgtggataaccgcatcgcctggtttgaagcgcgctcgctggcggggtatccggtgctggtgagtgaagaaaacggcacagtcaccggctacgcctccttcggcgactggcgcgccttcgacggctttcgccatacggtcgagcattcggtctatgtgcacccggcgcaccagggcaaaggcatcggccaggcactgatgatccgcctgatcgaagaagcgaagcgcatcggcaaacatgtgatggtggcgggcattgagtcgcaaaaccacgcctccattcatctgcatgaaaagctcggctttaccatcaccgcgcagatgccgcaggtgggcaccaaatttggccgctggctggatctgacctttatgcagctccagctggataaccgtagcgaaccggacgcgctgccatgaatcagtcgctgacgctggcgtttctggtggcggcgggcattggtctggtggtgcagaacacgctgatggtgcgcattacccagagttcctcaaccattctgatcgccatgctgctgaattcgctggtgggcattgtgctgtttgtcagcattctgctgattaaaaatggcttcgcgggattcagtgaactggcggcgacggtgcgctggtggacgattattcccggcctgctgggatcctttttcgtttttgccagtatcagcggttatcagtatgtcggggcagccacgactattgccgtgctggtcgccagtcagttgattggcgggctggtgatggacgtgctgaaaagtcaggggatcccgctgcgggcgctgattggcccggtctgcggcgcggtgttgctggtagtcggcgcctggctcgtggccagacgccagttttagatcagagaataacgccgccctgggtcaggtgctcgcgcctggcctccagctcttccttgttatgacgatctttatgcgcgatagcatggcgcaggcgctgctgctgctggtaacgttcctcccggctcagctccgcgtcatcgctcagggcgatcagcaactcgttcatgtgcgcgatgacgttctcgtcaatggtggcatccacgcgcgcaataacctcatccagatgcgacataccctctccttacgatctagttaactttggctttggaaaaatcactgcccatcagactgacactataaccgctgacgttgctgcgcgtggcataaaaggttttgccgttcgccagcgcgatccacggcgcctgctgatagaacacctcctgcgcctgttcgtacagacgcgcgcgttcttccggcacgctggtcagcttcgctttttcaaccagatcgttatagcctttatcgcaccagcgggcggcgttagagccggttttgatgctgttgcagccgagcagcacatcggcaaagttatccggatcgccgttgtcagacatccagccaaagagcgcgctgtcgtgctcgcctttacgcatgccggagagatattcgccccactcataagagacgatttttgccttcacgcccacttttgcccagtcgctctggatcatctcagcgatgcgtttggagttcgggttataaggacgttgtaccggcattgaccacagcgtcacttctgtaccctctgccacccctgcctgtttcagcagcgctttggctttttccggatcgtactggtaatccttcagatctttattaaagccgagcatatttggcggcagcggcgatttcgccaccgtgccggagccgaggaacaccgcgtccacaatggcttttttatcggtggcgtagttcagcgcctgacgcaccagcacgttatcgaagggttttttctccgtgttaaacgccagataaccgacgttcagcgcatcgacggaatgcagcgttaaatccttattctttttgatctcgtcaaactgcaccggagcaggcgccggaatgatctggcactcattggtttgcagtttcgccagacgggtctgcacgttcggcgtgatggagaagataaggtgtttggtcggcacttcaccgtcccagtaattcgggttggcgacgtaacggatcaatgaatccactttatattgttgcagcgcataagggccggtaccgatgggccaggtatcgacatattccggcgtgccctttttcagcatcgcatcggcgtattcgctggacagaatggaagcgaaatccatgccccagtcagccaggaacgcggcgttcggttcgttgagaacaaactgaacgtgataatcatccagctttttcacgtctttgatcagcttatccagaccgacatcgttaaaatattcgtaattgccctgggaaacattgtgatacggatggtcggcatttttctggcgcagtaccgagaaaatgacatcgtcggcattaaaatcccgcgttggtttgaaatatttattgctgttaaatttcacgccctgacgcagcgtaaaagtataggttttgccgtccggggaaattttccactccgtcgccagcgacggcaccggggtattatttttggggtcgaaattcaccagccggttatacagcacctgtgagctggccacgaaggtcgggccggagctggcgatctgcgggttaaaagattccggagatgcttcagaacagtaaatcagcgtgtcgttagatgccgccagcgcggcgcttgccggtaagagtgtgctcagcgccagcgcgagcagcgttttccctgtattcattgttatgccttatggatttttatgacagacagtgatcacagcacagcaatataaaactggcaaataacgaatcactatcaggttattctaatgccgcgttttttgttgaatattcatccactgaatcgctgaaaatttgcgttaagtattttcgcaaaggtcaagccctgaagacgttctcaatacgacgagaattcaacgcttttagcctctcttctgtcgtttgtttacatgccggtttgcgtaaagtagacgtgtgaagaagtctatgggatgaaaacgtggcaaaaactctcttgcgcagcggcgatctggatgattttcaggcagttggcggcggcggtcaggccgtatttgattcggcactgcaaattcgtgaagcattacgtctgcgtaaacagcaggcgatggtagattgtctggcaatcccgcaggttaacgatgatggcgatcgcgttgactggtattcgccgattgacggacgcgccatctcgtggaaagccgctgatgaggacgcgcgttttcgcgctctgcgctatctggaaagcaccctcgacagcgccgccgcgctgagccgcaaaagcctgcaatcaaataaaaccgcgcaacagctgtttggctcgctgttggaaaaagccttgcagtttcccggcgttaaccacgttttcctggtggatggcaaaccggttatcaccttctggggctttgttaatctgaacgaaagcgcccgtgacgacgtgctggcctgtctgcgcgagcaggcgctgccggaaccggtaatttcgctggttgagccacccgagccggaagaagagcccgcgccggtggttaatttcagccaggcggacgaaccgctgatcgctccgccgcccgtggtgaaaaccgaagaggttgctgaagccgtttatgaaaaaccccagcctgcggcctccgttaccccagcgcctgcgccggaaccggctgccgcgcctgtggctaaaaaacgttcccctgcgctgtggctgctgcccgtcgcggcgctggtcgccgttgccgtcgccgcgcccatgctgctgaaacaacaggttacccctgaaacgccgctggccagcgccgccgcgcccgttaccccgcccgtgccggtgacgcctgcgccacagctcaccgcttccctgccgctgcatcaggcggatgtcgtcgccgtgaaaaccacggttgtcgaagagaagaaaaccgccccggcggtgatcgccgccatcccgaaagacgtgatggtgatggatgccattcaggtgaaaaccggtaatacccgcttcctgaatggtaactggcgcgtaacgccagagatcaaagatcacgccaccggcaaagcgccgaccctgcgctaccagatccagaacaacaaaggcacggcccgtctggtccaggctggcaatatcacctgccgcgccgatctgttctctggtctgcatcagaccggcgaactgatgatcaaaagccgcagcaatgcgcgttgcagcgatggctcccgctacccgatgccggaaatcacctgcaccgcgggcagcaatgatattgcgcaatgtaccgcacgctatgacggcaacaccgttgtgccggtaaccttcagaaaaacaggtgcctgattttatgctggtaaatctttgcgactacaaacagagcgtgacgctgattgccaacagcggcgtgcagtttcttgatttcgggctgacgccgctggtgtccacccacaatggccgtttcgtgcgtaaaaccgccaacggcccgctgctgcgtctggattacgatctggtgaacgagcgctttaccctgcccgccagcaacggcggcccggcggaagtggtcaagccggaaaacactatcggcctgctggcgtccctcgccctgcttgacggcgtctggctgccgatcccgtttttacgtttcaacccgccgcgtacctttgtggaaggcccggataactgggcgcgggtgcagatccgcaagctcagcgagccggacagcaacggtcacacccaccgcgtgacggtggccctcgacagccagatcaacgatctctcccctgccgcccttgcgcccattgaaaacgacattctgaacggtacgcgtttttcactggcgtggcgcgatgatgaagtggcggatttcctcgatcagacgtggatcgacggctggctgcgggaagtctttttgcaggccatccaggatgaaaaccgcagcgagcgcgacgtggcgcaggcgctgcgcggctttgaatatcaggcgcactggctgaacctgatgacgctgctcggcgagcagctcagcgtgcctgaagtgaagatcgttacccatacgctcagcaccccggcgatcccggtggatttaattctcgacgtgggcaacacccatacctgcggtgtgatcatcgaagatcatggcgatgccaacgatggcctgcgccagaccgccgaactccaggtgcgctctcttagcgaaccgcaatttttaaatgaaccgctgttcacaagccgccttgagttttccgaagcgcgctttggcaaacagcatttctcggtggaaagtggtcgtgaagatgcttttatctggccgtccatcgtgcgcgtgggtgacgaagcccgcaaactggcgacgggtcgtctgggcaccgaaggcaacagcggcatctccagcccgcgccgttacctgtgggatgaaaccccggtgttgcaggactggcgcttcagccagatgaacagcaaatcccagcgcgagccgctggcgaccgccttcccgttgatgaacctgatgaacgacgatggccagccgctctacacgctgccgctggacgaacgtctgccggtcttttcgccgcagtacagccgcagcacgctgatgacccatatgctgtgcgaactgctggcgcaggcgttaggacagattaacagcgtggcgacgcgtctgcgtctgggcttccccgcctcgccgcgtcagctgcgcaccattattcttaccctgccgtctgcgatgccgaaacaggagcgcgagatcttccgtcgccgcatgttcgaagccatcgcgctggtgtggaaagcgatgggctggcacccgcaggacgatgatttcgccagccgcaagcagcaggaaaaaagcgtcgtgccggtaccccgcattcagatggagtgggacgaagccagctgtggtcagctggtgtggctgtataacgaagccatttcccactttgccggacagacggaaacctttttcgcctccctcgcccgcccggatcgccccacagcgcctggcgaagcgccgggacgcgccttgcgggtggcgtccattgatatcggcggcggcactaccgatatggcgatcacccactatcagctggatgacggcaccggcagcaacgtcaaaatcacgccgcaactgctgttccgcgaaggcttcaaagtcgcaggcgatgacattctgctggatgtgatccagcgctgcgtgctgcccgcgctgcaaacccagctgcaaaaagcgggcattactgacgccgccgcgctgatggcgacactgttcggcgactccgggcgcattgacacccaggcggtactgcgccagcaaaccaccctgcaactctttatgccggtgggtcatgcgatcctggcggcctgggaatccagcgacgttaacgatccgctggccggtctgcacgccacctttggcgatctgatcaaacagccgccgacgcgcaacgtgcttaactatctgaaacaggccatcgatccggcgctgccacagggcgcagcggaattcgatattttcgccgtgccgttacaggtcaatttcagcgaactgcaaagcgcgatgctcgccgggcagttcaccctgaccgccccgctgcatgcggtgtgcgaggccatctcccactactgctgcgatgtactgctgatcaccgggcgtccgggctgtctgccgggcgtgcaggcgctgatccgtcatctgcaaccggtgccggtcaaccgcatggtgtggctggataaataccgcgtgcatgagtggtatccgttcagccagcaggggcgcatcggcaacccgaaatcaaccgccgccgtgggcgccatgctgtgcagcctggcgctggatctgcgtctgccacgctttaactttaaagcggcggacatcggcgcgtattccaccgtgcgctatctcggcgtgctggataacaccgttaatacgctgcgcgacgagaacgtctggtatcacgatatcgatctggacaagcccggcgcgaagctcgacgccagactgcatttcccgctgcgcggcaacgtcacgctcggcttccgtcagctggccaacgcccgctggcccgcgacgccgctgtatacgctcagcatcaattcgccggagctggcgaaagccattgccggagacggcgtgctgaatgtgcgcctgcaatttaccggcggcagcaaagcccaggggccggaagccttcaacctgagcgatgcctggctgacggacggcaccccggtggatgccgatgcgttgacgtttaaactgaatacgctggccgatcgccgtcacagcggcagccactactggatcgacagcgggagtgtgtacctgaaatgaaagcgcctttaaaaatttcccaggccgtgatgtcctgggtgcatgacacccgcgcccatgcgccactgctcgacgatgacgccgacgccctgctggcgcgccttaccgccgcgtcggcccaggaatccgtgctgatgcaggcggcagagaccacctgcacggtggcgctgtacggtcattcgcaggcatcgaaagcgcacctgctcgccgccctgtgcaacagcggcaatggccgggtgaatgttaaacccggcgacaaaaccctcgactactttacccatatcaatccgggccatgcgctgaccggtatggcgctgcgtttcacacagaccagcgcgacccctgacgagcgtttcccgctgcaactgggcattctgagcgaagcagaactggtgcaggtgtttatcgcccatgcgcagcatctgccggatctgcgcatggtggataaaagcgtcattgaagatcggctgacccgctggcgcgccctgcgccagccgcaacaggtgccggggatcaccgccgacgaggtgggcgcaattgcccgtttctggcgcgccactgtcccgtctgcccgccagcagctggacgacaggttatggtatgagtttattacgctgttgccgtcgctggatctcagcgcccgcgccagcgcatggtcgctgctgtggggcgagcatcaggagttaacacaacagtggctggcgctggcgcacatcctgcatcagaccggtaatgcccgcgcgctcgccgccccgctcagcctgttggtggataacttcgccctgccgacggagggttttctgaacccgcagccgacggacggcgacagcgcccacggcgaagtggtggtgcatccctggtcggaagatcggttacataacgccgtcagcatcccgcttgccaccctggcgctgctgacccgtgaactggtgctgccggtggaaaacggtgtgctggacggcgtggatattctcgatattccggtacctgccctgggcgcgcagccgtcgctgcaaaacagtaaatgccgctggctgcccgaccattatcgtcagcagttgcagccggacgtgctgatgatctgtaacgccacgccgcagcgcagcgaaaccgccactaccgcgcgcacgctgctcaactgggtgaaggaaacccagtccggccaggaaacggcgctgccggggctggtatgggcgattaccccgcaggatgcgcgtttcactaccgcgcagaatctggatgagaccgtgcaacagctgctcggcaaaccggggcaatactggggtacgttacaggcgctggatgccagcagtctgcaacgtctgatcgagtggctgtcgcaggccacggctgcttcacagcgcacggtgcgcctgaaagcgctgcgcgatcgccatctgcaattgctgcgcgatctgatgcaacactggaccgcgccgctgaaagagacgccggaaagccagcgcgcccgcgctgaagcggcgatccgcgaattacagggccaggcgagccgtcacggtgaactgctggacgctttactgccggagatgaagcatttcgacgcgctgtggaaggtgcagcagccgcgcgaagaaaaagtcagcgggctgtttaacgacgccatcgatctgtttgctgatgtcgccgcgcagccggaaaccgtcacggcggcgaaagacaccggccatcaggcccatgcgatgtggatcaatcacctgcgtcagtggagccgtaacgacgtcagcgccgaacgcttagggttgacccctgccgcgctgcgccaggtcgcggatacactgatcgtcaccagctatcggctggaactgccgcaaagtttacagcagatcatgcagcgcgataccgcctgcgccgcgcagctgcatgccgcgataggtaattttattgcctggcttggctatgcgtcgctgccggaagatcagcgtcctgccagccgggtgcagaaaggccagggtattttcagcgccagcgcccccgcagccagcgatgcccgcctgacgcgtcttggcgagcagccggttcatgccgccacgcgctatgtgtatgactggctggttgcgctgtatacccgcagcaatgaaaacatcggctatcagcatccgcttgatgtgccgttggcgatgcgtaagaaactgattaagctggtgtgatggtgattgccgggatttaacgccgggtggcgctatgcttacccggcctaccgatctggcgtaggcccggcaagcgcagcgccgccgggcaccggatgcccataatttcggtggacataccccgtaggcccggcaagcaacgcgccgccgggcactgcccctttccacaccacatccacatttcgctccccgccgaagcatccgtctttcatccccattacgctggctgaaattcaacgacggagaaaatccatgatcgcagttctttttgaggccgacgccctgccgcacgcgcaggatcgctatttccagctggcggctgaacttaagcccttgctgacacagacggcaggttttatttctatcgaacgtttccagagcctgagcacgccgggaaaaatcctttcgctttcctggtgggaagatgaagaggctgtggctggctggaagcacaatctgcgccatctcgccgcccagcaggaagggaaaacctcgatcttttccttctaccgaattcgcgtcgccaccgtgttccgcgactattcctctgataaaggagcccatgcccatgcatgatattcacgtgatcctcagcaatgcgcccggcgcgctggcttcgctaggttgcgagctgggcaaaaacggtgtcgggctggaaggcggcggtgtcttttccgtggcggacgtcagccacgcccattttctggtggaagacggtgaaaaggcgcgtgccgtgctgcttgccgccggttttgaagtcgtgaagatcagtcggccggtgatcagaaaactgccgcaaaaacgccccggcgagctgggagaaattgcagaggcgctggcccgccacggcatcaatattctggtacagtacagcgaccacagtaaccagctcatcctcctgacggacgatgacgcgcgggctgctgatcttacccgccaatggatgccgctgcatgagtctgctgaacactgaataccaggatgacccggatgagggtctggaaaaatccatgtcgctggttgccgccgcccttgccgatccgtcgcgggtcagcattttatgcgcgctgatggatggccgcgcctggaccgccacggaactcagcgccgtggcggacattgccgcctccacgaccagcgggcatctgactcgtcttttgaataacgggctggtgatgtgcctgacccaggggcggcaccgttattacagcctggccgggcatcacattgccgggctactggaaaacctgatgggcgtgtcgatgcaggcgcgcaccacgccggtgacccgcacgccccagcatctgcgttatgcccgcacctgttacgatcatctggcgggtgagctggcggtaaagatctatgaatttatgcagcatgagaagtggatcagcgctgacggcacggcgctgaccgccatcggcaaagatcggttgcagcgcctcggtgcggtgttaaatcctcatacgcgccgcaagccctgctgcccttgcctggactggagcgagagacgctgtcatctgggcggcgatgcaggcgcggcgctgatggcgttgttattgcaaaaagcctggatcagccgcacgccgggataccgcgaggtaagcgtgacgaccagcgggaaagttgccatgagccggttgtttgggctggcgctggggtgagccttgttgccgggtggcgctgcgcttacccggcctacaaaatattatcggtggacgtatcacgtaggcccggcaagcaacgcgccgccgggcaaaaactcactgccaccgggtctgccactcccataaccggttccatgcggtgtcgttgaggttgcgatccgccgccacgctggcacgatatggccgcgaggtggtcgccgccgatccccagggtgataaccggtcatagctggaatctatcgtactccaggcaatcagcacctgaccgttcgcggtattacccggcagatacccggtcttgcccgcgccctgatcccatgcccgtcccagcttcgctttaaagcttccctgataacccgcatcaccggtgaaacggctgttcagcaccagaaatccatatggctgatccggcagggtgtttggcgcaagcacgtaagcttcctgcgagcggcgcgtggataccgtgtggaactccacgccgtcaaacaccacgctggcgcggccaaacacgtaatccacatccccttcgatatagctgtctttcaccagtacgcggctgatgcggtcggtcaccgcgagattttcacggttactggtattgagatataccgtgtcctggcggccaatcagccgcacgttttccagctgtacgcggtcgccgtcggtgcgcagcgccacgccctgatgggtaccgccatctacagtatcgagcagcgaattcaccacgctgagctgcgccagctgaaaatcattactttgcgaccagaccacagccgcgcagttggtgccaatcagcgcgctggttttaccggcacattgcgcatagagataccaggcgggatcgccctcgcggaactgctgggcaggattgaccgtctggcgatagcgggcgggagaaaacggtgaatcgagcgccagttcaaggcgcacatcctggggctgctcacctgtgccgaacagggtgattggcggcgcgtcggcgggaatatacaccgcgccctgataaacgccgggctgcacgctgatatagatgcgcgagcgatcggtggcattacgaatggcggcgtttatcgcctgttgcaccgtttgccagggttcatttgggccaacgcgccagggcgtggaaacctgctcaggatggatggcttccggttgccacgggccgtccggggcggcaagcagaccgccgcgggcaaaataattttccggcgtatagggagccgcttcctgcgcagtcaatataccgcgcgtttgcgttcccggtacttttccgccgccgttggcacagccatgcaacaccagcggcatacataatgctgctgacagaccaaaaccgcgtttcgccatcatctcgcctcgtcattttaagaaatggaggattgatattaatggaacgctgttttaattaacgacccagggatcatgctttcgcgtcagcccgttgaatcgattagaaaagtgagatcagcagcgcgaccggaaaactcatcggccaggttgagccgaccaggaaagcgctgaggaagcgaatacgcttgcgatctttcgacaaaaaccaggtgatcagtgcgctgatggcggccatgacagcgtagaaagccagcattttttgatatagcgtcattgttgtgatcgattccagagacaaaaccgccgcaatatgcatcgtttattgatattaatcaagttttgttacaacaaaaggaaggggtaaattgattaagacactaaatgcgctttacgacagtacatcatcctgcaccctggcggcctgggcgcaggatcccggcacaggtgcgacacgcagcaagccgcgttatgcgaaagataaatacgcgctggcgacgggcatcaccccgccgttatcgcctgccatcgccaccctgttacagcagttgcatacgctggcggcaggggatccgctggcggatgtcatgccagccagtgcgctgcacttcacctttttagccgttaccgatgcgctttatgacaggccgcagccgccgcaggaactcgccagcctgaagtcggcatttatggatatagcgccgctgaccgtgaccatcagcgatctgcggctggtcgcccttcccgatcaactcctgctcgccggcacgccggatgccgtcagcctcgcgcggcggcaacattttgcggacgccctgctcgccagcccctggaaatcagcgttaacgcagcgttacggcaacaccccgctgccgccgcctttctggcacagcacgctggtgcgctatgaagcggcccgtctgcctgtgcgctttcgtaagtattttgaggaccagcgcgcctcacgttttggtggagtaagcgcgcccttgacgctggcgctggtgaactacaactggagtaaaaaacgagtcattgagacagggcatttataacagggataccagtaacgccatcggaaagctcatcggccacgtcagcccgaccagcacggcggcgagcaggcgaacccagactttgtctttggtgagaaaccaggtgatgacgccgctcactatcgccatcaccccataaaaaatcagtagcttcagatacagtgtcatggtgacggtcgctccctgcgtaaaggcagcaggcattattaacctaacctgctgccctgaaggagacgcctgtcacaaggtggttcaatgtttaatcatgatgtgccgcactacggtgtaatcttccagcccgaagactgacatatctttgccgtagccggacattttctgcccgccgtgcggcatttcgctgaccagcataaagtgcgtattcacccaggtgcagccgtattgcaggcgagcgctcaggcggtgcgcccggcccacgtcttgagtccataccgatgacgccagcccgtactgcgaatcgttggcccatgccagtacctgatcttcgtcgtcgaattctgtcatgctgaccaccggaccgaagacttcgcgctggacgatggcgtcctcctgcttcgccccggccagcagcgtcggctggtaatagtagcccgcgccctcgcgcttcgccccgccggtgatcactttgatatgcggcagcgctttggcttcttcgaccgccgccgccacgcgcgccaggtgtgcttcggaacttaatggccccagttcggtggagccgtcctccggcgcgcccattttcagactggcaatggccgcaccgagtttttccaccagcgccggataaatgcccttttgcgcatagatacgacaggcggcggtgcagtcctgtccggcattgtaatagccgaaagtgcgcacgccttccaccaccgcctccagatccgcatcgtcaaagacgatcaccggcgctttgccgcccagttccatgtgggtacgtttcaccgaagaagcggtatgagcgatgatatgctcgccggtggcaatggagccggtgagcgacaccatacgcactttttcatgaccggtcagcggatcgccgacggttttgccacggccaaacagcacgttcagcacgcccgccgggaaaatatcttttgccagttccgccagcttcagcgcggtcagcggcgtgatctccgaaggtttgatcaccacgcagttgcccgccgccagtgccggtgcgagtttccaggccgccatcatcagcggatagttccagggggcaatggacgccaccacgcccaccggatcgcggcggatcatagaggtgtgaccttccagatattcccccgccgccagaccattaagcgtgcgcgccgccccggcaaagaagcggaacacgtccaccaccgccgggatctcatcgtttaacgcgcagtgcagcggtttgccgcagttcagcgattcgagttttgccagcgcgtcggcgttgtcttctatgacctgcgccagtttcagcagcgcttcggcacgtactttcggcgtggtctgcccccattcgctaaaggcgcgatcggcggcgcgcacggcggcgtcgacctgggctgcggacgcttcggcgatctccagcaacacctccccggtggccgggttatacactgcctgggtttcgccttcgccgttgatcagctcgccattaattaacagttgatgttgcataatatggtcctttctctgtggtcagttatttcccggtgtcgtcctcgcgggtcagccaccaggcaccgaggatcggcagcatagttaccagcatcaccagcagcgccaccacgttagtcaccggcacgtcgcgcggtcggcctaactggttgagcaaccacaggggcagcgtacgttcatgcccggcggtgaaagtggtgacgataatttcgtcaaacgacagcgcgaacgccagcatgccccccgccagcagcgccgaacctaagttcggcagcaccacatagcggaaggtctgccagccggtcgcgcccaaatccatcgacgcttccaccaggctccatgaggtgcggcgaaagcgggcaatcacgttgttaaacaccaccaccacgcagaaagtcgcatggccgatgacgatggttaaaaaacccggctccagatcgacggttttaaaggccgtcagcagcgccagcccggtgatgatccccggcaatgcaatgggcagcagcaacagtaaagagatggcgtttttgccaaaaaacgtgctgcgccataacgctgctgcagcaagcgtgccaagtaccagggcaatcgccgtcgacagcgcggcgactttaagtgacaacgtcacggattcgagaatgtcgccccttgtggcggccacgctgaaccagcgcagcgtcagcccctgcgggggaaaactgaaggcggcgtcttcggtgttaaacgcatagatggcgatgatggcgagggggaaatgcaggaagatcaccccgccccaggccgcgactttgagcaaaaagggggcgcgatcagagtgcatcgaaagctcccagacgtttcacgaacgccagataaagggcaatcaatacaatgggcaccagcgtgaaggccgccgccatcggcatattgccaatcgccccctgctgggagtaaaccatgttgccaatgaaatatcctggcgggccgatcagttgcgggacgataaaatcccccagcgtcagcgagaaggtaaaaatcgatccggcggcaatgccgggaatagccagcggcagcaccacataacggaacgtctgcgccggacgcgcgcccagatccgccgacgcctgcaacagcgaggcgggtaaccgctccagcgccgcctgcaccggcaggatcatgaatggcagccagatatagagaaacaccagaaagcgcccgaacccggaggtggaaagcgtgctaccgcccacggcgggcagcgtcagaaaggccgccagcagcggttgcagccccagatggcttaaaaaccactgcgccacaccgtctttcgccagcagcagcgtccaggcgtaggctttgacgatgtaactcgcccacatcggcaacatcacggcgatatagaaaaacgctttcattttgccggtggtataacgcgccataaaccacgccatcgggaaggcaagaatggcgctggcaacggtgaccgccagcgccatggtgagcgtgcgcaggataatgtcatagttggcggggttgaacagcgccttcaggttcgccagcgttagatccggcgtcaccgacatggtgaaatcgtcgaaagtgtaaaacccctgccacagcagcgtaagcagcgatccgaaatagactacgccgaaccacatcagcggcggcaccagcagcaggaacagcccgaggccaggcctgcgccagaaaaagcccgacagccgccccgtttgtggcggcgcagaaagacgggagaagtttgtcgccattcagcccgccccctgcagtggtaccatcgccgcccgcgcccagcaggccagcaccctctgccccggctgtaatagttcgggcagctgcgcgtcggagagattcgcctggctgaccagtaatttttccccgcccggcaagcgcagctcaaagcgcgtcgccgccccctgatactgcactgcctgcaccacgccctgcacctggatctcgccggactcgttcagccggatatgctccggacgcagggagtacatccccgtcataccgcacagctgacgggcggtgtcggcggtaaaaacgttggcggtgccgacaaaaccggcgacaaagggcgtgcgcggtcgcagatagagctcgcgcgggctgtcgatttgctcgatgcggccattgttgaacaccgccacccggtcagacatcgacagcgcttccccctgatcgtgagtcacaaaaataaaggtgatgcccagatcctgttgcagctttttcagttcgaactgcatctgctcacgcagtttgagatcgagcgcgccgaggggttcatccagcagcaatacccgcggctcgttgaccagcgcgcgggcgattgtcacccgctgccgctggccgccggaaagctgcgacggtttacgggtgtgcacaaatcccagcgccactttttccagcgcctcgcgggcgcgggcatggcgctgttttttgtcgacgcctttcaccatcaggccgtaggcgacgttgtcgaggatcgacatatgcgggaagagcgcgtaatcctgaaacacagtattgacgtcgcgctgccagggcggcagcgtgctggcgtcctgcccgaaaatacgtatcgccccgcctgacagctgttcaaacccggcgatcagccgcaggcaggtggttttgccggagccggacggccccagcatcgagaaaaactccccgtcctgcacctcaaggctgacgccatccaccgcccgcacatccccatacagacgcgagacattctgaaactctacggcccgggccatgcttaacgtccacccataatggcgatgtaatcctgcgtccagcggctgtacggcacatatttaccgccgtccgccaccggcgttttccagaaggcgattttgtcaaagaagctgtagccgttggtgtcgcagcctttctcgcccagcagcgtgctggccttgcagccttccggcaccaccggcagcgagccaaaccaggccgccacatcgccctgcacttttggcgtcagcgaccagttcatccacttataggcgcagttcgggtgtttggcgtcggcgtgcagcatagtggtgtccgcccagccggtgacgccctctttcggaaagacggtggcgatgggctgattttcgcctttcagcgcgtttgcctgatacggccaggcgctggaggccaccacgccttcgtttttgaagtcgctcatctgcacagtggtgtcatgccagtagcgatggatcaactgatgctggtcgcgcagtaccttcagtacggcgtcgtactgctgttgggtgagctggtagggatcctcaatgccgagttccggctgggtggctttcacatagagcgcggcatcggcgatataaatcggcccgtcataggcctgtacgcgcccctggttgcttttgccgtccggcagttgctgtttgataaacagcaccgcccagctgtccggcggcgtggggaacgtggtggtgttgtacatcagcaggttcggcccccactgatacggcgtgccgtagactttaccgttgacgttaaaccagtcgcccttctccatacgcggatcgacgtttttccagttctctatcagcgcggtattgatcggctggacgcgttttcccatgatcagccgcagggaggcgtcgccggaggcggtaaccaggtcgtagccgcccttcgccatcaggctgaccatttcatcggaggtggcggcggttttgacgttaacggcgcagccggtctctttttcaaaggccgtcacccagtcgtagtccttatcggtttgcccgcgctcgatataaccgggccaggcgataatatcgagccgcccttcgccatcgccgatttttgtgggcggttcggcggcgtgggcgcaggcaagggtcatgcccagcgaacacagacagctgcgcgcaaatgttttgctcatacggatgtactcctgtcgcaataagaggtgcggcagccgtgccgttaaaaagtctcccttcataaaggtagacagcggcacgatccgtataaaagaaatttgctcaggttgtgaccggcgttaaattcagtaaataagccgccgcaaagagttgttatttcagcaattcacgaattaattgtccgaggatcttcaccgcctgttcctggcggtcgccccactcccaggaggtgttaaagcggaaaaacggcacccaggcgtcggaggtggaaaacatcttgcccggcgcgatgctgatgcggtgcgccagcgcctgctcgcttaattttcccgcatccagggttgcgggcagttcgatccataaaaaatagccgctgtcgttgtggtgaatcttcacctccggcggaagatggcgcagcagcgcctgccagctttgctgtttgcgggcggccagcgtgcgccgcaggcggcgcagatgggcgtcgtaacgctgggtggagaggtaatcgaccagcgccagctgcaccggcgaactggtggataaggtgctcatcagctgtagctgctggatacgccgcgcatgtttccccgccgccacccagccgatacgaaatcccgccaccagacatttggaaaacgacgagcagtgcagcgtcatgtcctgcgtgtcccaggctttggccggcaagggtttttcccgcccgtaatacagctcgctgtaaacatcatcctcaatgagcgtgacgttatgctgtgccagcagcgccaccagtctggcttttttgtcggcgctgagggtaaagccgagcgggttctggctgttagtcatcagccagcaggcttttaccggatagtcgttcagcgcctgggcgagcgcttccagatcgataccctctttcacgtccgtcgccactgacaacgccttcagccgcagccgctccagcgcctgcaatgcgccgtaaaaacaggggttttcgacgatcacccagtctcccggctgcgtgaccgcctgcaaactcaggttgagcgcttccagcgccccggcggtgatcacgatttcatccggcgatatggtcatgccctgctgggcgtaacggcgggcaatggcatgacgcagcgcggcattgcccggcggcaggttttcgatcacgctcatggcggtggcggttttgccaatcgccgaaagcgagcggttgagctgctgctgcgggaaaagatgtggatcgggaaacgccgagccaaacggcagcaccgaggcgtcacagcttgcctgtaacacgtcaaaaatgtaggtgttgatgtccaccgcctcatctcgcatcacctgcgcgggcggcgtcagtttctggctcaccggacgcggcgcgacgaaatagccggactgcgggcgggcgacgatgcgcccctggctttccagcatctgataggcatggccaacggtcataaagctcaggccgctgtgcgtcacctgctcgcgcaacgaaggtaaacggtcccctggctgccagacgccgagttcgatctggtcgataatttgttgcgcaaggcgctgatattttttcatttcacttacacaaaactaacctaaacttaccgtaccacgacagttgccctttcgctatatcagttcactcaaaatgacggctttttgcaaactgttatctaaaaatatcgggtatctgcgtctgcacgtttcgctcccggatcattaccattaacgctaacagcaggttatcagaggttgtctatgttcggtcttgatgcgtttcatctggcgaggatccagttcgctttcacggtttcattccacattatctttccggcgatcaccatcgggctggccagttaccttgcggtgctggaagggttgtggctgaaaaccaaaaatccggtgtggcgtgcgctgtaccatttctggtcgaaaatcttcgccgttaactttggtatgggggtggtttccggtctggtgatggcctatcagttcggcactaactggagcggcttttcgcagtttgccgggagtatcaccgggccgctgctgacctatgaagtgctgacagccttcttcctggaggcgggttttcttggcgtaatgctgttcggctggaataaagtcgggccggggctgcactttctggcgacctgcatggtggcgctgggtacgctgatgtccaccttctggatcctggcgtccaacagctggatgcacaccccgcagggctttgagatcgtcaacggtcaggtggtgccggtggactggttcgcggttattttcaacccttccttcccgtaccggctgctgcatatgacggtggcggcgtttctcagcagcgccctgtttgtgggggcgtccgcggcctggcatctgctgcgcggtaataacacccccgctattcgcaccatgttttccatggcgctgtggatgacgctgattgtcgcgcccattcaggcgatgatcggcgatatgcacgggctgaacacgctggagcatcaaccggccaagatcgctgccattgaaggccactgggaaaacagaccgggcgaagcgacgccgctgttgctgttcggcctgccggatatggaagaagagcgcacccgctacgggctggagatccccgcgctaggcagcctgatcctcacgcacagtctggataaacaggttccggcgttaaaagagtttccgaaagagaaccgccccaactccaccattgtgttctggtcgttccgcatcatggtggcgatgggcctgctgatgatgctgcttggcgtcgcagcgttgtggctgcgttataaacaccgcctttacgagtcgcggccgttcctgcattttgcgttatggatggggccttccggacttatcgccattctcgccggatgggtgacgacggaagtcggccgtcagccctgggtggtgtatggcctgcaacgcactatcgacgcggtttccgcccacggcgatttgcagatgagtatcagcctgctgaccttcttcgtggtctatacctcggtcttcggcgtcggttacagctacatggtgcgcctgatcaaactggggccgcagccacctgacgaacatcccacagatggccggcctgcccgcccgctgtcggccaccagggaggagtttaaataatgggtatcgatctgtcggtaatctggtttgtgatcatcgtcttctccacgctgatgtatatcgtgatggacggctttgatctgggcatcggcattctgtttccgctggtacaggatgaagacgagcgcgatgtgatggtcaacacggtcgccccggtatgggatggcaacgaaacctggctggtgctgggcggtgcgggtctgttcggtgcgttcccgctggcctatgcggtcattattgacgcgctgaccatccccctgacgctgatgctgattgggctgattttccgcggcgtggcctttgagttccgcttcaaagccaccccggaacaccggccgttctgggataagtcattcctgtgcggttcgatcctcgccaccttcacccaggggatagtggtgggtgcggtgctgaacggtttcccggtgacgggccgtacgttcagcggcggtgcgctggactggctgacgccctttaacctgttctgcggttttgggctggtcgtggcctacgccctgctcggcgcaagctggctggtgatgaaaagcggcggtgaattacaggtgaaaatgcgtcgctcgtcgaaacagctgctgctggcgctgctggtggtgacggcggtgatcagtctgtggacgccgctggcgcatcaggcgattgccgatcgctggttcagtatgccaaatatcttcttcctgatgccggtgccggtgctggtggtgctgctgagcctgtggcaatggcgcagcctgagtaacgtcgagcaccattcgctgccctttgtgctgacgctggggttgattttcctgggcttcagcgggctgggcatcagcatctggccgcacattatcccgccgtccatcacgctctgggaggcggccgcgccgccgcaaagccagggctttatgctggtcggcgcgctgctgattattccggtgatcctggtctataccttctggagctactacgtgttccgcggcaaagttaaacccggcgagggctatcactgatgcagaaacctttatggaaacggctgatgtggctggtgatcatctggggcgccagcgtgctggcgctcggcgcggtgagtatggggttccggctgctgatgagcgcggcggggtttaagtcacattgatgggcggttattgcccggcgcaatcatgcagccacaccatacgtaggccgggtaaggcgcagccgccacccggcacattcacgcaaccacaccataccccaggccgggtaaggcgtagccgccacccggcaataacgtcaaactcctttgcgtttcggcaaggtcttcatcagatcttcaggactcaccgacgccaccacgctgcccggatgcggcattttaaggatacggtttttgatcttacccactacgtgcatctcacacggacggcagtcaaatttcagggttagcacttcatcgccatgcaccagctgcatcggcgtcgctttccagctcttgatcgaaccttttgcctgtttcgggcagagattaaacgcaaaacgcaggcagtgtttggtgatcatcaccggcacgtcgcccttctcttcgtgcgcctcgtaagcggcatcgatcagctgtacgccgtagcgatgataaaacgcccgcgctttggcgttatagacgttggcgaggaatgacagatgcgtttccgggtacaccggcgcaggtaccgccaccggtttacggctgccgcgctcatagttagccagacgggcgtcgtccagcagttcaatggtttcacggcgcagctggttgagcagactgttcggtacaaagagcgcacccggcaggtttacctgaatatcgcgcgcgtagtaacgggtctggcctaattttgccaggccatcctgcaactggtttaacgctttttcggcgttattggcctcatcgaactgaccgtccagcgtatgggtgacgctgatgccgtcttcacaggtgacggtgaggatcagctgttcctgccagccgcccagctcgatatccaccgcgatacggcgttcgctggaggttttggtcagcgcctgctgccagttatggtcgaggttgcggttcagcgccgtatgcggcttcaccttaaacagatcggcgggcatctcgttcgggaagacgcgataacggttttcggcggttttctccaccgtgttggcacgaaaacctacgatttcgcgcttgatcatcacgttaagcccgtcgccgttcgccaggggttcagtgacttccacatccaggtgatctttacccacccgcagcacttcgcccaccggcaggccgataaacttcggcgaatcaaaggccccaatgtcagccttacgggcattcacaaaataatcggtgctgccacggtggaacgtcttatcagtggacggaacaaagaagtgctcggtacgcccggcagaagagcgcgccaggtcgccccgatcttcaatgatggcatcgagcatctgccggtaatgggcggtgatgttcttcacgtagctcatgtctttatagcgtccttcgattttgaaggagcgtacaccggcgtcgatcagctgcccgaggttggcggtctggtcgttgtctttcatcgacagcaggtgtttttcataggacaccacgcgcccctgatcgtctttcagggtgtacggcagacggcaggcctgcgagcagtcgccgcggttggcgctgcgcccggtctgggcatgagaaatgtagcactggccggagtacgccacgcacagcgcgccatgaatgaaaaattcaatggtggcgtcggtggcctgatggatggctttgatctgctggaggtcaagttcacgtgccagcacaatctgtgagaagccgacatccgagaggaatttggctttttcaacgctgcgaatatcgcactgggtgctggcgtgcagttcaatcggcggaatatccagttccagcacgcccatgtcctggacgatcagcgcatccacgccggtctggtagagatcggtgatcagccgctgcgccggttccagctcatcatcatggagaatggtgttcagcgtcacaaacaccttcgcgccatagcgatgggcaaaaggcaccagtttcgcaatgtcctgcaagctgttgctggcattgtggcgggcaccaaagccggggccgccgatgtacaccgcatccgcgccgtgaagaatggcttcgcgggcgatgtcggtatcacgggccgggcttaataattcaagatgatgggattgcaggcgcatacggtcgtcgttatccaggatggtcaaaatggccgctattgtagtgagaatagcccacagaccaaaacactttccacgccttaaccgcggcttttttctttggggtaatggatcagtgaatgaaagtgcacggtctgcgcggtgctgttgcgataggcatgcgctttatccgccgcaaaacgtacgccgctgttggcgctaatgctctgccactggccgtcgagacacatctccagcacgcctgaaatcaccaccacatgttcaatcacaccgcattcgtggggcgtggattcgctcagcgcgccgggggccagcgtgatggaaaacagatcaaagtgcagttgcgcatcccaggggaacaagggcgtgataaccatcgcctgctggtcgggatcgtaggcctggggcaccatcgtatcgggcgcggcaataaaggtcgaaaacggcacgttcaggccggtggcgattttccacagcgtcgccaccgtcgggctggactcgttgcgctcaatctggccgagcatcgccttggatacgccggtttcttccgccagccgtgacaaactccagccccgcgcctgacgcaggcttttcagcgtcccggccagatactgtgtcagatccatcattttctcctggttgcattacccgtcgcttgtacgttatagcgcacagtgatagtttgtgcggacgctataacgcacaaggatcattatgcgtccgttctctttcccactccccgcgctgctcgtgggttttgttgcggtgctggtcggttacgccagctcggcggccattatctggcaggccgcttctgccgccggtgccagcgaggcgcagatcgccggctggatgaccgccctcggcctcgcgatgggcgtcagtacgctggcgctcaccctatggtaccgcgttccgctgctcaccgcatggtccacgcccggcgcggcgctgctggcgaccagcctgcacggggtaagcattaacgaagcggtaggcgtttttattttcgccaatgcgctgatcctgctgtgcggcctcaccggcttatttgcacggctgatgaaaattattccccattcgctggctgccgccatgctgggcggcatcttactgcgttttggcctgcaagccttcaggaatattgagggacactttttattgtgcggcagtatgctactggcgtggatgctgggcaaggcgttcgcgccccgctacgccatcgtcggcacgctgctggcggggattgtcgccgcatgggcttcaggtgacgttgtcacttatggactgcattttaacccggtcatgccggaatttatcgccccgcagttcagcctgaccacccttatcagcatcggcattccttttttcctcgtcaccatggcatcgcaaaacgcgcctggcgtggcgacctttcaggcggcgggctatcaggttcccgtttcgccgctgatgatttttaccggcgggttaacggtactgctgtcgggtttcggcgcgttttcggtgtgcattggcgcgatcagcgcggcggtgtgtctcagcccggatgcgcatccggacgccagtaaacgctggctggctgcaatggctgccggagggttttatctgctggcggggatttttggcggttccattaccgcgctgatgacggcgctgccggtgagctggatccagacgctggcggggctggcgctgctcggcaccttcagcggcagcctgtatcaggcgctggcgcatccccgtgagcgtgacgcggccattgtcacctttctgatcaccgccagcggcattacgctgctcggcatcggctccgccttctggggattgattatcggcggcgcatgctacgccctgctgtcacgcgcggcgcgcgcgtagctgcgaaggcgttataccggtgacgcttttaaagcggttgctgaaatggctggcggagttaaagccgcaggccagcgcaatatcggtcagggagctgtcgctgtagcgcaccatctgctcggcctgcgccatgcggcgctgcatcacatactggtgcggcgccagccccatcgactggcggaacatgcgcgcgaaatggaattcgcttaatgccgcttcggcggccagatccgccagcgtcagcggttgcgcgaggctggcgtcaatataggccaggacgttgcgtaataccgacggcgacagcccgccggtgacggtcggcagccgccagcgcacgttgctgtagtgctgcaccagatgggttaacagtaaggttgaggcggtgctcagcgtcagctgattcgcctgctgctgccagtcgcagccgagcagaaaatgacggtacagcgcggtgatctgcgcgtcttcgccaaacatctgttcgttcagggttaaggatgcgggacggcgatcccagatttgctcgctgaccgtacgcagatgcgcatcggtacagtagagatgcacaaaggagaggtcgtcgcgaatatcccagctggattcgctgtcggtcggcatcaggcagaaacgatcagggccgccgccattcttccagccgccggaggttttgtgatagctctcgtaaccgtcggcgatgtacaggctcagcgtgtggtgatcgcaatactgggtgatgttatcgcgcgtgttagaccaggcggccagctgcataccggtattaagcgccaccgaatcatgcagcaccgcattgtgattgcgcagattttcaaacgcccgataagtttccgccataacgccgcttaacaaatgattaaccagatccgcagtttacccgccttccccgcatattgtcccgccgcccgataaaaaagcgcaagaatttgcaagttgaccgcaatacggtgcaagccgcgggcgaaatgccacgccagaatcagcagcaggtcaaccgagaagagataaaacatgaacgcattattgtattgcctggtagtggtgatctggggcaccacctggatcgccatctttttacaacagggcagcgtcccggcaccggtttctatattctggcgctttgcgctggcgaccctggtcatcatgacgacgcttattgtgtggcggcgtttgcggccgctggcgcgacgcgatcacttgttttgcctgttgcagggcggctgcgtgttcggctttaacttctggtgtttttataccgcggcggcatggatcaataccgggctggagtcggtgatcttctccatggcggtgctgtttaacgccatcaacagctttttgtttttcggtaaccggccacctgcccgcttttacctggcagcgctgctgggactgtgcggtattgtggccctgttctggcacgatctggtcgccaccgatatgagcagtacgctgctgatgggtatcggcttgtcggcgctcggcaccctggggttttcgatgggcaatatgatcagtctgcgccatcagcgtaacgggctggaaaccatgaccaccaacgcctgggcgatgctctacggcacgctgattatgggcgggattgcgctggtgcgcggcgacgattttaccccagactggacgctctcttacctcggcgcgctggtctacctggcgctgtttggctcggtaatcggcttcggcgcgtacttcacgctggtcggacgcatcggccccagcaaagcggcatacagcaccctgctgtttccgctggtcgccctgaccatctccaccctgtatgagggttatgtctggcatctgaatgcagtgtgcggactggcgctgatcctggtgggcaatctggtgatgttcgcccgcccggaaaagtggtttaccggcaggggctggcgggtgaaacaggcataaaactgcgccaccggtcggtggcgcgcggttttactttttgttgagatcgaacatggtggcgtcggtcgccatgtcgtcaaccacctgttttaaggtttcgacggtcatcggcgtgctttcattgttgagatctttcccttcgcccttacgcaccactttcagcaccggtttattggtggcggcgtcaatcagttcgccttcaaaatagagatgcgtgtccatggtacggtgcccggtggcggcctgcgtcccggcgaccagcagcgcgacgggcaccacttcatagaactgtagcccttctttgctggaattcaccccggtgatcgccccgcggaaaatcaggctgtgcgcgccgggcgacgtcaccagcggtttacgctgtccgatggcaggtttcagtttgctgttggtgtagttcagcagaccatccagcgtttgctgcccgatttgcgaggtcggttttgccaccggatagtaagtcaccggatgataaataatgctgtcgtactggttgggatcaaaattgggatccacccaacgcaaaacaggtttacccgatgcggaggtggtttgctgcaagccagaataatctttcaaaaacccggaatagttatcaggctccgccactttcgacgcacagcctgccagggtgagcaggcctgtaagcactgcaactttaaataaagtatgagtacgcataataagatctcagttagtgcacatatgcacaggtggttatagcaaaaccattgtgtcgctgttgtgactaaaagaggcgtggcgcacatttcaggcaaataaaaaacccggcgtcaggccgggtaatttatgctcaggcggctttacgcgccagcagcgtggcgaagcgcagtttaatgcggttgccattcgcgtcggtgcggtgtaattcccccggattttcattgtatttcacgatctcccagccgtcgtaatagttgcgcagttcaccttctttaaaggcaaacgggaagccgacattgcacggaaaatcttcggtatccatggcggcgacaatcaggttgtagccccccggcacggtgcagcgctgcatattggcaatcagccccggaatagtctgcggctcaaggaacatcatcaccacggtggacaaaataaaatcgtagtcgccatcgaaggtcagcgcgttcagatcctgaatagcaatctcaaggttatccagcccttccgccgctttgatgcgttgcagattagcaatgctgttggggtttttatcccaggccgttacgttaaagccttttgccgccagccagacgctgttgcgcccgttgccacagcccagatccagggttttacccggtgggatcatcgccccggcttccagcacttcggaatgggtacgggtcaggccgtatttctcagtaaaatagttttcatcgcgagtggtcattattcatccttagcgttaattaattgtgccgggtcgacgcggatcagcagtttgccctgaaataacagcatcagggttttgatccccagtagcactatgatcaggttacagaacacaaacagcggcagcgccagcgtgtgaaagaatcccgcgcccgcgctgtgccccagatgtaatccggttgtggccagcgccgacacgccgaacgaaaagctccagaaggtggcgttaaacggctgcgacagataccaggggatcagccgcagcataaacagcagttgcagcagaccatagccaaacagcattttggcgaaggtgtccgcctcgccgccgttgacgctaaaccaggcgctacaggcgaccagcgcgggcgcaagctggatgccgagggacgtgcgcatggcgacgggcagctccccggcgctgcgcagccggtgaaggatcgccggttcaaggctgagccaggagaagacgccggcccctaaaaacaccagcccggcgtcatgaaaaccgagcgcgccgcaggccatggcgctgataaagttattcgccaccgtcggcagatacagccccggcgtggtggcgtcctgcggatgacggccacgccagaggcctgcggattgccaggcggcataggttagctgcaccgtcaccccgacgataaacagtcccagcgccagcgcgcgccaccagggcaccatgccgatggccaccagcatggtggtcgccggaaagaggctcacaaagctgctctgcaccggatgacgcatctcccgcaaaacgctgtacggatagcgcgccagtcgccacagaaatgccagcgtcagcaacgcccagatacaggtcgccagcgcgaccagcccgtcgccaatgacgtggctgaccggccagatagtgctggcataacgccaggcgaagcccatgccgataatccccagcaccatcccgaaataaccggcgggcaaatgcagcacttttttgctaacaattcggttacacattttgttgaatttttaaatgatatttgaaatacattttatggaaattcgcgccagatagccagtgacgtaaattttgctacgctcagtgaaggcttctgcggaataaccaagatgaataaatatcgtctcagcgatgagtgccgcacgttcagctatcaggacggcgtggaaaagcgcagcatcagtctgcgccagattatagcctttaccgaatttaacgatgtgacggccgggacgcccggcggctggatcgatgatgaaagcgtgctttctcagcacggcgactgctggatctacgatgaaaacagcctcgcttttgacggctgccagatccgcgataacgcccgtattaccggcgcgtgcattctgcgtcataacgcagagatcagcgataacgcctgggtggacgccgcggaaatcagccatggggcgaggctgtgcggtacggtgctggttcaggcgtcaagggtgcgcggcgactgtgacatcgccgatgaagcgcgggtgcttaacggcagcgacgtcattgccgcccgcggtctgacgcccgaccagcaccagcgattgcgtatcttccagcgcgctaccgtcagtcgctcccgcgtggtgcatcaggcgcaaatctacggtgacgccatcgtcaacgatgcttttatcgagcaccgcgctgaggtgtttgatttcgccctgctggaaggcaatgaagaaaataacgtctgggtgtgcgactgcgccaaagtttacggccatgcgcgggtggtggcaggcagtgaggaagacgccattccgacgctgcgctacagcgcgcaggtggcggaacatgcggtagtggaaggcaactgtgtgctcaaacatcacgtgctggtcggcggtcacgcatggctgcacggcggcccgatcctgctggataacaaagtcattattcagggcgaggcgaaaatcagcggcaatgtcctgatcgagcagcaggtggagatcagcggtaccgtcaatatctcaggccaggcggacggtggcattcacctgcgcggaccaaaggtgctgaacggcgcggagcatatcacccgcacgccgcttatcggctcactgtgacgccgaatcgataatacgcgcgtaaatatactgatcgtcaaagcggccgttaaggaattcggcctctttcagacagccttcgcgcgtaaagccattgcgcagcgctacctgattgctggcggcgttgtccacccggcatttgatcacaaaacggcgcacttccccgcgcgcggcgtaaaacgccataaatgcctgtaacgcctgcgacagcaaccctttcccctgatgatcttcatccagccagtagccgatataggccgttttattagacggctctacagagttgaacgacagcacgccgacgatgcgttcgttgaacttcagcaggaacattttcgcgtagccgcgctggtgcagcatgatgttgctctgcgcgtttttcagcgagtcgtcttccgaaccgacatattgcggccagtttaagaactgttgcagccaggttttgtttttcagcaccagttggtgcagctcggggacgtcctgctcgttgatggcgcagagcgtgagggtgtcgctgacgggaataaggtcgtcctgagtcatgggaactccttgaggcgggaaaaatgccgggtggcgctgacgcttacccggcctacggtttacaggcgctgagcagaaacgtaggcccggcaagcctgcgccgccgggcacaataccggcaccgccgggtggcgctgatgcttacccggcctgcaagttacaaatattaacgcattacgcggtcatcgacgtaattacgcttgtcgggcgcgggcgggaaatactggtacagccaggtttcgctgatggcatcgccctgacagcgcaggaacatgcgcatatccaccggatcggtggaatcattagtgggataccagtcgaactggatgcgatagccgtcgatcggctcaacgtagaggatctccacctgtttcgcttcgccgttcgacagggtgatcaccggctcaatgcccttcggtgctgacgctttaatatcgccgccgacaaaatccaccgcgaagcgacgcgcccatacctgcggataatgctcgcccggcgcccagccttccgggaaaccgcccatgccggtacgggtcgccagcacgcgcgccatcggcgtatgcaccggcggttgcgcgctccagtagagacggtactggaaggcgagatcttcacctgctttgatcggccgctccggctgccagaagcagacgatgttatccagggtttcgccggtggtcgggatctccatcagcgccacagaccctttgccccacttgttgcgcggctccacccacaggctcgggcgtttgttataccagcccatgatgtcctgatagtgggagaaatcgcggtccagttgcagcagcccgaagcccttcgggttgtcgtcctgaaaggcgttgaactgtaatttctgcgggttattcagcgggcggcagatccattcgccgttgccgcgccacatcgccagacggtcggagtcgtggatctgcgggtgaatggtgtcgcacatgcggcgttcgttgttgccgcagctgaacatgctggtcatcggcgagatgccgagctgtttgatgtctttacgcgcgtacagatggttatccacctccatgatcacctggcttttctcgcagtggatcacgaatttgtaggcaccggtgaggctcgggctgtccagcagcgcatacacggtgaaggtggtgtcggtgggtttcgcggtttcaaaccagaaggaggtgaaatccgggaactcttccggcgtgtcggtaaaggtgtcaatcgccaccccgcgcgcggataagccgtactggtaggtgctgtccaccgcgcggaaatagctcgcgccgaggaaggaaacaatatcccggcgcgccagctccggcgctttaaaggcgcggaaaccggcaaagcccagatcgctctgcccttccagctgtttcgtatctacacccgcgtcgtggtagttgaacagctccggacggaaatggatctcgcgcgcttcggaggtggcgggatccagcgagaacatgcgcacgcggcggcggaagcccataccgacgtggaagaactgaatatccagctggcgatccgggatgttgttccacaatgagtgctgcgcatcgtactggatgctgttgtaagcctgcggcgtcagtgtggccagcgtatccggcagcggcttaggtttaccggcccaggcgttctgcgccaggtcatgggccatggattgcagcacggaaaaatcgaagcgacggctttgaccatcggcaatgccaggttccgcagcaaatgccgcacgggggaagagagaggcgaatcccgttgttccgcacgcagcggccagggccatagagcctttaataaatcgtctgcggttcatgcctgagaaaacatccttctggtcgggtgaatgcgttccgccactggcgaaacagcggcatcaaaaagaacgctcactctagacaaaaaacatagagaatccaatgcctggttggtgatcgtctgcgcaaagttgcaatatcgccctgtcgatgggagcgcactgattcctgcgtaaagaagtgtatgaaatgtcaacagaatgtatgactaacacgccgattttttaggggtaatcatccgctgtttatacttcagcggcgcacagcccattacatcattgaaacacttaataaaataggtgacatggttaaaaccactttgcgtggcgatgtctgccacagaaagagtagagtgttccagtaattcacaggcatgtttgatgcggcgaatgataatatattcctgaatggtgccgccggtttccttacgaaatgtcctggacgcataactccctgagacattcaggctggccgccatattttcgaggctgattttatgcgcataattcacctcgatataattcatgattttcgatgaaagtaccccgctgttccctgccctgacataaacgccgctggagagaaaacccagaatatttaacagcagcagcgccatgagttcggttttactgcccgcttcatgataactttcccagaaggtttgcagcattcctgcaaatttatccgccgcgcctgaaagatcgtaaatcgatacccgcgctccggcgtcggctatctgtaaaaataattgatgccgctgggaaaaagggcgcagatagccgctcatcatcgccgcatcgacatgaataatagtgcggcgataacggttagtatcggaattctccaccataaccttgtggattttaccctgcggaaaaacaaaaagccgccctgctctggcggtgaatttctgattgtccaccaccacaatacccaccccgctttcgatgtaaagcagctccaggcactgatgccagtggtaatagttcacgctcctgccgctgcttcttttgaattccgctgagaagtcatcaaggctgatgcgatctaacagggcctgatcggtcataggctaaggtcaagatagttaaatttcgcttcagcatagttaaaaatattcgctgaaaatagccgtattatcctgtctgcttccctccatgttttcttttgtgatcttgctaacgcttcgcagtgctgatcccccctattttcgtcgtcatcgaatacagagtgaaactttgtttcagttacgcaagcgagcaaaagaatatgttcttttcagacaataaatcgactcagatacaaacacgccgcgaaactaaatcgtgttttaacaccttatttgctgccgtctggcagcagcgcaatgatgattacgcgggtattttaaccggtaatcgcattcctctttacggcgaaaaaaccgcggcgatggaaaccttcagccgcctgctgtggggaatatttcccctgttagcgcagggagaagttaagcacgacatcaccgcggaaattattcgtcgtatggccgagggtaccgacccctcgcacccgcattattggggtgacgtgggggactttgaccagttgagcgttgaaatggcggtgtttggcgcaggcctggcgctggcaggtaaacaactgcgggatcagatgcgcgatgaggagtggcaacggctgatcgactggctgcggcaattacgccatgcaaaaattccggcgaataactggtcgttttttcccgtcatgatcgaaatgggtttttgcctgtgcggtgagtcctggtcgatggacattattcagcagcacttttcccgcctggacagcttttactgtggcgatggctggtacagcgacggccttaatcgaccccgcgattattataatgcgatggcgctgcatttttacggcctgatctattcccgtctgatgggcgattatgatccgcagcgctgcgccctgctgcgtgaacgcgccgatcgcttcgcccgcgattttatctgtttttttaatcacgacggcgcggccatcgcttttggccgcagtatgacctatcgctttgcacaggccgctttctggagcgccgccgcgtttgccgggttaagcacttttccgcctggcgtgctgaaaggcctggtgttacgtcatctcaacgactggctgcaacgggacattctcgacgcgcgcggcgtgctcaccgtcggatatggctacgccagcgatctcattgccgaagaatacaacgcgcccggctcgccgtactgggcctgtaagctgtttctggtgctggctcttaatgacgatcaccccttctggtccagcgatgcgcagccgttgcctgcgcgcgaaccgcgccgcgccttaccccatgccggacaaatcattattgacgacgccgttgccggacatcattacctgcttaatggcggccagtggccagggaaaaattacgccaacagcgaaagcaaatacagcaaatttgcctgctcgtcgctgctgggatttaacctggaacgcagccgttacggtatcgaactcaacgcctgcgattccatgctgctgctctcggagcacgacgggtattaccgcgggcgtcgcaccagcgaactgaaaacctgcacggaaaacgaactgcattttgtctggtcgccgtggccggatgtcactatccatagctggctgctgccgctcgcgtcaggccatctgcgtctgcatgtggtcaataccgcgcgatcgctgcacagcgtggaaggcggctttccggtgccgatcaccggcgatccgcagcgttcgtttgatgcctgcgccggaacctgcgtcagcccgcaacacggttttttctcgcgcatggtggatctgtcaccggcgctggtgcgcccctgtagcctgatcgtcagcccgcctgccagcaatattctttacccctgctgtagtgccgttccggttctgcaacaggatctcgcgcccggcgagcatattttgtgttgttttgtgcacgccgggaccaccccgcctgatgaggttgcgctgccggaaattatccgtcagccgcagcatattcaggtggtgcttcacccccatgtttatgacatccccttgccctgtaccgtcactgtggagtaggaaatgaacaccacccatcgtattgattatataaagatcagcgcctttatttttttgtattttgttatctggactatgagcttcagcttatattccatctggcttggtcagcatgccgatttaaccagcgcggaaatcggcgcggtattcgcggtgaacggtgcattcgccgtggtaatgaaaccggtttatggttttattaccgataaactgggaatgaaaaaatatctgctttattttgtggcgatcatgtcgtcgctgctgatgccgtttttcgtctatgtttatcacccgttactgagcagccatttttcgctcggcgtggtggcgggcgcgctctatcttagccttgcgtggtacgccgggatcgccgcctctgaatcctattgcgatcgctttggccgcttaaaaggctttgaatttggccgcatcagaatgtggggatcctgtggcgcagcggttaccgcttcgtttgcggggatcttatttaatattttgccgaccattaactttaccatcagcagcatcacctcgcttatcatgctggcgctgctggtgagcattaaaattccggcctccgataatcaggaaaacgccgtggtgccggagaagaaaatcagcctgccggacgtgcgacgcctgctgaaagatggcaagttctggcgcttctgtttttatgttgccggtattttctggatcatgcatatcgccgaacaacagttcccgcgctactttatttccttctttcatggcgataattccggcacctcctggtacggctacctcagtaccgtgcaggctatcgtcgagtttatttcaatgctcaccatgccctgggtggtgaataaacttggcgcacgcaaagcgctaatatttgccggtctggttatcggcctgcggctggtcgtttccggtttcgccaccggtccgttaatgatcgcctttattaaaccattatatggtctggaaaacgccctgctgttaatcgcggtgttcaaatatatcgccaatcacttcgataaaaaggtcaatgccaccatgtacctgattggctaccagtgcaccatgtatgtcggcaccatatttgtctcggcgccagtgggttatctgtatgaccatattggtttcggcaatacctatttcattatgggcggcatcgtgatcctctttgccctgctctccatctttgtgctctctgataacgatgagcggctggcgcttgccagtaatactaaaccttccgtctcgtaaggacttactgccacatgaatatgcatcaaaacagcctgaaagataaaccgctgaatagcgatctcaatgcgatacgggtcagcatgacccaaaagctgaagtatcaactgacaggttttgcaggacgctatcccgcggcgtgcagtattaacagcgcttacccgacaacgcccaataccgactggacgacgggtttctggagcggtatgacctggctggcgtggcagatgacggaagatgattttttcctccgccagctgcaacaacaattacccggttatgcagaacgcctggataatcaacatgatattgaaacgcacgatctggggttcttattcagcctgtcctgcgtaaacgcctggcgcagcaccggggatgaaaatgcccgcacccaggcgctgcgggcggcggatttactgattgcccgctatcaccctcatgcgcagattattcaggcatggggcgatttagcggatccgcaccagcagggccgcatgattatcgattgtctgatgaatttaccgctgctgtactgggcttcagagcaaaccggcgaccgccgctatgcgcagatcgcccgtcagcacgcctgccaggcgcagaaatatctgctgcgggaagacagctccacctatcacaccttttatatggatgtggaaacaggcgaaccgctaaaaggcaccacgcatcagggttatgccgatcattcgtgctgggcgcgcggccaggcgtgggcgatctatggttttaccctcagctggcactacaccggagaaaaacaattccttgaggctgcgaccgcaacggcacgttattttttgcggcatctgcctggcgatgccatctgttactgggatttgagcctcagcgcacccggaaccgcgcgggatagttcagcggcggccattgcagtttgtggtttactggcgctggcggattcgctgtccgtgcttgatcccgaacgcgggaacttcatacagagtgcgctgacgatcatgaatgaactgtgcgtgaattattacgatccggcattaacggacggcggttatttaaagcatgcggtttacaatatgaataaatcgcgcggcgttgatgaatattgtctgtggggcgattattttttctttgaggcaatttcgcgcctgcattcgccgttagcaaaatactggtaatcatatttatctaaaaaaatatcagctttgctgagaatatcttatctctgtcaaaaggtttgttatgaataaaaatatactgcttctggctattgcgctgcccgcctttagccatgccggcggctatcttgaagtacgcgaagcctgggaaagcgcgtcggaagaacaccagtttaaactgggtgcgggctataattttgataacggcgcggggctactgttccagacggtttataatacgggtgagctcaatcagcttaagcacagcttcgatgaaatagagggctggtacccgctgtggaaaattaccgataaactcacgctcagtcccggcggtattattaactcgactaatgccggttccaccacctcgccttatgtgcaactgggttacagcattaatccggatctggccgccgcgtttaaataccgctttaaccatatgaactaccggacccgcagcctggatcgggaaatggaatataatgataatcatcagctggtaatggtggtgaattataaaatcagtgaggtgctgagttatgaatttgaaccggatctctatatcaatacgcagaactacaaccgtaaaaacggcaaagatcatagctgggagctgaaccataaattcagctggaaaatgacccgcaactggcgtccgtttgtgcagctgtcctggctggatcgggataccggtaatcatgcggagcgttaccgcatccgtcttgggatgcgctattacttctgaggtgctgcaatcccccgccacaggcttacgggcgggggatcagggcgttatttcccgctgacgctaacgtcaatgcccgggaaatatttcgcggcaagacgggtgatggtgccgtcggcgcgcactttatcaatggccgcgtccagctgttttttcgtcgcctcatcgcctttacgcagcccaaaaccaataccgctgcccagaatggtgtcgtccgataccggcttgccgataaagccaaagcctttgccctgcggcttgctgaggaaaccggcctgtccggcagcggacatcaccagcgaggcatcgatgcggccattgagcagatccgcccacgccagattttgatctttataagaaaccacggtcacgccctgtttttcccagtgctctttggcgtaggtttcctgaatggagccctgcaatacacctactgatttacctttcagtccctccggcgtggcttccataccgctgtccgctttacccaccagctgcgacgggatacggtagatcggctgggtaaaatcaatactctgacggcgctgttcagtaatgttcatcgccgagttaatggcgtcatattttttcgccaccagtcccgggatcagggcatcgaaagaggtttccacccagctgcatttcagcgccgccgctttgcagatggcattgccgaggtcaatatcaaacccttccagttcgccgctggcgttgcgactttcaaagggcggatattccgcttccagcccgtaacgcagctcggcggccgcaaaggacgacagcgagcagagcatacccattcccagacagagtgctttcagtttcatcaatgacgctccttagcgtggcttaacccgacacagggcctgcgcccctgcccgtaatgttgcctcgtctttcgcaaaagagaggcggatcagtttgttatccgtgccatcggtataaaacgccgacagcggaatggtggcaacgccgcattcgacgatcagccgtttcaccagctcgctgtcgctttcgtcgctgaacgcgctgtaatccgccagcaggaagaacgacccggcgcccggcaggacgcgaaacggcgagtcttccagcagcgattgcagcatatcgcgcttacgctgataaaatgccgccagcgaaagccaggtttgcggatcgttcatatgttcggcaaaggcgtactgcatcggcgtatcggcagagaacatcataaactgatgcactttgacgatctcatccatcagcgcggcgggagcgatacagtaaccaacgcgccagccggtgacgtgataggttttgccgaacgaggagataatcacgctgcgctccgccagctgcgggtgcgtcgccatgccgtgatgctgctccccgtcaaagaccacgtgttcgtacacttcatccgacaggatcacaatatcggtattgcgcgtcaggcgcaccagttgctcaatatcgtgacgggaaaagacctgtccgctgggattatggggcgtgttgacgatgatcatccgcgtgcgcggcgtgatagcggcgctgacctcttcccagtcgacggcaaactccggcaccgtcagcttgattgccactggcgttgcgccctgtaaacgcacaatgggcgcgtagctgtcgaaggatggctcaaagtagatcacttcatcgcccggatgcaccagcccgctgatggccgagtacagtccttcgctggcgctggcggtaatcagcacttcgtcatccacgtcataccgggtaccatatagatcctgcaccttttcaacgatgcgctctttcagcggacgcaggccggtcatggcggcgtactgattatgtccggcctccatggcacgggtgacgcccgcgatcagcccggcatcacacataaaattgggcgcgccctgagaaaggttaatggcgttatgttcagcggagagctgaccaatgacggtaaaaatggtggtgcccacatcgggaagttttgagcgggtctgcaccggcgtacgcaaagtcattttcgttcctttctcagcaaaattgcataaccattcaaaccaaaagtcgattgaggcgacaaccgaattgttgtcataatagccatgacaaaaatgcatacccggagacaccatgctgcgtcgttccctgccccttaacgctattgacgcctttcttgtgaccgcccggcatctgaatctgacccacgccgcaaaagagctgtgcctgacccagggcgcggtgagccgcaaaatcgccgcgctggagcagtggtttggctttccgctgttcgaacgtcacgccagaggcttgcgcctgacgccccagggcagcgccctgctgccggagttacaggcggcgtttgaacatctggcgtcggtggccgagcaggcgcgccagcagcagacggtggtgcggctgaaagcgcccacctgcgccatgcgctggctggtgccacggttattaaggctggagcgggaaaacccggatttgcaggtgtcgctgaccaccaccagcgatcacacggtcaatttcaaaaccgaaccttatgacgcggccatcgtgtttggcacacagctgagcgcgggcgatctgttgtttgaagaagcactgacgccggtgatcggcgcgcaaggtgatgagcacagcgcgccggagcagatgacctttctgcacccgacgcgggataaaaccgactggacattgtggctggcgggccagacgcagatcgccccggtcatgaaaaaaaatcaacacttcgacaccatggatctggcgatcagcgcggcgatccagggctttggcatcgccatcgccgatgaaactttggtggccgaagatctgcgtgccgggcgactgcgccgcccgttcagccacagcgtgaaaaccggcgcctgttaccggctggtactgcgggagtcgccggataaagccgccgggctggccatcttccgcgatattctgctggcggctaatccatgctgattaaagcagtcctttctgtttaaaggtaatgcgggtggcctcgttcagatccaacgctttcagcgcgtccgccgacacccacatcacttcctcaaattcttcattaaaggtgatgtcgcggttggcggttatgcagtcgaagatcaggtagatcatgtaaatctcttcagtggtgccatccgggtaggttttggttcgcacatcatcccaaaacgtccagggctgaatatccgtaatatcgagacgctctcctaactcttccctgatttcacgcctgagcgcgatttccatcgtttccccaggctccatgccgccgcccggtaatgcccattgtccgggaaaaacaccacgatcggcggccatcttacacagcagatactctccgttattctggatcaccggacaaacaatcactcgctggcgcattttatctccttaatatcaatgccttctgaaacattttatcagaagccccttcccattaatgggaccagacgccaatcttacgcaatgcccttttgatcgctaatccagactaacgtgctggtgcatcacccgtttaaacagctccatccgcgcccgcataaagcggttgaccagcttaaacccggcatacttattcagaccgatacgtaacaggcggtctttacctcgtacgctggcctgccagcgcaccgggccgtgcagcgcagtgcagctgaggctggcgtgacgggcgaaattaacccagtaatccgccacttgtccggcgactttcagatcgctttctgtgacatagtcgcaggacggtgaaatctcgccgagggtgtcgaacacatagggcacatcgttgccatgccaggccccgtggggataggtttcatgctcggcctccgccacataatcaaaccagtagcgccagcagggctggccgatgcgctgctgcgcctgcatcaccacaaatcccatggtggtgaatgccatatcgcggcacacctggcggcccagctcggtatcgcctttaacgccgggatagagcaacttaataagcccgagaccgaagcggcgctgacggcgcagcttctggatctcccccgccagatcgacgccgaataccgacatgacgctcgcctcgtcgctgttggagccgatcattaccggcatcggatgctggcgggcgttgaaaaagcattcaatcatcggctgcggcagcacggcatcgccgacaatcggcacaggcgcaacattgtgcggcgcggccagcggccacagatcttccgccggaatggcgcgcagctgttccggcgtggcgtccggcagccccagatgctccgccagcgctttgcctttcgccagcgccgtacgccgcggcgtatcgggcagcgcatagccgctctgaataatggctttatggaacagatcttttgccagcggcgacaccatcagcgataacgcgctgcgcgctccggccgattcgccaaacagcgtgacgttttccgcatcgccgccgaaggcgtgaatattctctttcacccagcgcagcgcggcgatctgatcgagcaatgcaaagttatacacccgctcgcccgcttcctcttccagcgccggatgcgcaaagaagcccagatgcccgaggcggtaattaagggtgacaaccaccacatcgcgtcgtgccagcccgctgccgttatagggcggcagaccgcccgcgcctatggtgaagcctccgccgtgcagccagaccatgaccggcagcggttcacgacgcaccgctggggaccagatattgagatacagacagtcttccgagaactcgcccggatcgccgccgcccagcgcgcggcagtattcactgctctgccagctggagggcgaataggtgtcggcgacgcgtggggttgaccaggcggtcaacggctgcggcgcacgccagcggcggtcacccaccggcggcgcagcataagggatgccccgccagacgtgcagtccgttttcctcgaggccaataaccgttccctggcgggtttccgccagcggggtggagggattttccataagcgcattcctcttgctgttcagtccatcagcgtagcgggtttacagcagaccgcaacgctgtttactgcgatcctccgccgcctgatagagactgaactcatccagcaccgcgcagccgagcgcctgctcgaaggcttcgcggctggcgttaccctggcggcgctgccgggtttcattgcccagattagactggaaaatccctgccgcgctgaccggcagaaagtcttcataaatgatgggctgcgcggtgacccagccgcgttcaatcagcggctgcggatcgtcgccggggcggatagcctggcggtgcgcctcgccggtcggcgtcaggcggtagcggaaataggccagcccctggcggcgcagcagcaactcactgtccggaaaggctttaaacaccgcctggagatgcaactggtgattgaggttgtctttgccggtgcccgcctcgctcagcagacgatcataaagcgcgcggcctttcggcgtcagcgccacgccgcgctgttcgatttcgccaaagcgtgccgtatgcgtcccctgctcctccccggcaaaccgcaccggctcttccagcgctttgaaactggtctgacgcagcagcagcggcacttcacgacgcggcgggccttcaatcagaactttgggttcgataccatattcaggcatcagcgactgcacatgatcgatatccagtgtgcgcggcgttaaatggttgatatgacaacccggaaagcacaccacatccgcaatcagccggtgctcactgtgcagcgcatgataggtggcgtgatcaacggtggcatgctggtgccagcgaaaggtttccagcgcctcgcgcacaaattcgcgggcttcggcggcggtgaactctccctgctgttcatgccgttcgatgagcgccaggcagcgcggggtaaagatattccgggcggcgaggatcgctgccgaacgctcgcgcagatcgggattttcgatcagatcgaggcgcaggagcgaggtaaagacgcgaaagggatttttcagcaacgccgcgtcgtcaatgggacgaaaagccgtggaatgtaccggcacgccagcctgcgagagatcgtaatagctcaccggatacatacccataatggcaaacatacgccgcaacgtcgccagctctgacgctctgccgacgcggatcgcgccgtgccgttcgacattcagacgcgccagctcatcggcattcgccagctgttcatgcaggcgcggattctgctccagtaccgccaggtttacatcggccaccagttccagcagcgtgccgtattgcggaacttcttgctgatacatcgtcgacatggcctgcgaaaagtcttcccgaatgtcatctgccgtgatgttgcttgccatattgtcatgcctctggttgatatatctggagtgtagagaaggcagccgggccgcgcgggaagaatttagaaagtgtgatcctgaccagcccccgcctcgtccgcgagtccgcttgcataacaaaacattatgttcagcctcctccccattgctgaccgccagacggcgtgcgtacccgctttgcgcaataagcagttgtaagtcaaatagattaaatgttaataatattttgctagcaggttatcaatattcaacaacttctcttgtcagcgggtacgctctgtttttaacattacttatggaaaaaaatggtctgttcagtcagcgcatccgtctgcgccatctacatacatttgtcgccgtcgctcaacagggtaccctggggcgtgcggctgaaacccttaacctgagtcagccggcgttatcaaaaacgctcaatgaactggagcaactgaccggcacccggctgttcgatcgcggacgcatgggcgcgcagctgacgctggtcggcgaacaatttctcagccacgcggtgcgcgtactggaagcggtgaactccgccgggcaatccctgacccgtaaagaaggcgtgaaaacggacgtggtgcgcatcggcgcgctgcctacagccgcgctgggcattctgccgacggtgatcggggaatttcatccgcatctgccggacattaccattcaggtcggcaccatgaataacccgatgttgctggcgggcttaaaaaccggcgagctggacatcggcatcgggcgcatgtccgatccggagctgatgagcgggctgaactacgaactgctgttccttgaatccctgaaactggtggtgcgtccgcgtcatccgctgttgcaggataccgtgaccttaagccgcgtgctttcctggccggtggtggtcgcgccggagggtaccgcgccgcgtcagcatactgaagcgctgctcgccacccagggttgcacgctgcccaccggctgcatcgaaacgctatccgcctctctctcgcgtcagttaacgatagaatatgactacgtgtggtttgtgccatccggcgcggtgaaagacgatcttcgccagggcgcgctggttgccctgccggtgccgacgcacggcgcgggcgaacccattggtatcattacccgcattgacgccccgctttctgccggtgcgcaaacgctgctcagcgccattcgcaaatcgatgccggagtaaatccggcgttcttcctgttgcgcaatttatgaatttttcgttaattgtgtgataataaagttgttgattaagggttgctgttacgcacattacactcattcatcagcaacccgctgtcaggaagaaccgatgaaattcaaaaccgccataaaaccctaccacgctgctgccggtggtctgggctctctggaagcgaccacccgcttcgtgattgacagcaaaaatgccctcagcaatatgcgcaacctgctgcgtatgaacaaagcccgcggttttgactgtcccggctgcgcctggggcgatgacaataaaagtaccttcagtttctgcgaaaacggtgccaaagccgtgacctgggaggcgacgcgccgtgaagtggacgcccagttttttgcgcaacatagtgtcagcgccctgaacgcgcagagcgactattttctggaataccagggccgcctgaccgaaccgctgagctataacccgcagagcgatcgctatgagccgataagctgggcagatgcatatgcattaattgcgcaacatctgcatgccatggttcatcccaatcagctggaactttacacctccggacgcgccagcaatgaggcgtcttacctctatcagctgtttggccgtatgctcggcaccaataattttcctgactgttccaatatgtgtcacgaagccagcggcgcagggttaaaacgcagcatcggcgtgggcaaagggaccattcatctggatgattttgcccacgcgaacgccattttcgtcttcgggcaaaaccccggcaccaatcatccgcgtatgctgcacagcctgcgccacgccgccgatcacggtgcgcaaatcgtcaccttcaataccctgcgcgagcgcgggctggaacgctttgcggatccgcaaaaaccgctggagctggtgacgccaaaagcaggcaccatcagctccgcctactatcagccgaacctcggcggggatatggcggcggtacgcggtatggcgaaagcgctgctggagacgcaacgccagcgtcttaccgacggccagccgggcatttttgacgaaacctttattaatcagcatacccacggcattgatgcctggtttgcgcaaatcgatgccacgtcctgggacgccattacgcaacagtcaggccttacggaacagcagctgcgtgacgccgccgccgtgtggcagcacgccgagcgggtgatctgcacctgggcgatgggcatcacccagcataaacactcgctggacacggtgcgggagattgccaacctgcaattgctgggcggccatctcggcaagcccggcgcgggactctgcccggtacgcgggcacagtaacgtgcagggtaaccgcaccatggggatcgacgagaagccgcccgctgcgctgctcgacagtctggggcgtcactttgattttgagccgccgcgcgagccgggtcatcatacggttgaagccatcgaagccatgttgcgggacgaggtgaaagtgctgatcgccctcggcggcaacctggcggctgcggcgccggacacgccccgcgttcacgacgcgctgcgccgctgcgggctgacggtttatatcagcaccaagcttaaccgcagtcatctgatgccgggtaaagcctcgctgatcctgccaacgctgggccgcacggaagaagatatgcaggccagcggccgccagtttgtcaccgtggaagactctttcagcatggtgcacgcctctgaaggtatcggcaaaccgctcagcgcgctgcaacgttcggaaacggcgattgtggcgaacatcgcccacgctacgctcggggatgagaagctgaactggctggcgctggcggatgattattcgctgatccgcgatcacatcgccgccaccctgccgggctttgaaaactttaacgcccgctgcgatgaacccggcggtttctggctgggcaatgccgccgccgcgctgaatttcactacgccgtctggcaaagcggaattcagcgccgcgccgctgcccgcctccatctgcccggatgtggagtccccttttgtgctgcaaacactgcgttcgcacgaccagtacaacaccaccatttacgggctggacgatcgttaccgcggcgtgtacggccaacgtgatgtgctctttatgcatccggacgatatcgccgcgctggggctaagcgatggcgatcgggtggacattaccaccgcctcccgcgacggcatcctgcgtcaggtggagaatttccgcctggtttcttatgacattccgcgcggtaatctggcggcctattacccggaaaccaatccgctggtgccgctgaccagttttggtgacggcaccggcacgccgacctcgaaatcgatcccggtgtcggtgacgccggcgcagacgcgaccatcgttgcgtattgcctgatcttcctgccttgcccggcggcgcgcgcttgccgggcctacgttatttgttctccccccttcgttcccaaataatgctgattttatttttaacaattgcgtaaaacaatttaacagttttatcatgttgccagttcaccagatggttcattaacttattatctggtgggtaaagaccccatctttacgctaaatttaaagttttatttatccgtctggttcgcaataaccagcggattggtgtgttcaggagaacttatggcaacaagcaacaggccgcgcgggatggttcgtatcctgcagtggttacttgccgggctgatgatccttatcggtctggcgataggtattcccggtattaagctcgtctcccttggcggcagcgcttactttctggtgatgggcgtggtgatgctcattgccgccgtgttgattatccgcacgcgcagcagcgggatcctgctgtatgcgctggcatttatcgcctccattatctgggcgattagcgatgcaggctgggaattctggccgctgttttcacggctcttcaccttcggcgtgctggcgtttctggccgctattctctggcctttcctgcgcgccacgcagacggcgcagccgatcaataaaaaaccggcctttggcgtggcggcggtgctggcgctggtgctgctggtcagcgcgggctggatgtttaaaccgcaaacgctggtcagtgcaaatgaagatgtcccggtgcagcctgttgcccccggtcagcagcagaaagactggaagcactggggtaacaccacccacggcgaccgcttcgccgcgctggatcaaatcaacaagcataatgttaacgacctgaaagtggcctgggttgcccataccggcgatattccgcagagcaacggctccggcgcggaagatcaaaacacgccgctacagattggcgacacgctgttcgtctgtacgccttacagtaaagtgctggcgctggacgtggacaccggtaaagaaaaatggcgttacgacagtaaagccaccgcgcctaactggcagcgctgccgtggtttaggctattacgaagagacgcaggcgcagagcgcaccggcgcaaagcccgcaggtcgcggcctgcccgcgtcgtctgttcctgccgaccaccgatgcgcgtctggtggcgatcaacgccgataacggccaactttgtgatgattttggcgatcatggcgtggtggatctgagcatcggcatgggcgagatcaaaccaggctattaccagcaaacctccacgccactggtggcaggggatgtggtggtcgtcggtgggcgcgtggcggataacttctccaccggtgaaccgccgggcgtagtgcgcgcgtatgatgtgcacagcgggaaactggcctgggcctgggatccgggcaatccggcgctgaccggcctgccgccggaaggccagacctatacgcgcggtacgccgaacgtctggtcggcgatgtcctatgacgcgaaactgaacctgatctatctgccgaccggcaacgccaccccggacttctgggcgggtcagcgtacggaactggacgataagtacagctcgtcaatcgtggcggtagacgccgccaccggtcaggtgcgctggcattatcagaccacccaccacgatctgtgggactttgacctgccgtcacagccgctgctgtacgatctgccggacggtaaaggcggctccaccccggtgctggtgcagaccagcaaacagggcatgatctttatgctcaaccgtgaaaccggcgagccggtggcgaaagtggaagagcgtccggtgcctgcggggaacgttgagggtgaacgttactccccgacgcagccctattccgttggcatgccgatgatcggcaatcagacgttgaccgaatccgatatgtggggcgccacgcctgtcgatctgctgctgtgccgtatcgaatttaaggcgatgcgtcatcagggcgtctttaccccgccgggtctggatcgctcgctgcaattccccggctcgctgggcggcatgaactggggcagcgtgtccgtcgatcccaacaatagcctgatgtttgtcaacgacatgcgtctgggactggcgaactacatggtgccgcgcgctaatgtggcgaaaaacgccagcgggattgaaatggggattgtgccgatggacggtacgccgttcggcgcgatgcgcgaacgtttcctgtcgccgctgggcattccgtgtcagaaaccgccgttcggtactatgtcagcggtggatctgaagtccggcaagctggtgtggcaggttccggtgggtaccgtgcaggataccggtccgctgggtattcgtatgcacctgccgatcccgattggtatgccgacgctgggcgcttcgctggccacgcaatctggcctgctgttcttcgcggggacgcaggatttttatctgcgcgcctttgatacggcgaccgggaaagaaatctggaaggatcgtctgccggttggcagccagtccggcccgatgacttatgtgtcaccgaaaaccggtaagcagtacatcgtgattaatgcgggcggcgctcgtcagtcgccggatcgcggtgattatattattgcctacgcattgccgtaaatcgttgcccctcatcctaaccctcccctcagggagagggccggggtgaggggaaattcaacctgtcagaaggtttcccagttatcgttattcgccatcgccgggcgcgttgtcgccagcggggctttgggagccgctttctcagtacgaaccggtgcggccttttgcagacggaatgcgcctaccgcctgagtcagacgcgcggcctgctcttccagcgaggcagcagcggccgaggcttcttccaccagcgaggcgttctgctgggtgacgttatccatttcagtgatcgcctggcttacctgctcgatccctttgctctgctcatccgaagcggcagcaatttccagcataatatcggtcacacgtttaaccgcgtccacaatatcgcccatggtgtcaccggcggcgaccacttcgtttgaaccacgttcaatcagggatacggattcactgatcaacccctcgatctctttagcggcgttcgcactgcggcttgccagggtgcgcacttcgcttgccactaccgcaaaaccacgcccctgctcacccgcacgggcagcttcaacggcggcgttaagcgccagaatattggtctggaaggcgatactgttgatcaccgcggtaatttcagaaattttcttcgagctgctggagatattgcccatggttttcaccacgccggagacaatctgcccgcccttgctggctttaccggaagcgtcaccggccagtttactggcgtgatgcgcgttgtcggcattctgtttcacggtggcggtgagctgctccatgctggcagccgtctgctcgatggccgcagcctgctgttccgtgcgcgaggagagatcggtgttgcccatggagatctcgctggtgccgcgataaatctcttctgccccctcccgcacggtgcccacggtctgcaccagcgagtgctgcattttttgcagatcgcgggtcagcaagccaatctcgctgcgaccggttggttcgtcggccagcgtcagatcgcctgcggcaatgtgctcaatgcgatttgcggcgcgttgcagcggctggatcaccgtacggcgcagcaccacaaaggtaatgagtgtcaggatcagcgcgatgacaaaggccgcgcccataaacatcaggccgagctgcgtacgctggtgcgccagatcgctcagcgccgcggcgcgttcggtacggatcttgatcgccttcatgagcacgtcgttataatcgctgtccagctgacgggcgtgttcgttttcgtggttgataatggcttcaaacatgccgtttttggcatatttcagcatcggttgcaggccattgatataggcgttgtagcgggtggtgagttcgccgtccagcgcttcgtcggcggaggtttttacgccgcgattctgatagacggcaaagccttcctgcgactgcttaatgcgcttttccgcttcctggatgttggctttcatatcatccatttccgcaatgcggctggccgcgccggcatggatcatattgatacgcgctgtgcgtaagtggttggagctgttcgataatcccatgcgtatctgaatttcttcagtgacgtcgcgctgatcgccatcagcctgaatcagaaaatatcccgccagccctgcactcaatgcaaacagcaccaggatgccgctgagaattgaagaaaacagaggaactaaccgtatgtgatgtaaaaaacctacggtttgcggtttgtgcatcgctgctgtgttgtccatgctatcgactctcttataggaaggtgcgtcatacacgcctgtaaaatagtcatcggcaatccgggaatttcccttatgcctaaaagcgctagctggctcacagattcaaacaataccccctaaagaaatcctgaaggggtaaattgccggcggcagaccgccggctgtggcattagttatcgccgaaatggataacggtacggatagatttaccttcgtgcatcaggtcaaaggcttcattgatctgatccagaggtaaacggtgggtgatgaaaggatcgagctggattttgccgctcatcgcgtcttccaccatgcccggcaactgggtacggcctttgacgccgccaaaggcggagccgcgccatacgcgcccggtgaccagctggaacggacgggttttgatttcctggcccgcaccggccacgccgatgatcacgctctcgccccagcccttatggcagcactccagcgcagcacgcattacgtcgacgttaccgatacattcgaagctgaaatcgacgccgccgtcggtcatttcaacaatgacttcctgaaccggcttatcgtaatctttcgggttaacgaaatcggtcgcgcccatttcacgcgccagcttgaatttctccggattagtatccaccgccagaatgcgcccggctttcgcctggaccgcgccctggatcaccgccagaccaataccgcccagaccgaacaccgcaacggtatcgccctcttttactttagcggtgttatgtaccgcgccgataccggtggtcacgccgcagccaagcagacaaactttatccagcggggcttccgggttcactttcgccagggaaatttccgccactacggtgtattcgctgaacgtactggtgcccatgtagtgatagatcggctcgccgttgtaagagaaacgggtggtgccgtccggcatcaggcctttgccctgagtggcgcgtactgcctgacagaggttggttttgccggatttacagaacttacattcacgacattcagcggtgtaaagcgggatcacatgatcgcccggttgcaggctggtgacgccttcacccacttccaccactacgccgccgccttcatgaccgagcaccgccgggaatacgccttccggatcgtcccccgacagggtaaacgcatccgtgtgacacacgccggtatgagtgattttaaccagcacttcgccctttttcggcggcgcaacgtcaatctcaacaattttcaggggctggcctggcccgaatgctactgcagcacgtgatttcatagtgtctctccccttctgttctttgaacggtaatgattattttagataagagcgcaaaagatgaccgacttcggccatccgggctgcacgttgatccggtgaagtgtcaccgctgaccagctcatctttgaggtgaatttcgaccatctcgcccatcaggccattagccgcaccgcgaacggcggcgatttgctgcaaaatggcaatacatggttcgcctgcgtccagcgcacgctccagcgcctcaacctgcccgcgaatgcgacgcacgcgggttaatacgcgttttttgtcttcgggtgaatgcggcatacattctccttcttatactgtaggggggtatagtaaacagttaagggtgttcatgtaaacaagaaatctgaatgaaaaaacccgccgaagcgggttttagtcagtatcaatttgcgctattgcggttttacccgattgccggaggcatcgatcactgtttcgccgtcttctttcgtgaaagcgcctttctgaggcgccggaagaatatccagcaccacctcagaggggcggcacagccgggtacccaggggggttacgacgatgggacggttgattagcagaggatgctggagcataaatccgattaactcctcatcgctaaaactggcatccgcaagaccaagctgctcataaggctcgacgttcttgcgtatcagctcccgtacagaaattcccatatcgttaatgagttttaccagctcatcgtgcgacgggggggtatcaagataataaatgatgtcaggctcatggccgctgttacggatcatctccagcgtattgcgcgacgtgccgcaagctggattgtgatagagggaaatgttgctcatagtgttatctcattacaatgtgaaagagagacgcaacgccagcgcggccagagtgacaaacagcactggcagggtcatgatgataccggtgcggaagtagtagccccaggtgatggtcatatttttctgtgccagaacatgcagccacagcagcgtcgccagactgccgatcggggtgatttttggccctaaatcgcagccaatcacattggcataaatcatcgcctctttaatcacaccgctcgccgcgctgccatcaatcgacagcgcgccgatcagcaccgttggcatattattcatgatcgacgacagaaaagcagtcaggaaacccgtgccaaatgtggctgcccataagcccctcactgccagtatattcagcacgcccgacaaatattcggtgagtcccgcatttcgcagaccataaaccaccagatacatgcccagagaaaatatgacgatctgccagggcgcaccgcgcagcacttttacggtatctatagaatgtcctcttttcgccacgacaaagaggactaccgcccccatcgccgcaatcgcgctgaccgggatacccagtggctccagaacgaagaaacccaccagaagcagcagcaaaacaatccagcccgccctgaaggtcgcgggatctttaatagcgctgtcgggtgttttcagcagcgaaacgtcataggttgccggaatatccttgcggaaaaataagtgcagcatcaccagggtggcggcaatggccgccatatccacaggcaccatcaccgaggcgtattgcgtaaagcccagcctgaagaaatcagccgagacgatattaaccagattcgagacaatcaaaggcaagctggccgtgtcggcgataaaccccgcggccatgacaaaggccagggtggtgcctttgctgaatcccagcgcaagcagcatggctatcactattggcgtgagaatgagcgcggcaccgtcgttagcgaatagtgccgccaccgacgcgcccagcaagacgatccaggtaaacaatagccgcccccgtccgttgccccagcgggacacatgcagcgctgcccactcaaagaatccggattcatcaagcaacagactgataataatgacggcgataaatgccgctgtcgcgttccagacgatatcccagacgacgggaatatcatcgagctggatgacgccggttgccagcgccagcaccgcgccgatactagcgctccagccgatcctgaggcctctgggttgccagatgaccagtatcagcgtcagtaagaaaatacttcctgccagtaacatttaagactccattacatatgcataagtgaatgtgttttactgtttcagcaggaggtacaggcgaatttttgtagccattcacgcacatcctcccgcaggcattgccatgacgtggtaatggtctcggcggcccaggctggcatgtgaggtgataaacgatagtggatccacttaccctccctgcggtcaatgaccagccctgcctcgcgtaatatcgccatatgccgtgaaattttgggctgtgactcagaggtggcggcacaaatatcgcagacgcacagctccccggcctccctgagaagcatgatgatggagagccgtgtttcatctgagaggatcttgaacaactgaacgggaaccagcattacttgctccgatgccattagaatacacatatgttaaatcatatctgttagatttgaaataaacacatccccgcggacaagaaaagttgacggcgcttctgagcaaccgctacatcatccttataatgaaaaaacccgccgaagcgggttttaaatgcggatgcaatgagctgactaaacgccagaggtgtggcggggatcgctccccgccgtggctcttaacgtgtttcaacttcgtaggctaaatacgcggtaagctctgtgcttcctcttttgatatgcagctcgcatagcgtgccgcgcaccatccagacgaaaaccagaatggtgatacaaatcaccatcagacaatacacatagctcctgcgcatacaacctcctgattgatttctcacaattaagaggctaatcttctgttgtctaggcattggattggcctcattcgatttatagtcgagtggggcttttctcttctgcccggtgaactcaaagcagaaagcctcaagcacccgtcagccatactacgcagcagaatttaataaatcaaatcagtaatataaccattcatttgataaatagatctgcgcttaacactcccagcccagactttttcgtatcgcctgccgatacggcgtttcgaattcagtgggaaccctgcgcagataatcctgcgcatgttgccgcttttccccttccagcgtagccaggtagtccagcacttctttcacgcagggtacgcggccttcaagaccatgaatgcgtggcggcagcgccgtccagatcaccgcgtccagctgtttttcccttgcccattcagctaatggacctgcggacgtactgttaaacaccatcacgccgacgccatcactacgggagagcgggatttgctcgcgttcacgtagcgctgaaaccgcatcatgcagcgtttcggcattcagcatcgcccagaaaacatgggtcagcggcgcattcatgcacaccgcggtggccagttcgccgccatccccgacgcgggaaaattcgatgggtagtgctggtccatctttgaaccactcgctggccagcggcaatgcctctggcttccagattagcgatccccagccaagacatgcaattttcacgatcccatcccttcttatttttgtcgctacgctcaggtagttaagcttaggaggtgcatgagaaagtgccactcggttaccgcttcagcggcagccccgccgtttccttcgcgcgcatcaccgtcaggaaggtgatcagcgccgcgcccattacatagaacgccggggagaatggattaccggtagaggtaattaaccacaccgagaaccacggggtgatgccgccgaaaaaggccacggcaaagttataggcgatggagagcccgccgtagcgaatgcgggtcgggaagagttcggccatggccgcgctgcatgcgccgtcgaaggcagcgataaacgcgcccagcatcagcattgccagcacagccgacagcatattgccgttcgccatcaccatcatggccggatagctgaacaggatgaagccgccgcagcccgccagcatcagcggtttacgcccatatttatccgacagcagccccataaaaggcaccagtatggcgatgccaaacagcccgatagtggtgatggcgtaagcgtcgagttttgaaaaatgcatctgcgtggacagatagctcggcataaaggtctgcaacgtccagtgccctaccgccttgatcaccacaaagcccacgcaaaacagcagcgcgccccaggcggtttttaccgccgtacgcagcggcgcggcttcttttttaccgagctttgccatcgccagaaattccggcgagtcttcgagatgcttacgcagataaagcccgacccagcccagcggtccggcgatcaaaaacgggatccgccagccccagtcgttcatcgccccttcgcccaacagcgcggtcagcaggaacaccagcccggaacccgcgacaaaggccataaagccgaagttgtcgatccagcaggtaaagtagccgcgccgggcatcgggcgcatattccgccagaaaggtggtggcaccagagctttcgcccccggcggcgaagccctgcaccagacgggtgatcaccagcagcacagtggcggtaataccaatctgatgataagtgggcagtaaccccatcacaaaggtggcgcccgaggtgagcaaaatcaccgtggcgaggattttttgtctgccgacgcgatcgcccagcgaaccgaaatagagcccgcccagcggacgcataatgaatcccgcgccgaataccgcaaaagaagaaagcagcgccacggcgggatcgccggcctggaaaaactgcaagccgataattgccgcgagcgtaccgtacagcccaaaatcaaaccactcgacaaaatggccgacgccggtggcaagtaagactttgcgtaattttcgtgccgccacgctggtttccccggctggtgcacggtcaagcgactgctgaacaggctgagtcataccctctcctaatcacagtgtttctataatagatatactatctatacgctgtgccggagtttcgcccactacagccgttttaaaatgtgatgcataacgaacaaaaacggtgaaaaacccgtcaggatcacatttattaccgtgctgaatatataaagccccgccagtgcggggcctgtcgttgccggatcagcggcgtttttttggtaacatacgcagcagcgtattatctttccacacatagtgatgcatcagcgccgccgcggcgtgcaggccgataacataatagccgagggtcgccagcgtgacgtgataatccttgagcatatccaccagatcgaaatccgcttcggcggcgtgtggcatcactatgccgaaagcgatccagttgttgccgcggaaccacatcatcagcaggccgatgactggcagcgcgataaacagcaggtagatcaccagatgtcccagatgcgccatgccggtcagcatcgctctgggctttggcacaatagccggtgacggcgttttcaggcgcagcagcaaacgggtcaccatcagcaccagaatcgagatgccacaggaaacatggacgatattaaagtaaggtcggtaactgcgcggcgcgaagccgcgaaattccatggcgcaatacgcagtgacgaccaataaaaaaaccagccagtgaatggcaatctgccatcctgaataggtgctgcgcatgagactttcctgaaataaaacagtaagaaggcaaacataccgggctttttgcaaaaattcattaatttttcggttctgaatctgacgtgtaaaccataaaggagactggcttgaaaaccctcagtaatgcgtacctgttacaacttatggaagaggcgtcaagccgcgccacgaccttttccgtctggccgcagggtgaagcccccggcgcacagcaaagcccggtggcgtttcgcaccgaagagcagcataccgggccgtcggcttttgaccgttccgttaccggcgtgcgtgcgccgaccattacggtctatgctccggataaccctaacggcatcggtatcctggtgacgccgggcggctcctatcgccgcgtggtgctggataaggaaggcagcgcgctggccccgttctttaatgcgcgcggatacacgctgtttgtgatgacctatcgcctgccgggggacggccacgcggaaggcgcggatgcgccgctggcagacgtgcaacgggcgatgcgcctgctgcgcgcccgtgcggcagagtggcatctggatgcggataaactcggcgtgatgggcttttcagcgggcggacatgccgccgccagccttggcatccgctatgacgaagcggtgtacgcgccggtggatgacgtcgatgcgttaaacgcccgcccggcctttatggcgctggtctatccggtgatcaccatgcatgcggatattgatcatcccggctcgcgttttgagctgatcggcgatgcgccgacggaggcgcaaattacgcactactccccggaagatcgcgtcggtgtgaatacgccgccgacgtttttgctgcatgcggtggacgatccggcggtaaaagtggaaaacagcgtggtgatgttcagcgccctgcggcggctggggatcccggtggagatgcatctgtttgaacagggccagcacggctttggcatacgcgatgcgcagggactgccggttgccgtgtggccggaattaatgatggcgtggatcgcgtcgaaattcccctcatctgccggatgaggggcagcgatcagctctgcaaatacaccatctgggtttgcagatattcattcaggccgtggcgcccgtcggcgccgccaatgcccgatttacgccagcccgcgtggaaaccctgcatcgcctcgaagttttcgcggttgatgtaggtttcgccaaacttcaggccgcgcaccgctttcatcgccacgttcaggttggcggtatagatcgaagacgtcagcccgtattcgctgtcattggccatcgccagcgcctcgtcaagggtatcaaaggacaccaccggcaacaccggaccgaaggtctcttcgtgcatgatgctcatttcctgacgcacgtccaccaacagcgtcggcgggtaaaaatagccgttgccctccaccgctttgccgccgagcacgacggtggcgccctgctcaaccgcgcgcgcgactttttcttccacgcgggtcagtgccgcggcgttgatcaatggccccattgcgatatcgttacgctgcgccggatcgccaaactgcaccgctttcatcgcctcgcccagtttgttaacaaagcggtcgtaaatacctttttgcacatagacgcgctcggcgcagttacatacctgcccggcgttgatgatgcgtgaatcgacaatggctttcaccgccagctccagatccgcatcgtccatcactatcgccggggccttgccgcccagctccaggcacactttggtgatgtttttcgccgctgccgccatgatcttctcgcccgcgccgacgctgccggtcatgctgaccatcgccactttcgggttgcccgccagctcctgtcccacagtttctccgcgcccgagcaccaggttaaagacgccgcgcggcagaccgatctcatcgacaatttttgcaaaggcgatggcgttgtttggcgtgaattcgctgggtttaatcacaatggtgttgccggtgatcagcgccggggccagtttgcgggcgataaggaagaacgggaagttccacggcagaataccggtggtgacgcccagcgcgcgtttaaagacgaaaatattttcgccaggacggtcgctttgcaggatctcaccttcatagcgccgcgcccactctgccatgtaatcaatgtaatccgcggtaaaggccacttcgacgtccgccagctgctgaattttgccgccttcagcgacgataagctgactgatttcgctggcgcgctcgcggatcccggcggaaattttgcgtaaccagcccgcacgttcaatagcaggcagcgcttcccaggcgggctgcgcgcgctctgcggcatcaatcgccttacgggcgtcctccgccgtaccgtccgggatgcgcgataacagcgcttctgtggacgggttgaccacgtcaatccacgcgtccccctgccaggtgacaaactgtccatcgatatacatagggtgttgtacgggtgctgtcatgacctgctcctgtaataacattgtttttaacaagtaaattcgttgttaaaaatctacaagtgcagcgggctattcccatcttaataggctgattttgtgagataactcataaaagcacggcggatatgcaacaaatgtattacatcagagagaggacgaatgcccgtttgcgctgtgaatatcgcaaacgggcagcacgttatcgtaatgcccgatcccgcagggcggcgttcagggtgtcatccgtctgtaaggtgcgccaggcggtttccacgctggcgggaaaatcgacgtgggcgataaagttgcgcccccgcgggccgtacccctgctcgtcatcccgcagacgcggaacctcgccgaggatcagcgacagatagcgatccgccgcccacaggccgtcttcgcgcggcgtaaagctcagcccgcgctgtccgttacgcaactgcggcgtcacgcccggccagctcaggaaacgaatgtccggcgactgctctgcgctgacgcgggcgaaggtcgccatggtgcgccgctgcatggtcggatcctgcaccaccagcaccctgcgcgccgtcggtagctttgcgcgcagcaattcgcaggacagtcgcgcgttttcaccgcagtttgtggacttatcttccgcaagaatacgttcagcgggaatgcgccagaactgccgtgcaatatcgccaatgatggccgcctctgaacgtccggtggtgcggatgacgttataacgcggatggcgggcgatagcggcatacaaaaacggcgtggaatgaccaataccgccgctgatcaacaagggcgctctggcgcgggcggcgagctggcaggccgcgtctatggtcgggatcacggcgttccctgccagaataatagcgtcggcctgcaccggatgcggcttgccggcaaaatcattttgcgccagccactgcccgagcgtattgaccgccgccagcgtggtttccggcaaagtgggaaagcgggtaatgatcatgcaaatctccttttacgtaccatcctgtagagtacgatcgctcacagatttaaatagcggatctctcctaatccttaggtaacttaccgaattttatcgcaatattttcatcagatgtttatacctttaacggtttcaaattctgtcatgctgttgccagttgtatgtgacaacgtcacgtaaaatattcactataaatattgaattaccgtaattaattgacttgaattatcattcgcgggcactataaaatccttagccgcctaattattcattgtcgttatctggaatcccaatgcgtttgcccaaaagcgatccgtaccagccaagagagtgggcaccgcatgaaaagcccatgcttttagggtcgccatcgaccccctttcacagcacgcccaggcgcatcgcctatggcattgtcgggctactggtgtgcctgaccggcgcgcttggcaacgccatggtaaccgccaacctgcaaaatttgcagggctcgtttgccgcctggtctaacgaaatcgcctggctgccgaccgtctatgtgatgaccaacgtctccattaacctgctgctggttaaattccgtcagcagttcggcctgcgcgcttttaccgaaggttttctggtgctgtacgtgctggtgaccttttttcacctgttcgtcaacgatctcaactctgccctgatggtgcgcgccgcgcacggtatggtggcggcggccttgagttcgttgggcatttattatcagattcaggcctggcctgcgaaacatcggttaaaagcgctcactatcggcattaccggttcgtcgctggctatccccatcgcccgcctgttctccactgaactgctgcaaatcgacgaatggcgcgggctttacctgtttgaactcgggctggcactgatctcgcttgccggagtgatcctcctcaagctgccgccgggggatcgaaaaaaggtgttcgagaaaaaagatttcatcacctttatgctgtttgccccgggtatggcgctgctgtgtgcggtgctgtcgctggggagaattgactggtggtttgaagcgccgtggatcggctgggcgctggccggctcgctggtgctgatcgtcagcgccattgtctttgagcacaaccgcagcaacccgttgctcaatacccgctggttatccagcggcagtattgtgcgcctcgggctgattatggtgctcattcgtattgtgctggcggaacagaacaccggcgccatcggctggctgcaatatgtcgggttgcaaaatgaacaaatgacgcacctggcgtggtctattcttgccgggattgtctgcggcatcgtcaccagttgcctgaccatcaaaccgcaacggctggcctggccgattgtcacctcgctggtgttgatgatcatcgctgctctgctcgacagtcagtcaaacagcctgacacgcccggaccagttactggtcagccagtttctgctcggctttggcagcgcctttttcctcgcccctgccatgcttgccgccatcggcggcgtggtggcggaaccgcgcaacctggtgagtttttccgtgctcttcgggataagccagaacctcggcggcctgctcggttcggcgatccttggcacctttcaggtgtggcgggaaaaatatcactccagtgtgctcgccgaacaactcaccacgcttaatccgctggtgaacgatcggatccagctctacagtcagatgtaccgcagccagatcgacgacagcaccctgctgaacgtgcaggcgatcaatcagttacagaccgccagcgcgttgcaggcgaatattctggcctataacgatacctatctgctcacggcgaccatcgcggcctgcaccctgctgtggatcctgtggcggttactgcgattgcgcattacggctcatctggccctgaagcgggccatgcagcaaaaagcataaaaatagcggaacaatgaaatgaaacagaaattacgacaggagtggttatgagtcagcaggacgccgccaaagagcaggccaacacgcgcagcaatttgcgtgtggtttctatttttgccgctgcagcgataggtattgtgggcgtactggtgatcctctacgcctggcaacttcccccttttacccgtcacacccagtttacggataacgcctacgtacgcgggcagacgacctttatcagcccgcaggtcaacggctatatcaccgacgttaaggtgcaggatttcgccatcgtgaaacggggcgatctgctgatgcagattgacgaccgcatctatacccagcgcgtacatcaggcgcaggcccagctggcgatgaaaattgccgcgctgaacaataatctgcaacaacgcaaaagcgccgaggcggtgatcaagcgtaatgaagcagcgctgcaaaatgcccgcgcccagagcctgaaaagccaggcggatctgaagcgcgtgaaagagctggcctctgatggttcgctctccgtacgtgagcgcgatgccgcccttgccagcgcagcgcagggcagcgccgatatcgatcaggcacgcgccacccttgagatgtcgcgccaggatctgcaaacggtgatcgtcaatcgcgcctcgctggaagcggatgtggaaaatgcccgcgccgcgcttgaactggcgcagatcgacctgcaaaacacgcgcatcgtcgcgccgcgcgacggacagctcgggcagattgcagtgcgtctgggagcctacgttaccgccgggacgcacctgacctcgctggtgccgccgcagcactggattatcgccaacgtgaaagagacgcagctggcgtcgatccgtctgggccagccggtgcacatcaccgttgacgcccttaacgacgaggccttcagcggacgggtgcagagcatttccccggctaccggcgttgaattcagcgccgtcacgccggataacgccactggcaactttgtgaagatcgcccagcgtattccggtgcgcattgagatcgacggtaaaccggaacagctacagcgcctgcgtccggggatgtcggtgcaggtgaatattgatacccgggaggcagaataatgaccttccgtcctgtctggctggcgctgacattagcgctggcgggctgtcagtctgttgacgttgcccctgcccgtcattcattaaccattcccgcggaatggcgcaccgccgtgggtccgcaaagcccggtcgagggcgtatggtggcgtaatttccatgacagtcaaatgaaccgttatgtggaacaggcgctgcgccagaacaacgatattctgatcgcccgcgagcggatcaatgaatatcaggcgcgcatttatgccgcggaaggcgatctgttcccgacgctggatgctaaccttggcggcacgcgggcgcgttcccagtctgccgccaccggccagccggtacacagtacgctctacaaaggcggactgacggcgaattacgacgtggatctgtggggggcgaaccgcagcgccacggaagcggcgcgggcatcgctggcggcgcagaaagccgcggcggcggcggccgatctgactgtcgcatcgcaggtggcctccggctatatcacgctgctgtcgctggatgaacagctgcgcgttacgcagtcgacgctggcggcgcgggaagaagcttataacctcgctaaacggcagtttgaaacgggctacagctcgcggctggagctgatgcagtcggactcggaacgtcgcgccacccgcgcgcagatcccgcagttgcagcaccagattagcgagcaggaaaacgccctcagcctgctggctggcggcaatcccggcccggtgccgcgcggagcctttgaccggttaacgccgttgccggtgcctgcgcagttgccctctacgctcttaaatcgtcgcccggatattgtgcaggcacagcaggcattgatcgctgccgatgcctcgctggcggcgtcacaggcccggctgttgccgtcgatcagtctgacggcgggcggcacctggcaggcggataccctgccaggattgctggataatcctctgcgcttgtggaacgtcggcggcagtattcttgcgccactgcttaaccgtcaggcgctgaacgcgcaggtagatgtgtcgatgtcccagcgcaatcaggcgctgtacagctatgaaaatacggtgcgcaatgcgttcaaagaggtgaacgacagcctggatgctattgcgcgcttgcaggaacagttagtcgagttgcaggagcaggcgacggtggcggaagaggcgctgcggatcgcccataaccgttaccggaatggctatgcttcgtatcttgatgagctggatgcgcaacgcacgctctattcggcgcagaccagcgtggtgcaggtgaagaataatttgctgctggcacaggtggatttgtaccgggcgcttggcggcgggtggaccggagtgcggtgagggttttgccctgggtggcgtgaactgcccggtggcgctgcgcttaccgggcctacgggctggtgaggtgactgcccggtggcgctggcgcttaccgggcctacaaacggcgtgtacaccgctttagtaggccgggcaagacgcagtcgccgcccggcgaggcattacggctggatctgctccatcgcctgcaaaatacgcttatcggaaatcgggtacggcgtgccgagctgctgggcgaaatagctgacgcgcagctcttcgatcatccagcggatctctttcacatcgtcatcctcacggcgggcgggcggcagcttgttcagccactgctgccaggcctgctgtacgctctccactttcagcatctgcgcgcgatcccggtgcggatcgaccgccagcttctccagccgtttttcaatggcattcagataacgcagcgtgtcccccagacgtttaaaaccgttgccggtgacaaaaccgcgatacaccagattgttcatctgcgctttgatgtccgacagccccagcgccatggtcatatccacccgccctttcaggcgcttgttgatattgaacacggcggtcaggatctgctctacctgcttcgcaatctccaccacggtgtcgttaagttcagcgcgcactttttcgtgcagctgcgcataaccctcttccgtccacaccgggccgcccgcctcatggatcagcttatcgacgccgcaggaaatacagtcatcaatcagatccagcactttgccgtacgggttaaagtacaggcccagcttggctttgttgggcagcttctcatgcagatatttgatcggcgacggaatattgagcagtaacagacggcgcagaccgcgccacatctgctgttgctgctccagcgggttatcgaacagtttgatcgccacgctgtcgcgctcatccaccagcgcaggccatgccttcactttgtagttgccgcgtttttgctcgtagctttccggtagctgaccaaaactccagatatgcagtccgctctgttcgataccgtcgtcggccaccgccgacagggtttcctgcactttgcctttcagcgcctctttcagcgccgtcaggttgcggccttcctggagtttcttatttttatcatccaccacgcggaagctgatcttcaggtgatccggcacctgatcccactgccaggcgtcgcgatcaacggtcacgccggtcatgcggcgcagctcgcgctccagcgcatccagcagcggcagcgccagcggcgtcacacgccccaaaaaggcttcggcatagttcggcgcaggcacaaagttgcggcgtaccggcttcggcagggatttgatcagcgcgataatcagctcgcggcgcagtcccgggatctgccactcaaaaccgctgtcttccacctggtttaacagcggcagcggaatgtgcaccgttacgccatcggcatccgcgccaggctcaaactgatagctcaggcgcagtttcaggttgccctgatgccagaagtttggatagtcgagcttactgactttttccgcgccctctttgatcagcatgttcttttcaaagttcagcagatccggcgtttcgcggctggctttcttccaccagctgtcgaaatggcgtgcggagatcacctcatggctgatgcgctgatcgtaaaactcaaacagggtttcatcatccaccagaatgtcgcggcggcgcgatttatgctccagctcttcgatttccgcgcgcagcttcaggttgtcgcggaaaaacgcgtggcgcgtctgccagtcgccttccaccagcgcatgacggataaacagctcgcggctcaacgccgggtcaatctggctgtagttcaccttgcgcgcgctgacgatgggcagcccataaagcgtgactttttccgtcgccattaccgcgccctgcgcccgctcccagtgcggttcgctgtaggagcgtttgatcagatgctgcgccaccggttcgacccattccggatcaatacgcgcggcgatgcgtccccacaggcggctggtttccaccagctcggcgaccatcgtccacttcggcggctttttgaataaaccggaaccggggaagatggcgaaacgggcgttacgtgcgccggtaaattcctgcttatcggcgtctttcatgccgatatgcgataacaacccggtcagcatggcgatatgaatttcgcggtattccgccggttcgctgttcaccggaatgcccagctctttcaccacctggcgcagctgggtgtaaatatcctgccattcccgtacccgcagatagttaaggaactcggtgcggcacaggcggcggaaactgttcgaggacagcgctttttgctgctcgccgaggtagttccacagattcacaaaggcgaggaaatcggactctttgtcgtggaaacggcggtgtttttcatccgacgcctgctgcctgtccatcggacgttcgcgcggatcctgaatcgacagggccgaggtgatgatcatcgcttcccgcacgcagccgagcttttgcgcttccagcaccatgcgcgccagacgcggatccaccggcagctgcgaaagctggcggccctgtggcgtcagcttatacgccgtttgctgctcatcggtggtgatcgcccccagctcttccagcaggcgcacaccgtcctgaatgttgcgtttgtccggcgcttccacaaacgggaacgcggcgatgtcccccagccccagcgcggtcatctgtaaaatgaccgacgcgaggttagtacgcagaatttcgggatcggtaaattccggacgcgacaggaaatcatcttccgaataaagacgaatacaaataccttccgaaacgcggccgcagcggcctttacgctggttcgccgacgcctgcgagatcggttcaatcggcaggcgctgcactttggtacggaagctgtagcggctgatacgcgccgtgccgggatcgatgacatacttgatgcccggcacggtaagcgaggtttccgccacgtttgtcgccagcacgatgcgccgcccgctgtgagactggaacacgcggttttgttcgctgttcgacagtcgtgcatacagcggcagcacttcagtatgcggcagactgagcttgttgagcgcatcggcggtgtcgcggatctcccgctcaccgctcaggaaaatcagaatgtcgccggcgctttcacggcccagctcgtccacggcgtcgaaaattgcctgaagctgatcgcgctcggtatcgtccgcctcttccacaatcgggcgatagcgcacttccaccggaaaggtgcggcccgagacttcaatgatcggggcattatcaaagtggcgggaaaagcgttccggatcgatggtcgccgaggtgatgatcactttcagatccgggcgttttggcagcagctctttgaaatagccgagcagaaaatcgatgttcaggctgcgctcgtgcgcttcatcgatgatgatggtgtcgtactgcatcaacaggcggtcctgctggatctccgccagcagaatgccgtcggtcatcagcttgaccatggtgttgtcgctgacgtgatcgctgaaacgcactttataaccaatgcaaccgcccggctcgcttttcagctcctcggcgatacggctggccacggtccgcgccgccagtcggcgtggctgcgtgtggccgataaccccggtcacgccgcgccccagctccatgcagattttcggcagctgagtggttttaccggagccggtctccccggcgacaatcaccacctggtgatcgcggatggcttccagaatgtcctgcttcttctggctgaccggcagattatccggataggtgatgtcagggcgcgcggccatgcgctggcgcactttaccggcagcctgttcaatttcctgcgccatggtctggtaaatggcctgttgcgcctctggatttttaacctttctcgccccgtgcagacggcgcgcgaagcgttgtctgtcgcgcagcattaaggtttcaagctgctggttaagggcggagaaagtaaaattttgttgttctgtcataaggttatcgggcagcacactgccggtaaaatgtctctgtttcgtttactgtagattatcacatcgccgctttctttggcttattcaaaaaattcgaacattggtatcgatatattgcgctattcatggcggcggataatgaatagagtgacggtaattattgaggctatacctcaacatacatgcataaaaggaatcacccatgagtaaagtattagtgcttaaatccagtattctggcagggtactctcagtctggtcagctttccgactattttgttgaacagtggagcgaaaagcatccggctgatgaaattaccgtacgtgatctggcggctaacccggttccggttctcgatggcgagctggttggcgcgctgcgtccgtccgatgccccgctgacgccgcgtcagcaggaagccctgaagctgtccgatgaacttattgctgaactgcaggcccatgacgttatcgtcatcaacgccccgatgtacaactttaacatcccgacgcagctgaaaaactactttgacctgattgcccgtgctggcgtgaccttccgttataccgagaaaggaccggaaggtctggtgaccggtaaacgtgcggtggtggtgtccagccgtggcggcatccataaagataccccgactgacctgatcgctccgtatctgaaagtgttcctgggctttatcggtatcaccgatgtgaacttcgtgtttgcagaaggcattgcttacggtccggaagtggcgaccaaagcgcagtccgacgcgaaagcggccatcgacagcgttgtgacagcgtaacgtttttgctaatttgcgcccggcggcgcttcgcttgcgcgggcctacactttttgtaggcccggtaagcgccagcgccaccgggcaaaaacacttacccgccgatactttccagcgtagccagcacctcttctgacaactccagctctgccgccgccatattttcacgcaaatgcgtaaccgacgaggttccgggaattaacaggatattcggcgaacggcgcagcagccaggccagcgccacctgcatcggcgtggcattcaggctcgccgccacctctgacagcgtggatgactgcaacggcgtaaagccccccagcgggaagaacggtacgtaggcgataccgtcgcgggccagcgcgtcgatcagcgcgtcatcttcacgatgggcaatgttgtagagattctgcacgcagaccacgtccaccattgcacgcgcttcggcgacctgggtcgcggtcacattgctcagaccaatatgtttcaccagcccctgcttttgcagatccgccagcacctgcacatgttccgccagcgaaccttccgccgggccgtgtccgtcgccgagcatcgaacgcaggttaaccacgtccagcgcttcaacgcccagattacgcaggttgtcgtgtaccgcctgtttcagctcatccgcagaaaacgccggtagccaggctgccgtttcatcgcggcacgcgccgattttggtgacgatcaccagatcatccggataaggatgcagcgcctcgcggatgatacggttggtgatatgcggaccataaaaatcgctggtatcaatatggttaacgcccagcgcaatggcttcgcgcagaaccgccagcgccgcgtcatgatctttcggcgggccatatacgccgggaccggcaagttgcatcgcgccgtagcccagacggttgacggtcatcccgccgaaggtaaaagtgtttgctgttgtgtgcgtcatcatgatccttcctgcatgagttatagtaaatcgctgcgcgtcttcagcagcgtttcgacgtctttatccgctttaatatgaatatcgtggtcgatctttacgttcatattgatggtgattggcgtggacggtgccgccacttcgattcgcggcgtgcagcctgtcagcaacatcaggggcgcacacagagcgattaacgagaatttcattgttttacctcacattccttgccaggcgcgcagcggttatccggcactgtcgcatgttgctcaagccatgactgtaaattatcgccgtaacgtaaactgcgccataacgtgaagacattttcttcatggttatagttcaggttgaccgcattgcttttgccatcaacgtaactgatgcctttcagggcggcgcgcatcttcattacgccgtgattgtccaggtcgatatgcgtccaggattgcgaaatctccatatagcgtagccagctgatggccgccccggccgccatattatccttcaccagcgcgtcggcggtgtctttatcaagacgcagcgtcagcgcgcccggattgcttaaccagccatctttcacgatccattgatcgttattcagccacagcggcagcgcgccgttgagcgcgccggacatggcgaactgtttggtattaaccgcactgataatttcgctggcagaaatatgctccagccgcagcagcgcggcgtcgtgctgcggtatacgcagctggcggagggtgattttcccgccgagcatatccacgctgacgtcgctcaggcgcagcgggttatcttcgctccacgggtatgcgccctgcaaatccgcagtgaagtttttcgccgtcacctggttgatgatttcgccaatgcgcagccggaccggcccgcgcgtccccagttgccaggtcccctcgctgaagcggaacggcagcacaaaatcgacgcctttcagctcgttatccggcatccaggcgctgccgcctttcagcacaccgtgtcccccggcttcgaacccctgatccgcagcggcagaaaaggcgatctgcgcgtacatttcgccatcgcgcagggccattttccagtccggcggtaccagcggctgaaagactttcaacgcctggcgcggccaccacgcctgcccgcgcagccgttcgccgtcccagcgcccgttaacccgtaccgggccaatctcctgtgcgtggagatcgcctttaaactgaaagatcgtcggctcgcgtccactgatgctgaatttcagcgttgagggtggtaacacgctgccgccgctgaaggtggtctgcgcggcgtcgagcgacagcgcgccgctaaactgcggatgctgttcatcgcgctgccagcgtatgggcgcgtcaagtaccagccggggtttatccatatgcatggtgccgtactgcaactggtcgaagccggtggacagatcggtcagcaggatcaggctatcacgccactccccttttccggcgacatcccagcgcgcctgcatcggcgtgaagcggccatcaccccagtaacgccactgccagagaccgtgatccggcaggaagtcgtgcgcctggccgtcaaggtgcagagtaaaatcccccatctggttttcatgggcgcgcaaaatggcctgtaagcgaccatcaatgccgcgctgggtgactttcacccctgccagcggccagcgcacttcatcaatattcagggaatcaataagcgtgccgcgggagcgcagcagcgcgccggggctgaacgccagcagcggatcggtgaggctgccgctcagatgcgccggtaacacggcgtataaaatcaaatcgttctgcttggcttcgccggtcagttgcaggggcagatcgctgttttccagactcagccgccccggcccgatattcagtacggcgttgcctttgcctgcatcgccccgggtcagcacgttcatccggccgctgacttctgcgccttccagccccgcctgccagtttttgatgcgtatgccgacgcgcccgcttaacggcatgccctgataaggccagttccagcgtccgtcgctgatggtaagctgctgctgcgtcacctgccagggaagatcaagcagcggatcggcggtatcccgcgccatgacgatcagttggccttcgttgtcgcgccactcgatttccgcatccacaggatcggcgctttgcggcaggtgcagggtggcggcggcatggccgttaaccggcagaccgtccggcaccagcggcagggtgaactcccccgccaggctcagcggcggctggttttccacgagtttgaccgcgaatttttccaccgtcagcgcctgtccggaaagctgcgcctgcacggtgacgcgctcgccctcataactgagctgctggcgcgctggcgtcagcgcaagggcgattttcccttcccactgctgccagggcgtgaccgtcagtttatcgatattaacccaggtataaggcagcatggactgccactgcgccagggtgcgcggcgcggcgggcgatgctgtcgtctgcgggagttttttcagacaggcggcgttaagcaccagcgagtcgacattcagctgccagcggctcgggtgcgtcagttcggcatgcgtgagtttcgccagcgggcagtcgtccaccaggtaaagcaaatcagggattttcagaccatgacgcgtcagacgggggctttcttcaaaggcgatgcgtgtccccaccggcagccagatcccggccagccccggcacccactgcgccagcgtcatcagcagcgtaagcggcaaaagtatgaacagtaagagcagcgcgagcgcgactttatatttacccttcatgggcagttaatatcctgatttggcatcaattttctgtctgtccgtggcgttattgtggcatgcttacatatattggtgaagtgaatgcctctgataagagtagatgttctagaattaatcattatgctggattgatattacaatcactggagaaagtcttatgaaactcgctgtatatagcacaaagcagtacgataaaaagtatttgcagcatgttaacgagaattataactatgaacttgaatttttcgactttctgctgactgataaaaccgcgaaaacggcccatggctgcgatggcgtctgtatttttgtcaacgacgacggcagccgtccggtactggaagaactgaaaaaacagggtctgaagtttattgcgctgcgctgtgcgggctttaacaacgttgatcttgaggctgccaaagcgttagggctgaaagtggtgcgcgtcccggcctattccccggaagcggtggcggaacatgccgtgggtatgatgatggccctgaaccgtcgtattcaccgcgcctatcagcgtacccgtgatgctaacttctcgctggagggcctgaccggcttcaccatgtacggtaaaaccgcaggcgtgatcggcaccggtaagattggcgtggcggcgctgcgtattctgaaaggtttcggtatgcgcctgctggcgtttgatccttatccgagcgccgcggcgctggagctgggcgtggagtatgtggatctgcccacgctgtttgcccagtcggacgtgatctccctgcattgcccgctcaccgaggataactaccacctgctgaaccgttcgtcgtttgagcagatgaaagacggcgtgatgatcatcaacaccagccgtggcggcctggtggactcgcaggcggccatcgaagcgctgaaaacccagaaaatcggcgcgctgggtatggacgtgtatgagaacgaacgcgatctgttctttgaagataagtctaacgatgtgatccaggatgacgttttccgtcgcctgtccgcctgtcataacgtgctgttcaccggccatcaggcgttccttaccgccgaagccctgatcagcatttcggaaaccacgctggagaacctgcgccagctggaaaaaggcgaaaactgcccgaacgccctggtgtaagagcccttcgctcccctctcttcaggggagcgctttcagattttcctgcaagacacctcttatacgcctgttaaaatcagcgctcaatcacggagaatatccagggagttttatgaaatattttattgcgttaaccgcagccacgttgctgctggctggctgtgcccgtgatggcaaagtctctgtcacgccggatgagctgatgcaccaccgttttgtgctgcaaacggttaacggcactgccatcaatcctggcagtaatccgccggaaatcagctttggcgagaaaatgcacctttccggtgtgatgtgtaaccgtttcaccggtcaggggaaagtgtccgacggcgcgctgtcggcgaaaaatctggcgatgacgcgcatgatgtgtgccgatccgcagcgtaatcagctggatcagactttcagcgccatgatgaatgaaggggcacaggccgacctcaccggcaaccagctgacgctggccaccgcagagcagacgttaatctttaaactggccgacctggggcagtaatcagtacgcgccgcacgtgcctgacgcgagcgattgttcgctacaacgtttaccgttgggcagtgcgcacatgccggtggccgagccatcaagctgacgtgcgacggacagcgatccgccaatcatcgcgcagctggcttcaccggaactggtcatggcggctttcagacctggcgcgacgtgcgccgccgtggcctgctgaactggctcgctgctgcaagccgataataataatgccgcgcaccctacccacaatcctgctcgcatgttttctcccccgtcgatttagcaaaacctatgcataataggcagcccggcggctgacgtcgagagccagactgcgctttttctgtccggccatgagaatttccccattttgcggtatggctcccaattggtcaggacgtaaaaaaacccgccgcagcgggtccttttcttaatcaatgatgaagcatttcatcgacgacctgctcgttagtcagctgatacggataataggtcggccagttatccatctctttcagcagagcgtcctgcgaggtattgccggtgaaaatgtggtaatgcgcggatttgcgcgggccgatggtgtgatcgctgaactgcacgaacttcggcgctttactgttggcatccttacattcgaacaggtagcgcacgcccttcttgcccgaggtataggtgaggattttgtagcccgcgtaatcgtacttacaggcgttaaccacgtcgccggtgtggaattccatcacgccgttttcaatgccgatagtgtccactttcgtggcgtagcctttgcggtaataggctttgtactcgtcagcggttttgctcttgtcctgttccgctttcttcttgaataccggatccagttcgccgctttccagcaacggataaacggattgccatacgccgtcccagtcgctcaggctacgatcttttacgtcgctgtcctggaatacgccgttcgcggctttttgttccatttcggtcagcggttttccgtgagaatgatgaccatgcgccagcgcctgcccgctcagtaaaagcgccccgagcgccattgccactgttccatattgctttatcaaaacgctaccctcattaagatttagaaacatggatgttatgatataacatttatattttcaagcccgaccattaaacatcaattcattgaccggggttatgaggagtacacaaaagcgaaaatggcttcagaggggatttgctaaaatagaagcataattacagggcacgccggtgttatgcgtgtcccttttattgcgcaatgtaagggtgtcctatgatcacaactgacggtaatggcgcagtcgcctcagtggcgttccgcaccagcgaagttatcgccatctaccctattacccccagctcgaccatggccgagcaggctgacgcctgggcgggcaacgggctgaaaaacgtctggggcgatgtcccgcgtgtggtggagatgcagtcggaagccggggcgattgccgcggtgcacggcgcgctgcaaaccggggcgctttccacctctttcacctcgtcacagggcctgctgctgatgatccccacgctgtataagctggccgggcagttaacgccttttgtgctgcacgtggcggcgcgcaccgtggcgacccatgcgctgtcgatctttggcgatcactctgacgtcatggctgtgcgccagaccggctgcgccatgctgtgcgccagcagcgtgcaggaagcgcaggatttcgcgctgatttcccatatcgcgacgctgaaaagccgggtgccatttattcatttctttgatggtttccgcacctcccacgaaatcaacaaaatcgccccgatcgccgacgagaccatccgcgccctgctgccgcaggaggagatcgccgcccaccgtgcccgcgccctgaatccggagcatccggtgatccgcggcacctcggcgaaccccgatacctatttccagtcccgcgaggcgactaacccctggtacaacgccgtttacgatcgcgttgagcaggcgatggatgattttgccgccgccacgggtcgcgcttataagccgtttgaatattacggtcacccgcaggctgaacgcgtgattattctgatgggctcggcgatcggtacctgtgaagaggtggtggatgaattactcacccgcggcgaaaaagtcggcgtgctgaaagtgcggctgttccgcccgttctcggcgcgacatttgctggcggcgttgccggaaagcgcgcgcactattgccgtgctggatcgcaccaaagagccgggcgcccatgcggaaccgctctatctcgacgtgatgaccgcgctggcggaagccttcagtaatggcgaacgcgacgccctgccgcgcgtcatcggcgggcgctacggcctctcctccaaagaatttggcccggagtgcgtgctggcggtatttaatgaattgcagtcggcaaagccgaaaccgcgctttaccgtcggcatttacgatgacgtcaccaacctgtcgttaccgctgccggagaataccctgccgtcaaaagccaaactggaggcgctgttctacggcctcggcagcgacggcagcgtgtcggccaccaaaaacaatattaagatcatcggtaactcgacgccgtggtacgcccagggctatttcgtgtacgactccaaaaaagccggtggcctgacggtgtcgcacctgcgcgtcagcgagcagcccattaactccgcttatctgatttcgcaggcggactttgtcggctgtcaccagttgcagtttatcgacaagtaccagatggcggagcgcctgaagccgggcggtattttcctgctcaacacgccttacgcgccggatgaggtgtggacgcgactgccgcaggatgtgcaggcggtgctgaaccagaaaaaagcgcggctgtgggtggtcaatgcggcgaaaatcgcccgcgaatgcggcctcggcgcgcgtatcaataccgtgatgcagatggcgtttttccatctgaccaacattctgccgggcgacaacgcgctggcagcgttacagggcgccatcgccaaaagctacagcagcaaaggcacggagctggtggagcgtaactggcaggcgctggcgctggcgcgcgagtcgttgtcagaagtgccgctgcagtcggtgaatgccgccagcccgcaccggccgccagtggtgtcggatgccgcgccggatttcgtgaaaaccgtgaccgctgccatgctcgccggtctgggggatgcgctgcccgtctctgccctgccgccggacggcacctggccggtgggcaccacccgctgggaaaaacgcaatatcgccgaagaaatccccatctggaaaccggagatctgcacccagtgtaaccactgcgtcgccgcctgcccgcactctgccattcgcgccaaagtggtgcagccggaggcgatggaaaacgcgcctgccagcctgcaatcgctggacgtcaaatcccgcgatatgcgcggccagaaatacgtgttgcaggtcgcgccggaagactgcaccggctgtaatctgtgcgttgaagtgtgcccggctaaagatcgccagaacccggagatcaaggccatcaatatgatgtcgcgcctggagcatgtggaagaagaaaaagtgcattacgacttcttcctcgatctgccggaaatcgaccgcacgtctcttgagcgtattgatattcgtacctcgcagctgatctcgccgctgtttgaatattccggcgcctgctctggctgcggcgaaacgccctatatcaaactgctgacgcagctgtatggcgaccggatgctgatcgccaatgccaccggctgttcgtccatttatggcgggaacctgccgtccacgccctacaccaccgaccgccatggccgtggtccggcatgggccaactcactgtttgaagataacgccgagttcgggcttggcttccgtctgacggtggatcagcatcgtcagcgcgtgatgcgtctgctggacacctttgccgatcgtattcctgccgaccttaacgatgcgctgcacgcccccgccacgccggaagttcgccgtgaacaggtcgccgccctgcgtcagcagttggccggtaccgacggcgcggaggagctgctgaccgacgccgacgcgctggtggagaaatccatctggcttatcggcggtgacggctgggcctatgacatcggctttggcggactggatcacgtgctgagcctgacggaaaacgtcaatattctggtgctggatacgcagtgttattccaataccggcggccaggcctcgaaagccacaccgctgggcgcggtcaccaagtttggcgaacacggtaaacgtaaagcgcgtaaagatctgggcgtcagcatgatgatgtacgggcatgtgtatgtcgcgcagatctcgctgggggcgcagcttaaccagacggtgaaagccattcaggaggcggaggcctatccggggccgtcgctgatcatcgcctacagcccgtgcgaagagcacggttacgatctggcgttaagccacgatcagatgcgccagctcacctcaaccggcttctggccgctgtaccgcttcgatccgcgtcgcgccgacgaaggtaaagtgccgctggcgctggactcccgtccgccgtctgaggcgctggcggatacgctgatgaaagagcagcgtttccgtcgcctgaacgcccagcagccggaagtggcggaacagttatggaaggacgccgccgccgatctgcaaaagcgctatgacttcctggcgcagctggccggtaaagcggaaaaacacccggcggaataagccgtcatccgggccgaatgctggcccggtactttctaaagcccggtgcccatcgggcttttaagccccctgaaaggccgttatttcatcacccgatatgctgtaaaaaatgataatcttgatgaatgccgagctgttaaggacaccaccgtgcgccatcatcccgtaaaatcatcgcgaattgcctccatcgggtacgaagaaagcacccgtacgctggaagtgcggtttcataataaaaacgtttaccagtatcgcggcgtcccctcgcgcattttcagcgtctttctgacggtcgtctcgaaaggccgcttttatgatggcgtggtgaaaggaaaatatccggagcaccgcatcgcctgatcttttatcccaccggcaccatcagaaaatcagaaaaccgcgtggtgtagcgcggcgacagcatttcacgtttcatctgccactcctgacggatcccctgcccggcgaaatagagcgtcccccgtccttttttgcggttcagttcatcaagcgtcgccatcagcgcctcgctgccgggccgcggggcatggtcatcaaacagattaagctgggcgacgccctggctgaagaaatcccccagcatgacgcccgctttctgatagtggaatccctctttccagatgagtttcagacagcgcgtggcggcgtcaataatatcccggctgtcctgagtgggcgtcagcaggctgatggaggcgcttttgccatagtaaggctcgtttaacgcaaagggcgaggtcttcacgaaggccgaaataaaccggcagtactggcgttccgcccgcagtttttccgccgcgcgaaaggcatggctgcaaatggcctgacgcatgtgctcatagtccgtcacccgctcgccgaagctgcggctacagatgatctcctgtttggtcggggtcaactcctcgaacgccaggcaggattcgccgcgcagctcgcgcacggttctttccagcaccacgctgaaatgtttacggataaagttaatgtcggcatcggccagctgaatggctttgctgatccccattgcctccagccttctggcgatgcgccgcccgatgccccacacctcgcccacatccagccgcgccatcagcttgcgctgccgctccaggttcgacagatccaccacgccgttaaactgcggccagcgtttggcggcatagttagccagcttcgccagcgtcttggtttgcgcgatgccaacgccaaccttcaggcgggtatcccgcgcgatggtctggcggatctcctggccgaacgccgtcagatcgcgacaattgcgcacgccggttaaatcgcaaaaggcttcgtcgatggagtacatttccacgcgcggacagagatattccagcgtgtccattacccttttgctcatgtcggcgtagagctcatagttactgctgaaacaggtgatgttatgggcgcgaaacagatcccgctgtttgaaaaaaggcgcgcccattaccacgccgtattttttcgcctcggcgctgcgggcaatcacgcagccgtcattattgctgagcaccactaccggcttaccccacaaatcaggccggaatatggtttcgcaactggcataaaatgagttgacatccaccagagcaaacataatcagcgtgtcgcttttacgataaaggtgaccacgccgaatacttccagcgcatcttcgctcaggatgggaataggtcgataggcgcggttgagcggattaagttgcaggacgggacgaagctggagttgtttgacggtaaattcgccgtcgacggcggcaataataatatcgccatgatcggcttttagcgaggcatccaccaccagcagatcgccgtcgctaattcccccttcaatcattgaatcgcccgcagcgcggacaaaataagtggctgagggatgctgaattagccattcattcatatcgagcgttttttcaacataatcctgcgcgggagaaggaaaaccgcactggacaagatcgccgaacaaagggagcgcgtaaaccacgcgcagttcagcagggtgatagcacttcatggtgagtcaccttatttgtttttactgtgtatttatacagtagatttatatattacgctgatcaagtccctgcctgagccgaaaagtctcatagaattggctttataagataaatttcattattaattaatgatttagatatatgtgtaaatttttcacgatgacgtgtgactgcgtagttcttgaacgagacggcgtattccggcgaaaggagtaatcagacgaatttattgctacaatcgtgcccggcggatctgacccaacaccagggtggatgccataaaatgccatcatccgaactgagccactattacatgtcgcaaaatcaagaagttaacaaaaaagaacagtataacctgaacaaactccagaagcgtctgcgccgcaatgtgggtgaagccattgcggacttcaacatgattgaagaaggcgatcgcattatggtgtgtctgtcaggcggtaaagacagctacaccatgctggagatcctgcgcaatctgcagcagagcgcgccggtcaatttctcgctggtggcggttaacctcgatcagaaacagcctggcttcccgggtcatattcttcctgaatatctcgaacagctcggcgtcgaatataaaatcgttgaggaaaatacctacggcatcgtaaaagagaagatcccggaaggtaaaaccacctgttcactctgttcgcgtctgcgtcgtggcattctttaccgtaccgccaccgagctgggcgccacgaaaatcgccctcggccatcatcgcgatgacattttgcaaacgctgtttttgaatatgttctatggcggcaaaatgaaaggcatgccgccgaagctgatgagcgacgacggcaagcatattgtgatccgtccgctggcctactgccgcgagaaagacattgagcgttttgccgaagcgaaaggctacccgattattccgtgcaacctgtgcggttcgcagccgaacctgcaacgtcaggtgattggcgacatgctgcgcgactgggataaacgctatccgggccgtctggaaaccatgttcagcgccatgcagaacgtggtgccatcgcacctgaacgacgttaacctgtttgattttaaaggtattacgcagggggctgaagtggtggatggcggcgatctggccttcgatcgtgaatccattccgctgcaaccggtaggctggcagccggaagacgaagacgctcaactcgatgagctgcgccttaacgttgttgaagtgaaatgatgttgcgcctctctggtcatatggccagagaggcattaaggcttatttcagtaaacgtacgcggcaggtcttgcctttaattttgccgctctggaactgcttccacgcctgacgcgccacgccctgacgcaccgccacataaacatgtgccggatgaatggtaatcttaccgatatctgcgccatccatgcccatatctccggtcatcgcccccagcacatccccggcgcgcattttggcttttttaccgccatcaatgcacagcgtcgccatttccgcttccagcggcacaactttcacgtttgctggcgggttcagccagttcagcttcagttgcagcatttcagacaggatattggcgcgctgggcttcttccggggcgcagaggctgatcgccagaccgctgttaccggctcgcgccgtacggccaatacggtgcacgtgcacttccggatcccacgccagctcgtagttcaccaccagttcaagggacttgatgtccagcccgcgggccgccacgtcggtcgccaccaggatgcgggcgctgccgttggcaaagcgcaccagcgtctggtcgcggtcgcgctgctccagatcgccatgcagcgccagcgcgtcctgccctgcttcgttcagcgcatcgcatacttcctgacaatcttttttggtgttgcagaataccacgcaggacgccgggcggtgctcgctcagcagcttttgcaacaggctgattttgccgttgcgggaaacttcaaaaaattgctgctcaacggcaggcagatcgtcgacggtatcaatttcgatagtttccggatcgcgctgcacgcgtccgctgatggcggcgatagcctccggccaggtggcggaaaacagcagcgtctggcgcgaggcgggcgcaaagcgaatcaccgcgtcaatggcatcactgaatcccatatccagcatgcgatccgcttcatccatcaccagcgtttgcaggtgatcgagcgccacggtgttcttttgcaggtgatccagtaaacgccccggcgtggcgacgataatatgcggcgcatgttgcagcgaatcgcgctgcgcgccgaatggctggccgccgcacaacgtcaggatcttaatgttcggcataaaacgcgccaggcggcgcagttcgctggcaacctgatccgccagttcacgggtcgggcataaaatcagcgactgcgtctgaaactggctggcgtcaatgtgctgcaacagccctaagccaaaagccgccgttttcccgctcccggtttttgcctgcacgcggacatctttcccggcaaggatcgcgggcaacgccgctgcctggacaggtgtcatggtcagatagcccagttcgttcaggttctcgatctgggcggcgggtagagcattcagggtagaaaaagcggtcacagtatattctcgcgataaaaggccaggttcagcaggcgcgtatcctctcagatctgcccgctcaacgcgacaatttaatcggcacctcgtccggcggcggatcgggtaaaggctgtggatggggaatgggatcgggcaccggaaccgggtcaacggggatcgggtcggtgggcagcgtatcaacaggattaaacagattgagacgggacatagttacctccgcgtgaatgaagcacaccttaagggtagaagctcacggaaaagaggcaaaaaaaagccgactctttaaagccggcgtcgtacgaatcaattgtgctatgcagtaattcaaaaaaaggaagtaagacaatatggagcgcaacgcccatcgcttgacgttgcattcacctgcgggagagatagtgccctgaatgaaccggcgttttattgatttcgctcaactaagatggccttttcatgtttgcattttgttaaaaaggttaaaatttacaaccatttactgcgatgtaaccaccaggtaactccgccgatcaataccaccaacatcaggcagaagatcgcaaagccgagatgccagccgccgccgggaatgccgccgaggttaacgccgaacagcccggtcaggaaggtactgggtaaaaacaccattgccatcagcgacatggtgtagctgcgtcgtgacaatgactcctgcatcacctgggtgatctcatcggtcatcacgcccgtacgggcgatacaggcgtcgatttcatccagcccgcgtcccagccggtcagaaatatcctgcatacggcggcgctgatcgtcattcatccacggaaaacgctcgctggcgagacgggcatacacatcccgctgcggcgccatatagcgccgcattacgatcagctgtttgcgcagcagagccagaaaaccccgcgggggaatttgctgatcgagcaggttatcttccagatcgatgattttgtcatgcagcacttcgataaattcgctggcatgatcggtcagggcatcgcagacatccaccagccagccgccgacgtccgtcggcccggtgccttcctggagatcgtgcaccacgtcatccagcgccagcactttacgctgccgtgtcgagacaatcagccgctcatccatatataaacgcatcgccaccagctgatccgggcgctcatcggtgctgccgttaatgcagcgcagcgtgatcagcgtcccctcgcctaagcggctgacgcgcggccgcaggctgtcgcccgccagcgcatcgcgcacgttgttgggaagcaaaggcgtggtcgcaagccaggccgcgctctcctgattggtatagttgaggtgcagccagcatggatgcttgtcgtcaataacgtcttcatcgctcagcgtcgtcacgccgcctttaccatccagcagccacgcatagactgcatccgggacgttaacgtccgatcccttaattgcctccacggcccctccgcattcagcactgtaatgaaaacagtctagctgtctgccgggcttaagcaatcagaaaaggtgccagtgcgctgaattttatggagaaatgccgcgcctgcctgcgccactggctgcggcgcgttttccagccggaaactgcgcgttctgccctggagttcaagcacctggcttttcagcacatccgccgagccggacagctcatccaccatagtgacattgctttgggtgagtttttccagctctgacagcgcctggctgatttgcgcgatacctttttcctgttgcagcgttgaaaccgaaatctcatccataagctggctcacctgcccggccccggcgacgatctcctgcatgtttttacctgcttcttcgaccacctgcgcgccctggctgacgttttgcgtcgtcaccgcgatcagcgatttgatgcttttggcggcttcggcgctgcggtgcgcaagggttctgacctctcccgctaccaccgagaaacctttaccatgatcccccgcacgggcggcttccaccgcggcgttaagggccagaatattggtctggaacgcgatgccgtcgatcatggcgataatgtcggtcatctgctgcgcacagtcggtaatggactgcatattgttcgagacttgatccattagctcaccgccccggcgcgcgctgccggtggcttcgctggcgtactgcgtggcgcgccgggtgttttccgcgttatttctggtgctggccgccatttgctccatgctggaagcggtctggatcagcgcggcggactgctcttcgcttttcaccgccagctccgcgctgcgggagtgcagctgcccggaaagatccatggccgcctgcgaggaggcgcggatttcccgcaccagcgtggcgatgttactggaaagatgattgatgcccgggatcaaccgccccgcacagttgttaccgaaaatcgggatggtaatagataagttaccggcgatgacttcatcgatgctttttttaacggtattgatcggcgagactaaataaaacgtcatatatgcccataataaaccgagcgttatcagcgataaaatagccagcagagtaattaaggtgccgtcttttgagacggccatcactattatttccatgacaacaaatgtactcagcaggaataacatgatgaaggttcgaacactaatatgtttaagcataaacaggcctgctaatacgtcagggagggattcagtagttttatagcatctggaataccctttttcactctcatttttaaggcgcatcatgttcgccgttaatagcggaaagttttacccaagggataatttttcactacttaaaatattttcataagtggataacactgcatctgtagcataaacgtgtttgacgccgcagcgcggttgtctcagggataagcatgaagaaatatttagcgtcctttcacactccgcccctgaaatttaatgtagccacacttaaatgcgaagaaataatgtgcaacgcaaaagctaatgcgcctttttaataattcggtgataaaggctgacgccagccaaaaattccggcgcgcataatctgttatttgaccgctttgttacagcgcctcctcccgccgggacagggtaaaatcgcttaataaacaaacagctttttagcgcctggtttgctaacatagcgccccttttacctgctatcgacgaccaaccggcatgtccaaaaaaagaatcgggcttcgttcgctattgatcatcctctctgtgggcagcgtcacgctgacctccctgcttctgctcagcacgctgtggctcatacagaaagaaaatattgaggacagcctgctgcgcagcaatatcgcctatgcgcgcaaactggcggacaccaccgacggctacttttccacagcgcagcgcgaactggcctacagcgcacagcaaatcaaaacgctgcgcgatgaggataatctgcatcgcgaagcggaacggttacgcctgcaatccggattttttaactcggtggtgatcgtcacctcccaggcggtggtggctgccgcctcgcctgaaagtctggggctggtcgggcaaaagctcacctctgacgccaccaggcgcgccatcgcccttaaacaaccctttatttccagtccgtttatgtcagctgccggaaattatgtggtgtttatctcccagccgctttatgccgctgacggacattatctcggctttgtcggcggctctatctatctgaaaaagccgagtatgctgagcaatattatcagccagcatttttatgaagatgattctcaggtgagtattgtcagtaacgatggcaaagttatttataaccacgatccgtccctcgtcggtggccatatcgcggttaatcctgatcttaaagataaattaatccacgaacagagcggtaaatatttactgactcatcagggacaggaatatctgctcggctatgccagcctgaaggcgaccggctggaatgtttttatttacggtacctcagataatgtgcagcgtattctggcgctgacggcggaaaacgccacctggatcctgctgacgctgatcagtctgatgatcacgctggtggcctggctctcctcgcgtatctccgcgccgctggaaaaactggcggaactgacgcgctcagaggacagcacccgcacgctgaaagcgctgccggggatccaggcctggtatgcggaggcggcgaatctgcgggaagcggtgtatcaccacgtgctgatgatggtcaaccgggtcagcgcgctgaacgacgaggcgatgaccgacccgctcactggcctgtataaccgtcggggtttcagagagatgacccgccgctaccggcacagcgatcaccactgcctgctggcgctggatatcgatcactttaaggtgatcaacgacgagcacggccatgacgccggggatgcggtgctgataagcctggcggtattgctgaaagccgtctgccgcgagagcgacattattaatcgcttcggcggtgaggagtttgtgatcttcctgccggacacctcgttgagcgaggccatcgcgctggcggagcgtatccgtaaaacggtggaaaacaccgatttcccgtacacgcacaagatgcggctttgcggcggcgtggtcagtttgcaggatgaaggtaacgatatggaagcggcgctgcggcgggcggatgtggcgctttataatgccaaagccagcggccgcaaccgcgtgatgttcagcaaaggcgatgagatttaccctcaccaggcgggataacgggctggcaagccagcccgcgtctgtcagtgctgcaaaatatacatcgtgcgggtgtaagccacgtcttccggattgttaatcggatagcctttcagccagggtttgatcagtcgtccgttactgtactggtagataggcgcaatcggcgctttttcggcaatgattttttccgcttcgttataatcggcattacgcgcttccgcagtggtttcctgcgcggcctgattcagtactttatcgtaagccggatcgttaaagcgcgaaatattgccgctatggctggaagccagcagcgacaggaaagttgacggctcgttgtaatcccccacccatgacgcgcggatcacatcaaaattgccggtgttgcggctgtcgatgtaggttttccactcctggttttgcagcttcacatccacgcccagatttttcttccacatcgacgccaccgcaatggcgattttctggtgcgtttccgaggtgttatacagcaaggtcagatccagcgggcgctgcgggccgtaacctgccgcctgcaacagggttttcgcctgcgcgttccgctcttcctggctcatggaagcaaaaggcgatggcgaagctttaaacccggccgtcacgtccggcgtgaaatgccacgcgggtttctcgccggtgcccagcactttgtccgccatcagctggcggtcgatggtcaggcttaacgccagacgcacacgcggatcggcggtcgggcctttctgggtgttaaaggcgtaataataggtgcccagctgcggcggcgtgtagacctggcccggaatgtctttcatcagcttctgatagaggtttttcgggaaggattcggtgatatcaatatcgtccgccagatagcgtttggtggcggcgctctcctggttgatcggcacaaaagtgacctgctggatcaccgtacgggcattgtcccagtaattgacgttcggcaccgccaccagtttttcgttcaccacgcgatcttttaatacataagcgccgttaccgatgagcttgccgggcttcgtccactccgcgccctgctccacattcgctttctgtaccggataaaacgcgaagctggcggtcagattggcaaaccagggcagcggtttatcaagctgaacgcgcagcgtgtgggggtcaacggcagtgacgccgagcttgtccggcgtggctttgccgtcaatgatgttttgcgcattgctgacgcccgccagcgccgcaaaccaggcgaatggcgaagtggttttcggatcgaccagccgctgccagctgtagacaaaatcctgcgcggtcaccggcgtgccgtccgaccattttgcatcgtcgcgcagagtaaaggtccagacgcggttatcgttgctctgccatttggtggcgacgccgggcaccagctcgcccttctcattctgattcaccagcccttcgaacagatcgcggatcacctggatttccggcaggccaacggctttagccggatccagtgatgcaggctcgtctttaatgtggcgcaccagcacctgctttttcgccagcactgcgcccgctggcacctcggcggcaacagaaagcgacgaaaagctgcacatcaacagcgcacaacaggttagcgaaacggaatgtttcatgagatcccctcaaaagtaggtgccggccggcgaaagatgaggtaattatttgttttaacaactgggaaagcaaacatatcccttcagaaaataacgatttgaaaaggatcgtgttttgcttaacacttttaaccatcacccgacagagtaaggatgtctatgtccgtttcccttccgcgcgccgaacgaggggcttttcccccgctgacggaacattatggcatctccgggcttggggcgccgctgatctggtttcccgcgccgcaggcctcgtcggacagcgggctgatcattgccggtacccatggcgatgaaaatgccgccgtggttacgctgtcatgcgcgctgcggacgttaagcccgcagtttcgtcaccatcatgtggtgctggcggtgaacccggacggctgccagctcggtttacgcgccaatgcgaacggcgtcgatctgaaccgcaactttccggcggccaactggcgggccggggacacggtgtatcgctggaacagcgccgccgaggcgcgggatgtggtattacagaccggcacgacgcccggctccgaaccggaaacgcaggcgctgtgccagttgatccaccgtattcatccggcatgggtggtgacctttcacgatccgctggcctgtattgaagatcccgcgcaaagcgagctgggggcgtggctggcgcaggcgttcgccctgccgcacgtcaccagcgtcggctatgaaacgcccggctcttttggcagctggtgcgccgacattggcctgaactgcatcaccgccgagtttccgcccatctcaaacgatgaggcgagcgaaatctatttgcaggcgatgatggatctgctgcgctggacgcctcagaggtgaagctgaccggtggagaagcgcagccccggctccacgtccaccgccagccaggtcgggccatccagatcggcgaaacgcacttttcccgccagcggcagcgccgcgctgatggcccgcgaggtgcagagcatacagccgagcatcaatcccagcccctgcgctgaagcggcgtccgccagcgccagcgcctcggtcaggccgccggttttatccagcttgatgttgatcatctcatagcggccctgcaaattttgcaggcagctgcgcgtgtggcagctttcatcggcgcagatgggcagcggatggataaaattcgccagcatggcgtcatcgctggcgggcagcggctgctccagcatcgctacgcccagatctgccagcaactggcagcgtgccgccagcccttcgctgtgccaggactcattggcatcgacaatcagggtggcgtcgggcaccgccgagcgtaccgccaccagccgttcgctgataaacgtatcatcgagtttcaccttcagcagacgcgcgcccttttcccacagcgccgccgcgctggccgccatctgctgcggcgtgccgatcaccaccgtttgcgcggtggtcaccgtgcccgtcagcggcacgtgcaggagatccatcagattctgtcctgcgcgacgcgcctccagatcccacagggcgctgtccacggcattacgcgccgcgccaggcggcaggagcgattgcagatcctgacgcgtcagcccgccttccagctgcggcactacggtcatgatttgcgcgatcaccgaggcatcgctttcaccatagcgcggatagggcgtacattcgcccactgcccgcacaccattctcttccagttcaaccaccaccacccgcgcttcattgcggctgccacgcgagatcacaaagggcgtatgcagcggccagttctcttcataaaccttgacggttctcattccgttactcctcaggcgcgatgtggacagtatagtgatgaaaataggtttgccgagttcctgaataatcccgtaaactagccgcgacgttaactatatgtaaacaggaagctatttatgtcacaactcgttcattttcagggcaatccggtcgctgttgccggcaccattccccaggctggcagcaaagcgccggcattcacgctggtggcaaaagatttaacggatgtcacgctgggccagttcgcgggcaaacgcaaagtactgaatgtcttcccgagcattgataccggcgtctgcgccgcgtccgtgcgcaaattcaaccagctcgccaccgagatgaaagacaccgttgtgctgtgcatctctgcggatctgccgttcgcccattcccgtttttgcggcgcggaaggtctgagcaacgtcatcaccctttccaccctgcgtaatgcagagttcctggaaaactacggtatcggcatcaccgaaggcgcactgaaaggcctggcggcccgtgcagttgtggtgatcgacgagaacgacaccgtgctgttcagcgagctggtgaacgaaatcaccaacgaaccgaattacgacgccgcgctggctgcgctgaaagcgtaatttcaggttagttcgcccggcggcgcaggcttgccgggcttatccattacacccggcactcatttcccgcttactcctcgcccttcttctggcttaagccgtattcccgcagcttattggcaatcgccgtatgggatacgccaaggcgtttcgccagtttgcgcgtgctcggatagctccggtagagctgcgtcagcactgaacgctcaaagcggctggtgatgtcatccagcgagccttccatcgcctcttcgcccacggccaggctaccggcgtcataatcgggcagcaaaatatcctgcgaccgtaattcatagccttccagttgcgtcagcgcgcgataaatggcgtttttaagctgacgaacgttgcccggccagccatagcgcatcagcactgtattcagctcagcggacagtttcgggcgcggcacgccctgctcatcggcaaaacgcgccacgaaaagttcggtcaacggcatgatatcctgcggacgatcgcgcagcggcggcagattgagcgtcagcacgttcagacgataatagagatcttcccggaacaaccctttctgcaccagttccacgaggtttttctgcgtcgcgcaaattacccgcacatccacatgcacctcatgatcttccccgacgcggcggaacgtgccgtcgttaaggaagcgcagcagtttgacctgcatgcgcggcgacatttcgccgatctcatccagcagcaccgagccgccgtttgcctgctcgaagaagccttttttgccttccggcgcgtgaccaaagagttcgctttccaccgcatcctccggaatggaggcgcagtttaaggccagataaggcttagcagcgcgcgggctggcaagatgacaggcgtgcgccagcaaatctttgccggtaccggtatcgccgacgatcagcagcggcgcggtaagcatcgccagtttgcgggcctgatccaccacctgacgcattttcgggctgacggcgacgatctggctgaaggcgctgacgtcctgggtggtcatattttgcagctggcggcccatacggatggtcgaacgcagcatcaccaccgcgccggtcagcaccggcgtccccgcttcgccttccagatgcaccggggtgatttccatcaggaaattttgcccgttgatcaccacatgttcgttgtgggacgcctgcggattcccctccagccagcgctggaagttaaaaccagggataagttgcatcgcggtatggttgcgcagctttgcctgctcaagcgcgaacagctggcaactggccgggttcgccagctccactttgcatttcatatcgaccgagagcactggctccggcagcgcttccagtaaggcgctgagcgccagatgttcacgctccgacggcatccacagtacggtgcgcacgtcggtgacgcccgcgatacggcggatctccgccatcaggctgctgaaggtggtgaactccagttcagcaaaattaaggtagatgcgaccgatagggtcgatttcgataccgcgcagatctatgccgcgtaataccagcagatcgagcagctcgcgggccagaccaaggcggtcttcacaaaacacttccagacgcatgagggcttcaccctgaatagttaacgtatgatgaaatgataagccacttattggctggcaggaagctgtctgtcaacaaatattgacagcctgacggaaaaacaggcactcaggcgtaaagttataggttcagggcatgttctgcgtcagctcacgggccagcgcgaggaaggccgccagccccgccgagggatgacgccgtccaggataatagagacacaatccgggaaacggcggcgtccactcctccagcaggcgcaccagccgtccggcgcgcaggtcatcaataatgtcctgttccagaaagaagccgatgccgacatcctgcaataccgccgcccgcaccagcgaggcctcgtccagcgttagcggcccgcgcacctccggcagcacgacctcgccctgcttttccagatgccagcgatacagagatccatcgggtaaacgtacccgaatacaggagtgcgccagtaaatccatgggtttgaggggacggggatgtcgggccagataggcgggggacgccaccaccgcaaagcgctgcggttgccccagcgagacggcaatcatatcagcggggatcaaatcggcgacgcgcacgccaatatcaaagccttccgccacaatgtcgacgagtttgccttcggtgaccagatccacatgcatctccggaaagcggcgcaaaaactccagcacaatgttgttgagcagcgtacgggcggcaaagggcggcgcgttaatgcgcaacacgcccgtcggggtttcccgccgggagcgcaccgcgtccagcgcgtcatgcacgccctgcaatgacggtcccatgcgctcaataaaaagatgcccggcatcggtcagcgccacgctgcgggtagtgcgattaaacagccgcacaccaagagtggcctcgaattttgccaccatatgactcagtgccgtggtggatacgcccagttcaatagccgccgcccggaatgttccccggcgggcaatagccatcactgcgtccagatctgacagtgcaatacgtgacattatcccgctcctttcatcacggcatcccggtttgtcccgattgtttaaattataaagccttcttaaagtgaacggacacactacaggagaaaaacgtatgcatgattttctggcactgactgacaaacgcgtcctgatcacctctggcactaaaggcgcaggcgcggctaccgtagcgctgtttcgcgagctgggcgcgcaggtgatgacctgcgcccgccatcatccggacgaccaggcgagcgatctgtttgtcgccgccgatctcaccaccgaagcgggctgcgcccggctggcagaggcggtgcagcaacggctggggggcgtggacgtcatcgtgcatatgctgggcggctcctcatcgccagccggagggtttgcagcgcttgacgacgcgcaatggcagcgggagctggcgctcaatcttttccctgccgtccggctggatcgtctgctggcgccgggcatggtgagtcagggcagcggtgtgatcgttcatgtttcgtctattcagcgcacattgccattaccggaggccaccaccgcttacgccgctgcgaaagctgcgctgtctgtctacagcaaaagtttgtccaaagagatatcgccgaaaggcgtgcgggtagtgagcgtgtcgccggggtggattgaaaccgaagctgctgtacgtctggcggaacggctggcaatgcaggcaggaactgattatgacggcggtaaaaaaatcattatggatgcgctggggggtattccgctgggacgtccgacgcggccgggggaagtcgcgagcctgattgcgttcctggcctccgatcgcgccgccgccattaacggcaccgagtacgttattgacggcggcaccatcccgacggcgtaaatcaggccgccgttttccccttttgcagcgtctctttcatctggctgattaactggcggcggaaatcgccaaggcgcggtttgtcatcgtcgatccacggtagcgggcggcacagttccatcgctttaatacccagacgcgccgtgagtaaccccgcgccgatcccctgcgcggcacgggcggaaagccgcgccgccagatcctgcgacacccagtccatgccaacttcccgcaccagttcactggccccggcgaaggcgatattcaacagcaccaggcggaacaggcgcagacggctgtaataccccagctcaatgccgtacagccgtgcgatgcggttgatcagccggatattgcgccaggcgataaacgccatgtccaccagcgccagcgggctgacggcgatcatcagggtggattccgccgccgagcggctgatctcccgccgcgcctgggcatcaagcaccggctgcaccagatgggcatacagggtgacgatctcgcgatcgctctgggtttcatgaatggcggcgtaccagcgctggagcgccggatgggatttatcaatgcccgcctgctgcgccagtttttcgcagaaagcccggcccctgcccgcgccgtggctgtgcagcagatcgcgcgcttcatcccgctcctgcgcccgctcgcgcagccgccacagccgatgccattcagtggccaccgatccgacgccggcaccgataatcagcgcgccggcggcacagccgccgagcgacacccagtcctgcgtctgccaggcatgcattgtccactgtacgccctggccgaccacgcttgcgccgaacagcgccagaccggccattaccattttacgccacaggctgcggcgcggacgcagcgccgcgtcgatcaccgcttccggtttgtcatccacgagtagcgtgtcatcggtgacggctggggcgaaattatcggcttccggcccggcaaacgtctgcgcggttttgaacgtctcagcctgctctgattccagcggaccggcaaagtcgatgcgcggttttaaaggttcattcatcgcagtttatctcctattaaaaactccagcgccgcatccagacggatatgcggcagcggtttgtccacatccatgacctgcgggcgaaacgcctcaaactgaaagccctgcttttcccagaacgcctgtcccggcagccgcgccgggacttcgccgggatagaccgtcagcggcgcgccatcgcttaaccggttgccgcgcagggcgggaattttctcgcccttgacgtcaatcagcccgctttgcgtcgcctgtacggcggcaagccccatgcagtccatgctgatgccttcaaaggcggcgttttgccaggcgtcctggatcagctgctgcaacagcgacaccatattggcgtgctggtcgagggtcacatggtcggctttggtggcggcgaacaggagtttgtcgatcaccggcgagaacagacggcggaacagcgtgcgctgtccgtaatgaaaactctgcattaactgcgtgagcgcgaggcgcatatcgttaaacgcctgcggcccgctgttcagcggttgcagacagtcgaccagcacgatttgccggtcaaagcgcaggaagtaatttttataaaatcctttaaccactttttcgcagtagtagttgaagcgctcgcgcagcataccggcgttggtgcttttatccgcctgcgccagtttcgcttcgccgctggcgtccacgtccggccacggaaagaattgcagcgcgggggcacccgccatatcgccgggcagcacaaaacgtcccggctgaataaaatgcagcccttgctgtttgcactggtgcagatagtcggtccaggcggcggcgatttccgccaggcggttttcatcggcgggcgccagcggatcgagaccgtcgcacagttgccgccagcgggcagaccactcttttctgtgaccctgtaacaaaccggtcatttgtcgcgaccaggtcaggtaatcctgcgccagcatcggcagatccagcagccattcccccggataatcgacgatttccagatacagcgtggacgtgtctttaaaatggcgcagcagggagtcattagaacgatagcgcagcgcaaggcgcatctcactgacaccgcgcgtcggcgtcggccagtccggcggcgtgccgtaaagctgggagatgccttcatcataggtgaagcgctgaatgccaaaatcccgctgcggcacccgtttcacgccaagcagccgttcttcacgcacggcgctgagcagcggcagacgcgcgccgttgtgaacatttaacagctgattgaccatagcggttataaaagcggttttcccgctgcggctaagaccggtaaccgccagccgcaaatggcgatccacgccgcgatttaccagagcactgaattctttttttattctgttcataagcatccaggttgcatgagggatccagaacgtacagatcagaaggtttcactacatgagaggcagtatgccattaaaaacgggggaattgagaggtcgggatgaaaggcttcaccccgacaaaagccgtcaacgaacgggtttaacaggtttgttgttaaaacgggcggaaactttgcgcgccatgcgtgacagcaaaggttccagcaccagcgccaacaacatttttgccggacgacgggcaacggatttcaccgcccaccctgccacaccggccggaccgtaacgcagcgctgtcaacagcaccagttttccggcgattttcagaccgggtttcattttttgtcctgcctgttgccaattacgcgccatcagaaacctcattcgttaaacagttaattatagctggcgaaaacggctgcgcagggagaaggtgtcagaggtgacatagcgctccatgtcgcgcagacgcttctcgcccgcggccagctcggcatcgaccgcatccagcaattcgccgctggtgggcaccgcctcgccgtcggccagattatccggcatcgggtcaagcatgaatgtcatgatgatgtaggccaccaccacaaagaaaaacagcccgaaaaacatcgccagcacggtgatcaggcgaaccagtttgaccggcacgtcgaagtagtgcgccacgccggcgcagacccctttcaccatgccctgctgcggcatacgccagagctttttattcagatctaatccagccatcagcgatccctccagttcggatgttcagcatccaggatagattccagcgcctggatacgttcgcgcatacgttgtgcgtcggcattcaactgcgccaggcgttgctgttcgctttgcgacagcgcgttgcgggacgaccggttgttgtaatgcagccacagccagatgggcagcacgaacaaaataaacagcgtcaggggaatagccagaaacagcgcgctcatgtgtactccttacaggtgaggtgaaggcgcgctcaggcgccttgtcattattattgaagatcctgcttcattttcgctttcagctgttccagctgctcgctgatggcgtcgtcggctttcagttccgcaaactcctgatccagcgatttctgcttaccgaaagcatggctttccgcctcggcttccatatggtcgatacgacgctcgaaagattcaaaacgcgccatcgcttcgtcgattttgccgctgtcgagctgacggcgcacatcacgggacgagctggccgcctggtggcgcagcgtcagcgcctgctggcgggcgcgggtttcgctgagtttgttctcaagctcgccgatctctttcttcatgcgcaccagcgtatcatccaccagcgtcacttcatgttcgagggtggcgatcacgtcagttaatttctgtttttcgatcagcgccgcacgggccagatcgtctttttctttacgcagcgccagttccgctttttcctgccactctgcctgctgggcggtggcctgttcaatacggcgtgacagctgtttcttttcagccagcgcacgggctgaggtggagcgtacttcgaccagcgtgtcctccatttcctggatcatcagacgcactaatttttgcgggtcttcagccttctcaagcagtgagttgatgttggcgttcacgatgtcggcgaaacgagaaaaaatacccataattcagtcctcatattttctgttatcgggccaggccctgctgattgagtaatacaattcccgtgccagctttttatgttaatgataataaaggaaatgattaattttaccgcagcggtgaaatgggttagagtggtgaaatacaccaaccagtggcgaatttcatcatggcggaatacagagataatcttcttggcgaagcaaacagctttatcgatgtgctggagcaggtttcccgtctggcgccgctgaataaaccggtgttgatcatcggcgagcgcggtaccggcaaggagctgatagccaaccgcctgcactttctctcttcccgctgggacgggccctttatttcgcttaactgcgccgcgctgaatgaaaatctgctggataccgagctgttcggccatgaagccggggcttttaccggcgcgcagaaacgccatccgggacgctttgaacgcgccgacggcggcacgctgtttctcgatgagctggcgaccgcgccaatgctggtgcaggaaaaactgctgcgcgtgatcgaatacggcgagctggagcgcgtcggcggcagccgtccgttacaggtgaacgtgcggctggtgtgtgccactaacgccgatttaccgcagatggtggagaatgaaaccttccgcgccgacctgctcgaccggctggcctttgatgtggtgcagttgccgccgctgcgcgaacggcaaagcgacatcatgctgatggccgatcactttgccattcagatgtgccgcgagctggggctgccgctgtttccgggctttaccgaacgcgcccgcgacacgctgctgggctaccgctggccggggaatattcgtgaactgaaaaacgttgtcgagcgctcggtgtaccgccacggcagcagcgatacgccccttgacgagataattatcgatccctttcaccgcgccccgtcgccggtcaggtcaacgacggatagcgaagcgctgcccgccctgccgctggatctgcggcagtttcagcaatcccaggagaaagcgctgctggaaagcagcctgcaacaggcgaaatttaatcagaaacgcgcggcggaactgctgggactgacttaccaccagctgcgcgcgctgctgaaaaagcacgcgctgtaagggctattttttattcatcatcgctttcagatcggcgaaaggattatatttcgcctcgccgacatctttctgcgcatcttccccggcgatcaccgttgagccgtactgatccgcctcggtgtatttcgagtgctcatgatcgtggcaatacaggcacaacagctcccagttgctgccgtccggcgggttattggtatgatcgtgatcgatatggtgcaccgttaactcacgcaagtttgagtagacaaattcgcgtgagcaccggccgcacacccacggatagatttttaacgcacgttcccggtaatccacttccaggcgggcatagttcttcggaataatagccatcgcggcaatccttttggtcacagagatagaccaccataatatcaggcgggggcgtgtttgcggcaaatatcccgcacaaactcccgcagccagcgatgaccggcatcggcttccatacggggatgccacatctgggaaatggtgatcgggcgggtttctaccggcagcgtaaaggtatgcagccttgccgcctgctgatggatcagaaaagaggccggcaccagcgccaccagatcggacgcctgggccaccgccaccgccgccggaaagccgggcacgacggctgcgatatggcgttccaggccaagcgccgccagcgcttcatccaccggcccgcccgccttgccgcgccgtgacgccaccacgtggccgtgggcgatatactcttccacgctgacttccggcatcgcggccagcggatgcccgtgtctgaccacgccgacaaaacgatcgcggaacagcgcctgaatgcggatctccggtcccatatcaccaagcacgccgatttccagatcaatctgcccttcccgcagcggcgcggcgtttttcgcaagcttaggcgcaaagcacaatcgtacctgcggggcctgttgtgcggcggcgacaatcagttttggcccgaacgcctccacaaagccgtcgttagcccgcagggtaaaggtgcggcggtaagtggttaaatcgagcttctccgccgccggacgcagcacggccagcgcatcaaacaccgtctgccgggtgcgctcgcgcaccgcaccggcatagggcgtcagcaccatatggcgtccggcgcgcaccagcagcggatcgccggtcaccgtccgcaggcggctgagggtgcggctcatcgcagattcactgaggccaagccgccgggccgcccccgccacgctggcttccgccagcagcgcatcaagggcgatcagcaagttcagatccggttggttcatgtcagcctttccttatttccccgctcatcaatcgcactataacaggcgtccggtgcaggttataactgcaattgctgcgtcttccgccgggtgtggtacgccggtaggctgtcagcagatgacaatgcgcttaacaaggtgaatatgatggaactcttttctgacaaagcgggcgacgaaggcttacccggacgcccgcgtgcgctggcaatggcggcggtgatgacctccaccaccatggcggtgtttgacggatcaatggtgaatatcgccctgccgcagatcgccgctgcgcttaaggttgctgccccggcggcggtgtgggtggcgaacggttatttgctggcggcggcgatgacgctggcgattttcgccgcgctggcgaaccgctttggttttcgtctgctgtttgcctgtgggcttggcctgtttacggtggcctcgctgggatgcaccctgtcctcctccctgacggcgctgaccagctggcgtattgtgcaggggatcggcggggccgcgaccctgagcatcgcgcctgcgatcctgcgctccatctttcccgaccggctgctcggccgcattcttgggctgcatgcgttgctcatcgccgccagcaccgcgctggccccgctgcttggcggcacgctgctggcgacgctgagctggcgctggctgtttgccgttaatctgccgctcggcgtgatggccctggcgttaaccctgcgaacgatccccggcaaaaaagcgccgcagcgcgaaccctttgacgccgcgggcgcgctgctgtcggcgataatgctcggcgcgctgatcatgaccgccagcacctttgcccggccggagaaagacgacggtatgctgataaccgccctggcatacggactgctcgccattgtcgcaggcgtgctgttcgtctggcggcaacagcgggcgccaaaaccgctgctgccgctggcgatgttctcatcaatgcgtttttctctggcggcgctcacctcgctggcgtcttttgtcagccaggggatgacctttgtcgcgctgccgtttttattccagagcctctatggttacagcgcctttgaatcggcgctgctgtttaccccctggccgctgggcatcattctggccgcgccgcacgccggacgttttgcagatcgccattcccccgcgctgatctccaccgtcgggctgtgcgtgtttgccgcaggactggtcctgctggcgctgttgtcggatcacgccccgatgtgggacatcggcgtgcgcagttttgtgtgtggcctgggatttggctgttttcagagcccgaacaaccgggaaatgctggcgaacgtctcgcgggagaacagcggctatgcctcaggcgtactggcgatagtgcgtaccttcggacaatgtatgggcgcggcgctggtcggcgtgctgctgtcgctgtccggtgatgcgctggcggtacacctgagtttgtgggtggcggcgatggcgacggcagtggcgctgctgttcagcgtcagccgcctgcgaaagtgacgcgtttgatgacttttccgccagttatccgcagacatttttacgcggcggcgttaagtgcgatacactttgcagatcagtcttaaaaccaaagaaattatgcgcctaattttatcgtctctgctgatgagcgccggtctgttaagcggactggcgcagggcgagcctgtgccgcccgccgcccgcgatattcgtgacagcggctttgtgtactgcgtgaacggtcaggtgaacacctttaacccgcaaaaagccagcagcggcctgattgtcgataccctcgccgcccagctgtacgatcgcctgctggatgtcgatccttacacctaccggctggtgccggagctggcggaaagctgggaagtgctggacaacggcgcaacttaccgttttcgtctgcgcaacgacgtgtccttccagaccaccgcgtggtttaaacccacccgtaagctgaatgcggacgatgtgacctttaccttccagcgtattttcgaccgcaaacatccgtggcataacattaacggcagcagcttcccctatttcgacagcctgcaattcgccgataccgtggagagcgtgcgcaaaatcgacaaccgcaccgtggagtttcgtctgcgccagccggatgcgtctttcctctggcatctggcgacccattacgcgtcggtgatgtcggcagagtacgccgcggatctggcgaagaacgaccatcaggagctactggatcgtcagccggtcggcaccggcccgttccagctcggcgattaccgcgccgggcagtatattcggttacaacgtcacgaacgattctggcgtggcacgccgctgatgccgcaggtggtggtcgatctcggctccggcggcaccggacggttatccaaactgctgaccggcgaatgcgatgtgctggcctggcccgccgccagccagcttaccagcctgcgcgacgatccgcgtctgcgcctgacgctgcgccccggcatgaacatcgcttatctggcgtttaataccgacaagccgccgctgaataatccgcaggtgcgccacgcgctggcgctggcgattaataatcagcggctgatgcagtctatttactatggcaccgccgaaaccgctgcgtcgattttgccccgcgcctcctgggcctatgataacgaagcgaaaattaccgaatacaatcccgatgaagcgcgcgcacggcttaaagcgctgggactggaaaacatgacccttgagctgtgggtgccgaccagctcccaggcctggaaccccagccccctgaaaacggcggagctgatccaggcggatatggcgcaggtgggcgtaacggtgaagatcgtgccggtagagggccgttttcaggaagcgcgcctgatggacatgaatcatgatctcaccctttccggctggtcaacggacagtaacgatccggacagtttcttccgtccgctgttgagctgcgcggcgatcgaatcgcagaccaacttcgcccactggtgccaccgtgaattcgataacgtgttgcaaaaagccctgcgttcgcagcagctggcgtcgcgcattgaggcttacgacgaggcgcaaaccattctcgcccgtgaactgccggtgctgccgctggcctcatcgctgcgtttgcaggcctatcggtacgatatgaaaggcctggtgttgagtccctttggtaacgcctcttttgcgggcgtgtcgcgtgaaaaagagcattctgaggataaacagccatgatcatttttacgctgcggcgcatacttctgctgatggtcacgctgtttttgctgacctttgtcgccttcagcctgagctattttacgccccatgcgccgctgtcaggggcgtcgctgtggaacgcctgggcgttctggtttaacggcgtgctgcactgggacttcggcgtctccagcattaacggccagctgatttccgaacagttaaaagatgtgtttccggccaccatggagctgtgcattctggccttcacctttgcgctggtgctcggcattcccgtcggtatgctggcgggaatttcgcgcaataaatggcaggataaatttatcagcgcgctggcgctgctcggcttttccattccggtgttctggctggcgctgctgctgacgctgtttttctcgctcacccttggctggctgccggtgtccggacgctttgatctgctgtatgaagtgaaaaccgtgaccggctttgccattatcgacgcctggctgtcggattcgccctggcgcgatgagatgatcgtgagcgccctgcgccatatggtgctgccagtgctgacgctggcggtggctccgaccacagaagtgatccgcctgatgcgcatcagcaccatcgatgtgtttgagcagaattatattaaagccgcggccacgcgcggcgtgtcgcggctgacgattttgcgccgccatgtgctgcacaacgccctgccgccagtgatcccgcgtctcggtttgcagttctccactatgctgacgctggcgatgatcactgaaatggtgttcagctggccggggctgggacgctggatgatcaacgctatccgccagcaggattacgcggcgatttccgcaggcgtaatggtgattggcgcactggtgatcatcgtgaacgtgatttctgacattgtgggcgcgctggcgaaccccttgaaacataaggaatggtatgccctccgataacgtctacagcgaaaagcgcgcccccggcgcgctgcgcaacgtctggcgcaaattttacagcgataccgccgcgatggtcggtctgtacggctgcgcaggtctgatgctgctgtgcctgtttggcgcctggtttgcgccttatggcatcgatcagcagttcctgggctatcagctgctgccgccgtcctggtcgcgctacggtgaagtgtcgtttttccttggcactgacgatctggggcgtgatgtattgagccgtctgctcagcggcgcggccccgacggtgggcggcgcgtttctggtgaccctcgcggcaaccctgtgcgggctggtgctgggcgtggtcgccggagcgacgcacgggctacgctcggcggtactgaatcatattctggatacgctgctgtcgatcccttcgctgctgctggcaatcattgtggtagccttttccggcccacacctcagccacgcgatgtttgccgtctggctggcgctgctaccgcgcatggtgcgctcggtctacagtctggtgcatgatgagctggaaaaagagtatgtggttgccgcccgtctggatggcgcgacgacaatgaacattttgtggttcgccgtgctgccgaatatgaccgccgggctggtgacggaaattacccgcgccctgtcgatggccattctggatattgcggcgctgggctttctcgatctgggggcgcaactgccctccccggaatggggcgcaatgcttggcgacgcgctggagctgatttatgtcgcgccctggacagtaatgctgccgggcgtggcgatcatgctgagcgtcttgctggttaacctgctgggcgacgggatccgtcgtgcggtcaatgcgggggtggaataatgccgttactcgatattcgtaatctgaccattgaggtcaaaattggcgagcagtgggttcgcgccgttgaccgggtgagcattacgctggccgaaggggagatccgcgggctggtgggcgaatccggctccggcaaaagcctggtcgcgaaggcgatttgcggcgtcaacaaagataactggcgcgtcaccgccgaccgtatgcgttttgacgacatcgatctgatgcgcctctccgtgcgcgagcggcgtaagctgctcggccataacgtgtcgatgatcttccaggagccgcagtcctgtctcgatccttccgagcgcgtcggcaaacagctaatgcagaatatctccggctggacctataaaggccgctggtggcagcgtttcggctggcgcaaacgccgcgccatcgagctgctgcaccgggtgggcattaaagatcataaagacgcgatgcgcagcttcccctacgagctgaccgaaggcgagtgccagaaagtgatgatcgccattgcgctggccaaccagccgcgtctgctgatcgccgatgagccgaccaacgccatggagccaaccacccaggcgcagattttccgcctgctgtcccggcttaatcagaacaataacaccaccattttgttgatcagccatgacctgcaaatgctgagccagtgggccgatcgcattaacgtgatgtactgcggccagacggtggaaaccgcgccgagcgaggatttgatcagcacgccgcatcatccttatacccaggcgctgatccgcgccattccggattttggcagcccgatgccgcacaaaagccgtctaaacaccctgccgggagccattccgttgcttgaacagttaccgataggctgccgtctggggccgcgctgcccctatgcgcagcgcaaatgtatcgatacgccgcgtctcgcggggcctaaaaaccatcttttcgcctgtcattttcccctgaatatggagcgcgaataagatgccggaaacgctgcttgaagtgcataacctgagcaaaaccttccgctaccgcaccggctggttccgccgtcagacgctggaggcggtaaaaccgctcagctttaccctgcgcgagaaacagacgctggcgattattggcgagaacggctccggcaaatcgacgctggcaaaaatgctggtgggcatgaccgagccgaccaccggcgagctgcgcatcaacgatcatcctctgcactatggcgattactcgttccgcagccagcgcatccgtatgatttttcaggatccctccacctcgctgaatccgcgttcgcgcgtttcgcagatcctcgattttccgctgcggctgaacaccgatctgacgccggaagcgcgccgcaagcgcatcgccgaaacgctgcgcatggtcgggctgctgccggatcacgtcagctactatccccacatgctggcccccggccagaaacagcgtctggggctggcgcgcgcgctgatcctgcgtccgcaggtcattattgccgatgaagcgctggcctcgctggacatgtcgatgcgctcgcagctgattaatctgatgctggagttacaggaaaaacagggtatttcatatatttatgttacccagcatatcggcatgatgaagcatatcagcgaccaggtgctggtaatgcaccagggtgaagtggtggagcgcggcagcaccgccgacgtgctggcgtcgccgctgcatgagctgacccggcgcttgattgccgggcattttggcgaagccttaaccgctgacgcctggcgtaaagatgtctgacctgtggcgcagcagcgtaccgcgggaaaaataacgtgacagatcccattgtcagtgggatataatttaccgttagtgttgaataattgtgacttaataatcgtaacctgatgattattaagtcataaaatgagcagaaactataaggattcaaaactatgggttttcttaccggtaaacgcattctgattactggcgttgccagtaaactctccattgcctggggtatcgcacaggcaatgcatcgcgaaggcgcagagctggcctttacctaccagaacgacaagctgaaaagccgtgtcgaagggttcgccgctgacctgggctccagcctggtgcttccgtgcgacgtagcggaagatgagagcatcgaagcgctgtttaccgaactggctaaaagctggccgaaattcgacggtttcgtacactccatcggtttcgcaccgggcgatcagctggatggcgactacgtgaacgccgtaacccgtgatggttttaaaatcgcgcacgacatcagctcctacagctttgtggccatggcaaaagcctgtcgcgcaatgctgaacccgaactccgccctgctgaccctctcctacctgggcgcagagcgcgctatcccgaactacaacgtgatgggtctggcaaaagcgtctctggaagcgaacgtgcgttacatggcgaacgctatgggcccggaaggcgtgcgcgtaaacgccatctctgccggtccgatccgcaccctggcggcgtctggtattaaagacttccgtaaaatgctggctcattgcgaagcggtcaccccgatccgtcgcactgtgaccatcgaagatgtgggcaacagcgccgctttcctgtgctctgacctctccggcggtatttcgggtgaagtggttcacgttgacggcggcttcagcatcgccgcgatgaacgagctggaactgaaataatccccctgacgccccttccgcccggagggggtgttttccccgttatgcctttctgatctttgttatcacccaacaatatttcatcctccttcccgcttacgccaggataatgctgcgaaaaagatccggcgcatcctgatgtcacgtctccggatcgtcactttcagatcaaggaacgctcatggaacaacgccgtttttccggcaaaggtcactggtatcatgaaacccagtcgagtaccggccagactcccgcgctaccattagttcccgaagccgccaccgttaacgaccgctttttgctggatttaccgctgacgaacgacatgcttgccgcctgtgactcctggctacgcccggcacgcaatctgtgcgcccgtctgtttccgcagcaggtagccgtgagccgcctgcgcacctttaccgcttacgaccgcctcagcacggcgctgaccgcagcccaggtgtatggcgtccagcggctgtgcaatcactatgccgcacgcctcgcgccgctcaatggcccggatccctcacgggaaagtaaccgccgtctggcgcaaatcacccagtacgcccggcagctcgccagctcgccggaggtgattgataaccgcgcccggcagcagcttgatgaggttggcctgacctgcgacgacattattttgatggatcagatcatcggctttatcggttttcaggcgcgcgtggtcgccgcgtttcaggcgatgcagggcatgccggtgcgctggctgccaggcatggaaatgcaggcctgggctgatgcagaacgctttagcgccggggctgacggctggtccgcggccttcagcggcgtagaactgcgccgcgccagcgcaagccagctggaagcccatgcgcaatggcagacgcagccggagctgcgcgtgctggcggcgtcgctggcccatgagcatgttgtgcttaatgaactcggcgcgatcctggaaagcggcttacgggctgaactccccccggcggtagtgcagctggtggcgcaactgaccgcgcgcattaacggcagcgtggactgttttgcggccagcgcgcaacgcgatgagacgctgcgcaccgcgttgcaggacggtgagcaggcgctgctggcatggagtcaggacgacgcacaaacgcgggcggttattgtcgccgtacaactgctgacccgggcggcggatcgctttagcgccgcgcagtttattccgcttactgagcagggttttaccacccatcaggcgttctcgctgctggcgtggagcgggttatgcggctggttgaaccgtctgaaaatcgcgctgggtgagcgccagtaacgcgaaagagcgcttgctgcgccccccgtattcgcgtaaaactgtcagccgctcttttggccacgaaaatacaaaattatgttccaggacaacccgctgcttgctcagctaaaacagcaattacattctaagacgcctcgcgcggaaggcgtcgtcaaagccacggaaaaaggctttggtttcctcgaagttgatgcgcagaaaagctatttcattccgccgccgcagatgaaaaaagtgatgcatggcgaccgtattatcgcggtgatccatagcgaaaaagaacgtgaatccgccgagccggaggaactggttgaacctttcctgtcgcgcttcgtcggtaaagtgcagaaaaaagacgatcgtctgtccatcgtccctgaccatcccctgctgaaagacgccatccagtgccgaccggcgcgcggtgtcgagcacaattttgccgatggcgactgggcggttgcagaaatgcgccgtcacccgctgaaaggcgatcgcggcttttatgcagaactgacccagtttattaccttcggcgacgatcatttcgtgccgtggtgggtgacccttgcccgtcacaatctggaaaaagaagcgccgaacggcgtcgctaccgaaatgctggacgagggccttgagcgtgtcgatctgaccgccctggatttcgtcaccattgacagcgccagcaccgaagatatggatgatgccctgtacgccgaagagctggcggatggccgcctgcaactgacggtggccattgccgatccgacagcgtggatagcccaggacagcaagctggacaacatcgctaaagttcgtgctttcactaactatctgccgggctttaacatcccgatgctgccgcgcgagctttctgacgatctctgttcactgcgtccgcagaccctgcgcccggcgctggcctgccgcatgaccatcagcgctgacggcactatcgaagacaatattgaattcttcgccgctaccatcgagtcgaaagccaagctggtgtacgacgagatctctgactggctggaaggcaaagatggctggacgccgccgacggatgccatcgccgcgcagatccgtctgctgcatcgtatctgccttgcccgcgctgaatggcgcaccacccatgcgctggtgtttaaagaccgtccggattaccgctttgtgctgggcgaaaaaggcgaagtgctggacatcgttgccgagccgcgccgcatcgctaaccgcattgttgaagagtcgatgattgccgccaacatctgtgccgcccgcgtgctgcgcgataagctcggtttcggcatctacaacgtacatttagggttcgatccggctaatggcgaagcgctggcggccctgctcagcacccacggtctgcatgtggatgccgaagaagtgctgacgctgaacggcttctgcaagctgcgtcgtgaactggacgcacagccgtctggtttcctcgacagccgcattcgccgcttccagtcttacgcggaaatcagcaccgagccaggcccgcactttggcctcggtcttgaggcctatgccacctggacgtcaccgatccgtaagtacggcgatatgatcaaccatcgtctgctgaaagcgatcatcaaaaatgaaaccatcgcccgtccgcaggacgataccacggtgcagatgaccgaacgccgtcgccttaaccgtatggcggagcgcgatgtcggcgactggctgtatgcccgtttcctgaaagacaaagccggaaccgatacgcgctttgccgcagagatcatcgacatcagccgtggcgggatgcgcgtccgtctggtggataatggcgcggtggcctttattcccgccccgttcatccatgcggtgcgcgacgaaatggtatgcagccaggaaagcggtaccgtgcagatcaaaggcgagacggtgtataaagtcactgatgtgattgatgtgaccatcgccgaggtgcgtatggaaacccgtagcgtgatcgcccgacctgtggcataaaagccgaacggtatataaaccggtctcgctgttctggcgagaccgttactctctcctgacgtctgccgcgctacgtcaaaattccggattttttcccccacatttggctaaaaacagccacacttagttatgcacttttacgcatgaaaagtcgttcagaacaagagtttagcaatagatatgcaatttgttagccacgctttattataagaatgcgaatggaaaacagtaagttcaacctgctcctgtggagagtcagtgtgaaaacttcaccgttataaggttctgttgcgctttgggtggaatgggagactgcatgaaagacgatgtggagcaaaatttgctgtttcgttaccttgggaccaccagccctttctggcgtctcaccgctgacagcaacgcacttcatcttgccgcgagtgaaaccgcagacatcagccaggtgtttgcgctgagcgatcatcaggcggatacgatccgtgaaatgacggtgattaccaccagtttgaccatgaccatttccatgtttggcgatgacgtgccgctgcatctggtgggccgcaagatatcgaaaaaagagtgggcgggtacggcgtcttcctggaatgatacttcctccgtagcccgtgatttggtgcaggggttgtcctttgcggaacaggtggtatccgaagccaattcggtcattgtgatccttgatcgacacggcaacatccagcgctttaaccggctatctgaagaatatacagggatgcgcgagcaggaagttatcgggcagaacgtttttaaattatttatgagccgcagcgaggcgctcgcctcaaagcgtaatatcagcgagtttttccgcaacggcagttcctatgaagtggagcgctggatcaagacgcgcaaaggccagcgactgtttttgtttcgcaataaatttgtgcacagcggcagcggcaaaaacgaaattttcctgatttgttccggcaccgacattaccgaagagcgccgggctcaggagcggctgcgcgtactggccaacaccgacaccattaccggactgccgaaccgcaatgccatccatgaactgatcagcgatgccattgcctgccgcgacgatacgcaggtgggcattgtttatctcgatctggataattttaaaaaggtgaacgatgcctacgggcatatgtttggcgatcagctgttacaggcggtgtcgctggcgattttaagctgcctggaagaaggccaggtgctggcgcgtctgggcggcgatgagtttatcgtgctggcgacgaattcgtcgcagagtacgctggaagccatggcctcgcgtattctgacgcgcctgcgccagccgttccgcatcgggcttatcgaagtctataccggttgttcgctggggatttcccttgcgccgcagcacggcaacgatcgcgagagcgtgatccgcaacgcggataccgcgatgtatactgccaaagagagcggccgcggtaagttctgcgtcttctcaccagaaatgaatcagcgggtatttgaatacctgtggctggataccaatctgcgtaaggcgctggagaacgatcagctgctgatccactatcagccgaaaatgacctggcgcggcgagatccgcagcctggaggcgctggtgcgctggcagtcgccggagcgcggcttaattggccccatggagtttatctcttatgccgaggagtccgggctgattgtgccgctgggacgttgggtcatgctcaacgtggtgcagcaggtggcgaagtggcgcgacaagggcattcatttgcgcgtggcggtgaacgtttcggcccgtcagctggcggatcagactattttcagcgatctgaaacaggcgctgagcgatctcaattttgaatattgtccgatcgacgttgagttaacggaaagctgcctgattgaaaacgaggagctggcgctgtcagtgatccagcagttcagcgcgctgggggcgcaggtgcatctggatgatttcggtaccggctattcgtcgctgtcgcagctggcgcgcttcccgctggatgccattaagctcgatcagtcctttgtgcgtgatgtgcataagcagccaatttcccaatcgctggtacgggccattgtcgctgtggctcaggcgcttaatttgcaggtgattgcggaaggagtggaaagcgccaaagaagacgcctttctcacgaagaatggcgtcaatgaacggcagggttttctctttgctaagcccatgcccgcagccgtattcgagcgatggtataaacgttatctgacgcgcaaagcgcgttagctggctttactcagactggcgacatgccggttttgtaactgcaccagacgttccatgtaggcgatgtctttgggttgcaggcagaacgccgcgtccacccagtcttcggtgatgtccatcagttcactgcgaggcaactgtatgacccgctgacgcgcgcgcagcatggcacggacgccattgagacgcggttgcagcgtatcgatgaaggtgcgcacggcaaccgccccctgccccggttcaaagagttcatccaccaggcctttaggttcgtaccattccgccgtatgggattcgcctttatagatcaactcctcggccagcttcatgcccgaacgccgggcgaccagcgaatatccccccatgccaggaaacaggttaaaggcgatttccgggaagcccaggcgtgcgtcccgctgcgcgagcacaaaatggtgcgccagcgcggcttcaaagccaccgcccagcgcactgccttccaccatcgccagactgatcgccccggtatcgaaaccgcgtgaagcggcgtgcacacagtcgacacaggctcgcgcgtaagcccgtagcgcttcacgacggccattttgcaggcagtcaacgaagaaacccagatcgcctccggcgttataaataccggggaccagtgagcctgttacccaaaaatccaccgcgaaccccgcctgcctgaccagccaggaaatattcatgatctcctcaatcagtccgtgattgaagcatgggcggggttgcgcccgtaacatcatccagaccgtgcgacgttcctcttcgtagtagcctgccagttgggtaaagcgctctgtatcagtgaacaatttgcatgatgcatggttggtaactgtcatggtcttttcctcattaattaaagcgcattgcgcgcagatttagactaatgcaggagcaaaccaggcagtatgtgcgtaagctaatttataattggtacttatgcttttttaagatttccttttttcccttctctttttacactaatttctgcatcattgaatttattaacttttcgatacagggtgacgacatggccgacatcgacgcaaagcaactggcaggacgtattgatacggtgctggacattctggtggcgggtgattaccactccgccatccataatctggaaatcctgaaagacgaattactcgcccttgacgccgccgggcaaatatccccgcagggtgcgccaaaaacaccctgggaaatctgaataagacgctatgaattcccgacaacaaattattctgcaaatggtcattgaccagggccgcgtcagcgtggccgagctggcgaaaacaaccggcgtttctgaagttactatccgtcaggatctgaacaccctggagaagcaaagttatctgcgccgcacccatggctatgccgtgccgctggaaagcgacgatgtggaaacccgcatgatgagtaacttcacccttaagcgcgaactggccgcctttgccgcgtcgctggtgtctcccggtgaaacggtatttatcgaaaacggcagcagcaatgccctgctggcccgcgcgctggccgatgagaaagacatcactattattaccgtcagcgcctacatcgcccatctgttaaaagagacggcctgcgaagtgatcctgctggggggcatttatcagaagagaagcgaaagcatggttggcccgcttacgcgccagtatgttcagcaggtgcatttcagcaaggcgtttattggcattgacggctggcagccggaaacaggctttaccggacgggatatgatgcgggccgatgtagtcaacgcggtactggaaaaaagctgcgaagccattgtgctcactgacagctcaaaattcggcgcggtacatccctatactttagggccaatgggacgatttaaccgggtaattaccgatgaaaaactggatgcagcgcagcaggcgcaattaacgcaatccggactgattgtcgatatagtaaaaaaagcttccgcacaataactcgccagcgcccgccatgcgcgggcttacctttcatctctgagagttttccgacctgtcaattaagactatttacctgtctcgtttagcggcaggaagtaaaattatgttgaacgatataacaggacgtaactatcactcacgtgatctatagtaacacctgcgcaacataatttacggaaatgaacttaagtttgctgaacaggcactatactcatagagaaattctttccgtggatacctatttcaggagattagtatgatgatgttatctggtaaaaaaatggctacagcggtactggcggtaacgctggcaatgtctctgagtgcttgttctaactggtctaaacgcgatcgtaataccgcgattggcgcaggcgcaggcgcactgggcggcgcagtattaaccgacggtagcacactcggcacattaggtggcgcggcagtcggtggtattgtgggtcaccaggtcggtaaataatcgtacaggtgtcgcgcagtacagaatatatactggcgttattgcgtaaattcgcagtgaattaaaaggccacggcatttgccgtggccttatcttatttatccggttaaccgccagccagttttaccttcatacctttggcttccagtaatgatttaatcaggtcgcgtttatcgccctgaatttcaattacgccatccttcactgaaccaccacaaccgcatttctttttaagctccgcggccagacgggcaatttcctcgtcactggcatcaataccagtaatcagacagacgcccttccctttacggccgctggtctgacgctggatacggacaataccgtcacctttcgggcgctcgaccaccggtttgggttcatcgatacgtccactgtcggtggaatagaccagccggctgtttgcatccttcatttaggcctccacacgtaatgaagcattaatggccttcagcgtctgcgccggatcggcagattgcgtaaccggacggcctatgaccatgtaatccacaccggcagcctgcgcctgttccggcgtcataatgcggcgctggtcgccagcatcactgccctgtggacgaatacccggcgtgaccagtttgaaggcctgccccagttcgcttttaaaacgcacggcttcctgtgcagaacagacaacgccgtcaagcccacagttttgcgtcagacgcgccaggcgttcggcatgttccgccggagtgctggtgatccccaaatcatgcaggtcgctcgcttccatgctggtcaggaccgtcacagcaatcagcagcggcgcatctttaccgaaaggcatcaacgcttcacgggccgcactcatcattcgcgccccgccggaggcatgaacgttcaccatccacacgcccagctctgcggcggcggctaccgcatgtgccgtggtattgggaatatcgtggaatttgagatccaggaagacgtcaaagccgcgctgttgcaggtcgcggacaaattgcgggccaaacagcgtgaacatttctttcccgactttcaggcggcaatccgacggggaaatacggtcgacgaaagcaagcgcctgatggcgatcggcgtaatcaagggcaacaaccacaggggaatgcgttacagcggcaaaagaggatgtagcagtagacgtcatgatcagaccttcctgatgatgggcacccgcgcaggcgcaataagaataaacggcgtgcattctacctgcgcgccgttgaaaaggacagaatgcatttttttgctaccaggcgataagggcacgatgtcgcagtagttatgcatgggaacaaaaagtatgttgtaactaaagtgcgggttttttttaatattactgaccatcaaggccacgaatgggcttgacggtggaccacgcgcgacaggacgggcaatgccagtacatggtgaaagcggtaaagccgcatttgtggcagcgatagcgtggcttactgcggatctgctcgcccaccatgtcacgcaacgccatcaggctctctttcgcgcgcccttcttccgcttcctgcaaatggtaatccatcagtttgtggaacacgcgcatggtgggctgacgctggagctgacgcgtcaccagcatttgcgccgtatcctgcccttcacgttgctcgacgatatccgccagcatcagatcggctaccgcgccggtgttctcttccacgcagcgctgaagaaattccgcccactcatcggttttaccggtatgcagatagcaggtttgcagcatctccagcgtttcgctgaccagttctttatcctgatccaccacacgcagcagactttcgatggctttttcgtactcccctttcgccatcagcacgcggcccatcatgatggaaacgcgcgggctgttgcgatcggcagcggctcccttcttcagcagcgccatggcacgatccagatcgtcgttgcccatctgttgtaacgccagctcacagtagaagtgggcgatttcgacacgctgtttatctttacccagcttgaccagacgttcggccacatcaatggctttctgccagtcgctggtcgcctggtaaatttgcagcagttgttgcagcgcgccgatacggaagtcggtttcgtcaaccagctgattgaacatgtcttcagcgcgatcgtacagacccgccgccatgtaatcgcggcccagctgttgtacggccagcagacgctgatcgtaagacagcgaggcgctttccatcagcgtctggtgaatgcggattgcgcggtcaacctcgccacgcgagcggaagaggtttccgagggtgagatgggcctcaacggttccggtatcctcttttaacatatcgaggaacaggtcaaccgctttatcctgttgattactaagcagaaagttaacacccgccacgtaatcacgcgagagtcggtttgcctcatcctgctttgtttgttgcgcgcttctgcgccccatataccagccatacgcggccgctacgggcaacagcagaaacaacaactcaagcatataatgttattccttgacggacggcgtgccggtcgttacgggaacgtcgtttgcgggggcaagctgatgttcaagtcgtttaattttacgttccgcgcgtaccagcgaaacacgcacacgcagccagaacagtccgcataccagccagccaatcacaaagcctgcggcaaacagacacgccagcagcgttgaaatacggaattcaccctgcgccagcaaataattgaatgtgacgagctgatcgttctgtgcacccagcgtgaccgaaatgacaaaaatcgctaacaccagtaagaaaatgagtaaatatttcacattacgtcccgttatgtggattggagcgaataaattctgttcaactgactgcatccagccttataacctaccattttcgcgacctggacgaaatggaaaagcgagtgacctgatggatttgcgggcgaaattcgctatttcaaccccgaatgcgcgttaacccatcaggcccgtcgataatattattcgtcgtcgcggtcggcgatctctttcttctcttcgaccggcggcgttaatggcccgcagatacgctgcgccagcatggtggcgaaggtgacaagcagtccggaaatcagcgtggcgaccaccagatcgcgtggccagtgcattcccaacagcatgcggctgcccatcaccgccgtcgcccacatcagcagcacggcaatagtgatagtgcgccgccgtggccacagcaaacctacgcccagcaacgcccagctggcggcaaacatggtatgccctgacgggaaagcgaaaccggtctctttttgccagtgtttgcgcaagaacgccggaatgttctcttcaccgctcagctgctcttttaccagatgcccgcgatccttacgttttaaagtgtagaactcatcaaccggaatatggtgtgttttttcaagccagatgacaaaaggccgcggctcctgcacccgatccttcacccaggacttcacgccctgcccgattaggatagcggcggcgaggatcacaaaaagcatcagcgcggctttcagacgaaatcgcagacaccataaaaaccagccgcagagcagcacatgggtgatgatcccccagggctgcgtcaccgtttcggttacccagtacagcgccttcagccacgcgctgttgttacctggcgtccactgccagccggatccccatactatcagcggcataatcagtaatatccccacccccgccatggtgcgctttacaatagacagcatgttctctcctttatgtgccaggccgcttaatagtaactgaaaaacaacatcaccggcaggagtgacggatttgtgcgcttaatctttacagcccgttgacgcaattagagaagttggccgccttgtggcaaaatacccccagaatgaaagcctgagggcgacaaggcacgtcaggtgccagaataaatccggagaatcacatgcagcttaaacgtgtggcagaagccaaactgccaaccccatggggcgatttcctgatggtgggttttgaagaactggccaccgggcaggaccatgttgcgctggtctatggcgacatttcaggccagacgccggtgcttgcccgcgtccattcagagtgtctgaccggcgatgccctgttcagtctgcgctgcgactgcggtttccagctggaagcggcgctgtcccatattgccgaagaaggccgcggcatcctgctctatcatcgtcaggaaggccgtaatattgggctgctgaataaaatccgcgcgtatgcgttacaggatcagggttacgacactgtagaagcaaaccaccagctcggctttgccgccgatgagcgtgatttcactttatgcgcggacatgttcaaactactgggcgtggacgaagtgcgtttgctgactaacaacccgcgcaaggtggagatcctcaccgaagcaggcattaatattgttgaacgcgtaccgctgatcgtcggacgcaacccgaaaaacgcgcattaccttgataccaaggccgcgaaaatggggcatttgctggattaataaaaaaagcccggcggtatgtcccgccgggctagcgtgaagggttatcagtgcagcatgttgcggatcacgtaatgcaggatcccgccgtgctggtagtaagtcagctcggttgccgtatcaatacggcagcgacaggaaatcacttcctgcgagccgtcggcgcgggtcaggcgtaccggtaccgtcgcaccaggtttaagtccggtcagatcttccacatccagccgctcttccccgctcagccccagcgttttacgggtcacgccctgcgggaactccagcggcaaaatgcccatgccgatcaggttagaacggtggatacgctcgaaagattcagcgatcaccacgcggatccctaacagacgcgggcctttcgccgcccagtcacggctggagccggaaccgtattctttaccggcaatcaccgccagcggcgtgccctcctgctgataacgcatcgcggcatcataaatggagatcacttcactgcccggcagatggcgcgtcatgcccccttccacaccgggcaccatttcgttgcggatgcggatgttggcgaaggtgccgcgcatcatcacctcgtggttaccgcgtcgtgaaccgtaggagttaaaatcgcggcgctccacgccatggttttgcagatagcgtcccgccgggctgtcggctttaatgctgcccgccggtgagatatggtcagtggtcacagaatcgccgagcatcgccagaatgcgcgcgccctgaatatcctctaccggcttcggctgggcttccatctcctcaaagaatggcgaggagcggatgtaggtggagtcaaactgccagccgtaggtatcggaggcttccactttgatggacttccactcgtcagtcccttcaaacacttccgcatactccttgcggaacatgtcagtggacacctgctctaccgcacgggcgatctcctgtccgctcggccagatatctttcagatacaccggatcgcctttgcgatcgtggcccagcggatcggttgccaggttgatgttcatattgccggccagcgcataggccaccaccagcggcggcgaggccagccagttggttttcaccagcggatgaatacgaccttcaaagttacggttgccggaaagcacggccccgacggtcagatcgccttttttgatcgcctgttcgataggatccggcagcgggccggagttaccgatacaggtggtgcaaccatagcccaccaggttaaagcccagctcatcgagatacggcgtcagacgcgcctgcgccagataatccgataccactttcgagccgggcgccagcgaggctttcacccacggctgacgcttcagcccgagggtgacggcttttttcgccagcagaccggccgccatcagcacgctcgggttcgaggtgttggtacatgaggtaatggctgcgatgaccaccgcgccatctggcagctgatactgatgaccgttcagaacataatccaccggctgacgatctttctgggcggtattgagctccagctcggtgctggccgcaaaggcttttggcacatcgcccagcgccacgcgatcctgcggacgttttggtccggcaaggctggcttcgacgctgctcatgtccagttccagggtactggtaaagacaggttcatcacccggctgacgccacatgccctgcgctttcgcataggcttccaccagcgccacctgatcgtcgctgcggccgctaagacgcatgtactcaagcgtcacgtcatcaatcgggaagaatccgcatgtcgcgccatattccggcgccatattggcgatagtggcccggtccgccagcggcagggagtcgagaccgtcgccataaaactccacaaacttacccaccacgccgtgtttacgcagcatttgcgtcacggttagcacgaggtcagtggcggtgatgccttcgctcagtttaccggtgagcttaaagcccaccacatccgggatcagcatggatacaggctgaccaagcatggcggcttccgcttcgataccgcccacgccccagccaagcacgcccagcccgttgatcatggtagtgtgggagtcggtgccgaccagggtatccggataagcgacccactctttatcctgcagctcgctccagacggccttacccagatattccaggttgacctgatggcagatgccggtgccaggcggcacaacgctgaaccggctgaaggcctgctggccccagcgcagaaacacatagcgttcgtggttacgctccatttccagacggacgttttcttcaaaggcgtcgtcatcgccgaaatggtcgacggtgacagagtggtcgataaccagatcaacaggggaaagcgggttaactttagtggtatcgccaccaaggcgtttcacggcttcacgcatggcggcgagatcaacaacagcgggaacgccggtaaaatcctgcatcagcacgcgggcgggacgataagcgatttcacgatcggcgtgggcggatttcaaccagcctgcgagggcatggatatcctcctcagtgacggactcaccatcctgccagcgcagcaggttttccagtaacacttttaacgacttgggcaaacgggaaatatccccaagttcctttgcggccaggggcaggctgtagtaatggtaggttttgttttcagcctgcaatgtgtccttactggcttcgcgtagggtcgacgacataagctcctccttaatacagggattgcaattccctgattatcatcagggtctgtattaaagataacacaaacatgctgtaacgttttgataacaactcaaattgataaaagaggtaaaaccattgaagggataaaaacaaaaaaccccgcttaagcgaggtttttatgcggttagtgagccatcatccagaccagttgtccccagaacataaccgagacggtgaatgcgcccatccatgaccagtatttgagattatttatcatttatacaccctacgaattaatcaagcgccacaccgggttgttacccgtttctatattgctgaggtgtatttattaagaagtacaaaagaccgctgggcgtcaggctaatttcgcgcccacgctgttggttaaattattgtttttttggttcgtcttctgcgaacgtttcaataaaggcacgctgctgcggggtgagttcccattcgtcaggaatacgcacctcggcgtcctttttggcgctaagaggcttgtcatgtaactgacatactggcttcactgtgccgaactgccccgtaaacaccattctcaaccccaaaatttccacaccagcaaggctacaaccacccagaacagggctgagccaagaaacaccgccagccaggctttgcgtttcagcgcgtgatccctttgcgattcgtcgcttcctgatggcattgctaacctcacacaatcgacatcacttatcattttgacacctaacaataggtataagtaatcactagatgagacaaatcctaaaataagtttaggaaaaaagccagcgaatttaccaatgatttccagttaaatattcaatcttttgaccggaaataaataattgaagaataaaatttgcggacccgtaaattactttctacttttgtcgcgaaaacacgacacaattgcggttaagttgtgacaggaatcactcggggaaatgtgagttaaggcagatgatgataattctgatttaggtttagggcgataaaagggtatcttcccgggcgggaagataccgcaggaaattatttttctggcagcttaatgtcctggaacatggcttcaatatcatcatttgaacgcaatgccaccgcggtatccaccacgtcacgggttaaatgtggtgcgaagcgctgaataaaatcatacatataactgcgcaggaaagtgctgcgacgaaaaccgattttcgtggtgctgtggctgaacacgtcctgtgcgtccagttttaccagatccggatccgataccggatcaaccgccatgctggcgatcacccctaccccaagacccaggcgcacataagttttgatcacgtcagcgtccgtggcggtaaagacgatacgcggcgtcagcccggcgcgattaaaggcggtgtccagctctgaacggccggtaaagccaaaggtataagtaaccagcgggtactgcgccagctcctcaatgctcaccgactgtttgcccgccagcggatgatcgggcgtgacgacaatcgaacgattccagtggtagcacggcagcatgaccagatcgtcatacaggtgcagcgcttcggtggcgatggcgaaatcagcattgcctttggagacggcttccgcaatctgcgtcggcgagccctggtgcatatgcagcgaaacacgtgggtagcgctcaataaagcccttgattacgccgggcagcgcataacgcgcctgggtatgggtggtcgcgacgtagagcgagcctttatccggccaggtatgctctcccgccaccgacttaatggcatcaactttggagagcacttcacgggcgatgcgtatgatctcctcaccggctggcgtgacctgggtaagatgcttgccgctgcgggcgaaaatctggatccccagctcatcttccagcatacggacctgtttgctgatgccgggttgcgaggtgtatagcccctcagcggtagaggagacattaaggttgtgattcaccacctcaacgatataacgaagctgctgtagtttcatgacggaccatccggttgagcgctgacgagcaatcgtttaagacgatttaataataagaaatgacttaactataaccactatatcattaatgcccggtctgtatagacaggaacgcaaaattataagcaacaaaaaagggccggatatccggcccttgcagggagcagacaggctaaattacttcttaccttccacccatttcccgtcgatgaagaaagcagaccagccggtcgctttaccctctttctcggcggaaacatactgctgcttagtcttacggctaaagcgaacgacagttttgttgccttctggatccgcgacaggcgcatcggccagataacgcagtttttccggcagacaatcgcggaagcgatgcagctcttccaccagcggtgcgcgggtttcacgggatttcgggaaggtgttcgccgccaggaatacccctgccgcaccgtcgcgcagtacaaaataggcgtctgatttttcacatggcagctcaggcagcggcaccggatcttctttcggtggcgcgacttcgccgttacgcaggatcttacgcgtgtttttgcattcgtcgttggtgcaggccatgtacttgccgaaacgccccattttcaggtgcatttcagaaccacacttctcacactccacgatcgggccgtcatagcctttgatgcggaattcgccctcttcgatttcatagccgtcgcaggtcgggttgttaccacagacgtgcagcttacgcttgggatcgatcagatagctgtccatagcggtgccgcatttcacgcaacgacgcttagcacgcagggcgttggtttcggcgtcgtcgccttccagcacgttaaggacttcgttttccggcaccaggttaatggtggttttgcagcgttctttcggcggcagcgcatagccggaacagccgaggaacacgccggtgctggcggtacggatacccattttgcgaccgcaggtcggacagtcgatactggtcagcaccatctgattcggacgcatgccgccttcttccggatccttttccgctttttcaagctggccggtgaagtcggtaaagaagttgtccagcacgcctttccattccgcttcatggttggcaacctggtcaaggctgttttccatttgcgcggtgaaatcgtagttcatcagctcgcggaaattctcttccagacggtcagtgacgatttcgcccattttctcggcatagaagcggcggttttctacacgcacgtagccgcgatcctgaatggtcgagatgatagaagcataggtcgacggacgaccgataccgcgtttttccagctctttcaccagggatgcttcgctgaaacgcgcaggcggcttggtaaagtgctgcgccgggagcagttccacaagggataccacatcgcctttgttcaccgccggcagcgtgcgatcttcatcgcccttacgcagctgcggcatcaccttcgtccagccatcgaaacgcagcgtacggccacgcgccttcaggcggaactcgcccgcttccacggtcagggtggtggaatcgtactgcgctggcgtcatctgacaggcgacaaactgacgccagatcagctgatacagcttctgcgcgtccgcttccatatccttcagggactctgccagcaccgccacgtcggaaggacggatggcttcgtgcgcttcctgggagttttctttgctggcgtactgattggcgctttccggcagatattttttaccgaaattatcgctgatatagccacgcaccatgctgacggcgtcctgactcaggttggtggagtcggtacgcatataggtaatgtggcccgcttcgtacagacgctgcgccatcatcatggttttcttcacgccaaagccaaggcgcgtactggccgcctgctgaagcgtggaggtaataaaaggcgcgccaggcttgctgctggtgggcttatcttcccgatccgtaacggtgtagcgcgctttttccagcaggcttaccgccgccatagtctgctcgcgattaaccggacggaaaggcttgtcctgctgatgcgtcacctgcaacggcagcgcatcgccggaaggcgtggtaacgctggcgtcgatttcccagaactcttccgggacaaaggctttgatttcgcgctcacgctcgaccaccagacgcaccgccacggactgaacgcgtccggcagacaggccgcgggcgatctttttccacagcagcggcgacaccatgtaacccaccacgcgatccacaaagcggcgcgcctgttgagcatttacacggtcgatattcagttcacccggcttttcaaacgcctgctggatagcgtttttggtgatttcgttaaacaccacgcggctgtagcgcgagtcatcgcccccgatcacttcccgcaggtgccaggcaatggcttccccttcgcggtcaaggtcggttgcgagatagatatggtccgctttttcagcgatggctttcagttcggcaacgactttttctttgcccggaagcacttcatagcgtgcatcccattcgttccatgggtcaacgcccatgcggttgaccagcgcgccacgttcatcctttttaggctttttggccgttttggtggtggcggagtcggcgctctttttgggtgctgagccactggtcggcagatcgcggatatgaccgacgctggatttcaccacgtagtcattacccagatacttattgatcgttttggcttttgccggggactcaacgatgacgagtgctttacccatattcacctttacctaatttgattcttccaggaatacgtcgcacgttgattcactctccaccgcgacatccgatgatgtggcggcgatatccgtggttatcaacccctctttaaaaccgggcgcgtgaagtgtggtgcccaggtgactgagttcacaggtgttttcgcgcatcagtgctgtagcacgacggacttaaggtcgaatgtcaagcaattctgttgccagattgacgaaagcgcacactctacctgataaaattcgttacgcaactttattagcatgcaaaagcaaatcacgccagccagtccccggtgtgaaaaccattttaaaaacagggaaaatttgcgcctggcccaccggcagacgtagaataaatgccttgtcagaggagcagactatgcacgagaacattcaacctatcgatcgccagtcactattagctgaagctaaccgaatcatccgcgagcatgacgattttattcagggcatcgaagcgacggatgtcactgaacgcaacggcgtgctggtgttcagcggcgactatttccttgatgagcaaggcctgccgacgtcgaaaagtacggcggtgtttaatatgttcaaacacctggcccatgtgctgtccgaaaagtatacccttgcggactgacggcaataaaaaagcgaggtgattcacctcgctttttgttttacagcaacggtttttcaccgcgctgccaccagcgcagcagcaggcggtcagcggcttccgccgcactgccggtaaagcggtccatcagctttttacgctgggcgtaacggatgccgatcacctcgcgctctttaatcagccccagcagcagatcgtcgctggtgcccacttcatccaccagtcctttttccagcgcctgtacgccataccagtgctcgccagtggcgacctggtcgatgtccagcgacggacgcatctgcttcacatactctttaaacagatcgtgcgtctcattcaggctctcacggaacttctgccgcccttcttcggtgttttcacccagcagcgtcaacgtacgcttgtactgcccggcggtgtgcagctcgatgtcgatgtctttgcttttcaggaagcggttaaagttcgggatttgcgccaccacgccgatagagccgacgatggcgaaaggcgcagccacgatcttatcggccacgcaggccatcatatagccgccgctggccgccactttatccaccgccaccgttaaggggatgtttttgtcgcgcaggcgctggagctgggaagacgccagcccgtagccatgcaccacgccgccgggactttccagacgcagcaccacctggtcttccggccctgcgatggtgatcaccgcggtgatctcttcgcgcagggagttcacctcatgggcatccatactgcctttgaaatccagcacaaaaacccgtggcttcgtggccgtaaccggggtgccctgcttcgcgctggccttcgccgctttcgcgtcctgcttcgcttttttcttctgcgctttatgccacagcttttgctggtgatcgtccagcagcgcgacggagacctcctcctgcatctccttatattgttcgctcagcctggtgacacgtaattcaccccgctgacgcttgcgctgggcaagatttacaatcagtaccgccacgacaacaatcgccagcacaacggtggcaatctttgccaaaaacaacccatattcagacagtaattccacgcgtaccaccttggttaaaccgcattacgttcgcattcagtgtacatgacaggttccggctcgtcttctgccaccgcacaatgttacgaggcatcttcctgatttttttagactccatgaaaaggttgcaaagtgttaaccagcaggattgtctgcctttggctgattgaaatacgggccggattaaggcataaaaccagcaagtcaagtcgaagtcagcctggcgcgccacgatcgcgacgcctgaggagagaatgtgtattaccagccacaacgagatctactgcaaaaccgcatcattctggtcaccggcgccagcgcaggtattggcgaagaaaccgcgcgtacctatgcccgccacggtgcccaggtgatcctgctggggcgtaacgacgaaaagttgcgccgggttgcgcaggccgttgcggatgaatgcgggcagatgccgcgctggtttacgctggatatggaaacctgcacccctgccgactgtgaacagctcgcgcagacgcttgccgcgcattattcgcggctggatggtgtattacataacgccggtctgcttggcgatatctgtccgatggatcagcaaaatccgcaggtctggcaacgggtgatgcaggtcaacgtcaatgccacctttttcctcacccaggcattgcttcctttattactgaaatcagaagccggttcgctggtatttacctcctcaagcgttggacgtcagggtcgcgccaactggggcgcttatgccgcctccaagtttgccaccgaaggcatgatgcaggtgctggcagaggagtatcaaagccgtcatctgcgggtaaactgcattaatccgggcggaacccgcaccggtatgcgcgccagcgccttcccgacggaagatccgcaaaaactgaaaacgccggcggatattatgccgctctatttatggttaatgggcgatgacagccgtcgcaaaaccggcctgagctttgatgctcagccaggacgtaaaccgggaatatcgcaatgagtgaagatcgttatcagcagcgtcagcagcgcgtgaaagagaaagtcgatgcgcgcgttgccgccgcccaggatgaacgcggcattatcatcgtctttaccggcaacggcaaaggcaaaaccaccgcggccttcggcaccgcgacacgcgctgtcggacacggcaaaaaagtgggagtgatccagtttatcaaaggtacctggcctaacggcgagcgcaatctgcttgagccgcacggtgtggaatttcaggtgatggccaccggctttacctgggacacgcaaaatcgtgaatcggacaccgccgcctgtaccgccgtctgggagcatggccgccggatgctggcggatgcctctctggatctggtgatcctggacgagctgacctacatggtggcctatgactatttaccgctggaagaggttatcagcgccctgcaaaatcgtcccccgcagcagacggtgattattaccgggcgcggttgtcatcgtgacattctggaactggcggataccgtcagcgagctgcgtccggttaaacatgcttttgatgcgggcgtaaaagcgcagatgggaatagattattgagtgattttgccaggtggcgctacgctcacctggcctgccagtcacagtcctgaaaacccgcgcaagcgaagcgccgccgggcttgtgtacagattaaccgtttgttttgttacgagtgcttgagcggcgaccggttgatgccggacgcgggtttgaggtctggctgtgacgttttaccgcacggcggatctgattcgctttcacccggcggcgatctttctcgacggccacttttgattcggtttccggtttcagctccaccagctcacgcaggtagttggtctgcgccagatccagttcggtataacccccacgcggcaggcctttcggcagcggaatatcgccgtagcgaacgcggatcaggcggctgacctgcacgccaacggcttcccacaaacgacgcacttcacgattgcgcccttcggttaaggtgacgttgtaccactggttgatgccttcgccgccgctgaacttgatggttttaaaggcggccgggccgtcttccagctgaacaccacgggccagttcacgcagcttgttatcgtcgacctgaccgaaaacgcgcacagcgtattcacgttccacttcacggctcgggtgcatcagacggttcgccagttcaccatcggtggtaaacagcagcaggccgcaggtattaacatcaagacgccctacggcgatccagcgcgcgccgcgcagtttcggcagacggtcaaatacggtcggacgcccttccggatcgttgcgcgtacacagctcaccttcgggtttgtaataggccagcacgcggcagatttgttcaacggattcttttacggagatcagatgtccgtcgatacggattttcaggcccggctgaacctcaacgcgatcgcccagcttagcaattttgccgtctacgctgacgcgacccgcttcgataatggtttcaatttcacggcgtgagccgtggccggcacgcgccagcactttctgtagtttttcgctcatggagcatccttcaggtgtcgccttcacaggcgtctggtatactttcaaaaacaacgagttatgaatttcaccctcgctgctatgtaaaatcgctggcgtcaaagaacgcgcccaatttcatgtggccgcacatattacacgaatttatgcacgaatgctgcaatgctgctcgcgaaccgcatttctggagtatataaggaaggcataatgaaaagctttacctcttctgtggctggctgtcagatccgctatcacgatctgccggggcctggcgaaccgctggtctttattcacgggctgggatgcgcctcgtcctttgaatatccgcgtgtcgtcatggacccggctttctcaccacgtcgggtgatcctgattgatttaccgggcagtggctacagtgataaaccagcgtattacagttactccaccaccgatcaggctcaggcggtaactgaattgctgacggacattggcctgacgcagttctggttatacgggcacagcatgggcggtagcattgccattgaagtggccaccgcaatgcaggcatcacttctgggactaattgtatcggagccaaacttttataaaggtggcggccaattcagccgcgggattgcggcaatctcacaagatgaatttatagccggaggttaccagggcttaattgataacgaagagagtccatggaaaggttctttgcagagcactctgccgctcgccgtctggcgcggagcaacatcactggttgaaggtatcgaacctgaatggttttccctctttaccgccctgccggttcgtaaacagttactgttcggggaatggtctttgccggatcaggattttgaagcggttaagtcacaaggaatagcgtgccggatcattaatgccgcaggccactctatgtcatgggaaaacccgacaggactggcgcaggcattaagcgagttctgtacgctataagccgggccacctgttgtggcccggcgcatcacttataagaaaggtttaacgtccccgacgccttcgcgcaggatcaccggcgaatcatcggttaaatcgataaccgttgttggctgctggccaaggtaaccgccgtggatgaccagatcgacatgtttttccaggcgatctttgatctcttccggatcggattcggtaaaatcgctgcccggcagcatcagcgaggtggaaagcattggctcattgagcgtttccagcagcgccagggcgatggggttggatggcacacgcaggccgatggttttacgtttttcctgcaacagccggcgcggcacttctttcgtgcctttcagaataaaagtgtagttgccgggcgtgttgtttttgatcagacggaacgccacgttatccacataagcgtaggtggacaactccgacagatcgcggcacatcagggtaaagttgtggccgtccggcagctggcggatgcggcaaatgcgctccatggcgcccttgtcttccagtttgcaccccagcgcatagccggaatcggttggataaacaatcaccccgcctttgcgcacaatttccacggcctgattaatcagccgcgcctgcgggttgtccgggtgaatatagaaaaactgactcatactgccctctcattggtgttctgtggctgctcccacgatgtccacaccccttccacgcctgcgggtaaccagagcttacgacccagttcgatccacgggcagggctgatggaaatccgagccctgcgaagccagtaaaccaaactgttgcgcataagctgcaagctgggtgcgctcgttaggcgcctgctgacattgcgatacttccatggcgtcgccgccctgttcggcgaagtgcgccagcagtcttttcagccatttagcgctcaaatcataccgccccggatgggcgataaccgctttgccgccagaatgatgaatgacatcaatagcttgttttattgtacaccactgtggcggaacgtagccggttttcccccgcgcgaggtattttttaaatacatccgccacgttattggctttgccgctggcgaccagaaaacgcgcgaaatgcccacgggtcacggcaccgccctgcgccagggcctgcgccccttccagcgcgccgggaatatgcgctttttcaagccgttcggcgataagctgcgcccgctgctggcgtcgcgccttttgttcgtccagcagttcacacaccgccggatgagtgctatcaatattgaggccgacgatatggatctcatggttttcccagagggttgagatttccacgccggggatgagcgttaatgccaggcccgcgcgttcgatttcggcctgcgcggcggcgatgccgtcggtggtgtcatgatcggtgatcgccagcgtaccgacgcgcatctcaaccgcgcggtgcaccagtttttcgggtgaaagcaaaccgtctgaagcgagagtgtgggaatgaagatcgtaaatcactgcgtaattcgtgtcgctcaaagcggctcccatggggatataaagaaggtgaccgcgccatcataacggttgccgatgatttttgcgaaatcaggggttgactttatttccccgaaccagttaactagtacgcaagttcacacgacgaggtatctgaaaatgactgcattctcaacacgtaaccgctggtggcgcactcctgattacgggcagtgaggtcacgtctgcgtcacgcaaacagataccccggcccgcctcgtgagcgggcttttttatgaacaaaataacgagaacgattatgcaaacgcaaaaaccagcactcgaacttcttactgatgatgcggtgtaccgtgaaaatccaacggcgctgtttcaccagatctgcggcgcgcggccggcgacgctgctgctcgaatccgcagacatcgacagcaaaaatgatttaaaaagcctgctgctggtggatgccgcgctgcgcattaccgcgctgggtgacactgtcaccatcaatgcctttaccgccaacggcgcgtccctgctgccgctgctggacgcggcgctgccctcaggcgtggaaaatataaaaacggataacagtcgtgtattgcgcttcccgccggttagcgcgttgctggatgaagacgcccgcctgtgttcgttgtcggtgtttgacgccttccgcctgctgcaaacgctggtcacactgcctgccgatgagcgtgaagcgatgttctttggcggtctgttcgcctatgacctggtggcaggttttgaagaattaccggccctggcgcaggataataactgcccggattactgtttttacctggcggaaacgctgctggtgatcgatcaccagaagcagcatacccgtatccaggcaagcctctttacgccgcaggccgccgagcgcgatcgcctgacgcaacgaatggcaacgctgcgccagcagttgcacgacctgcccgttgcgctgccggtggaatccatcgcctccatgcgctgcgactgtaatcagagcgacgaggagtacggcgcggtagtgcgcgaaatgcagaaagcgatccgcgccggggaaattttccaggtggtgccgtcccgccgcttctccctgccctgcccgtcgccgctggcggcctatgatgtgctgaagaaaagcaatcccagcccgtacatgttctttatgcaggatgccgatttcaccctgttcggcgcgtcgcccgagagctcgctgaaatatgacgcaaacacccgccagattgaaatctaccccattgccgggacgcgcccgcgcgggcgtcgtgccgatggctcgctggatcgcgatctggacagccgtattgagctggagatgcgtaccgatcataaagagctgtcagagcacctgatgctggtggatttagcgcgtaacgatctggcccgcatctgtacgccgggcagccgttatgtggcggatctgaccaaagtcgatcgctactcctttgtgatgcacctggtttcccgcgtggtgggtgaactgcgccacgatctggatgcgctgcacgcttatcgcgcctgtatgaacatgggtaccctgagcggggcgccaaaagttcgcgccatgcagctcatcgccggtgccgaaggtacccgccgcggcagctacggcggcgcggtgggttattttactgcccacggcgatctcgacacctgcatcgtcattcgttccgcctacgtggaaaacggcgtcgccaccgttcaggcgggcgcaggcgtggtgctggattctgtgccgcagtccgaagccgatgaaacccgtaataaagcccgcgccgtcctgcgcgccattgccactgcacaccacgcacaggagacgttctgatggctgatattctgctgctcgataatatcgactcgtttacttacaacctcgccgatcagctgcgcgccagcgggcacaatgtggtgatttaccgtaatcatgtcccggcgcagacgctgattgaccgtctgaccaccatggacaacccggtgctgatgctctcgccagggccgggcgcgccgtcggaagcgggctgtatgccggagttgctcacccgtctgcgcggcaaactgccgatcatcggcatctgtctgggtcatcaggcgattgtcgaagcctacggcggctacgtgggccaggcaggtgagatcctgcacggcaaagcgtcgagcattgaacatgacagccaggcgatgttcgccgggctgagcaatccgctgccggtagcccgttaccattcgctggtgggcagtaatattccggcgggtctgaccatcaacgcccatttcaacggcatggtgatggcagtgcgccacgatgcggatcgcgtctgcggcttccagttccatccggaatcgatcctcaccacccagggcgcgcgtctgctggagcagactctggcatgggcgatgcaaaaactggagcagaccaataccctgcaaccgatcctcgaaaaactttaccaggcgcagaccctgagccagcaggagagccaccagctgttttccgcggtggtgcgcggcgagctgaagccagagcaactggcggcggcgctggtcagcatgaagatccgcggcgaacacccgaatgagatcgccggggccgccaccgccctgctggaaaacgccgcgcccttcccgcgcccggattatgcctttgcagatattgtcggcaccggcggcgacggcagcaacagcatcaatatttccaccgccagcgcttttgtggcggcggcctgtgggctgaaagtcgccaagcacggcaaccgcagcgtttccagtaaatcgggctcttccgatctgctggcggccttcggcattaatctggatatgcaggcggaaaaatcccgcaccgcgctggacgagctgggcgtctgtttcctgttcgcgccgaaatatcacaccggttttcgtcacgccatgccggtgcgtcagcagctgaaaacccgcacgctgtttaacgtgctggggccgctgatcaatccggcgcatccgccgctggcgctgatcggcgtctacagcccggagctggtgctgccgattgccgaaacgctgcgcgtgctgggctatcagcgtgcggccgtggtacacagcggcggcatggatgaagtgtcgctgcatgcgccgacggtggtagccgaactgcatgaaggagaaatcaaaagctatcagctgaccgccgccgattttggcctgacgccttaccatcaggagcagctggcaggcggcacgccggaagaaaaccgtgacattctgacgcgcttattacaaggtaaaggcgaggctgcgcatgaagctgccgtggccgctaacgtcgccatgctgatgcgtttgcacggtgaagaagatttacaggccaatgcgcaaaaagttctggatgtgctgcacagcggcgcggcgtatgacaaagtcaccgcacttgcggcaagagggtaaatgatggaaaccgttttagcgaaaatcgtcgcagataaggcgatttgggttgaggcccgcaaagcgcaacagccgcttaccagttttcagaatcaggtggtgccgagtacgcgtcgcttctattctgccttacagggcgcgcgcacggcctttattctggagtgcaagaaagcatcgccgtctaaaggcgtgatccgtgaagactttgatccggcgcagatcgccgagatctacaaacaccatgcgtcggctatttcggtgctgacggatgaaaaatatttccacggcagcttcgattttctgccggtggtcagcgccatcgcgccgcagccgatcctctgtaaggatttcattatcgatccttaccagatttacctggcgcgtttctaccaggcggatgcctgcctgctgatgctgtccgtgctggatgacgagcagtaccgccagcttgccgccgtcgcacatagcctggagatgggcgtgctgacggaagtcagtaatgaagaagagctggagcgcgccattgcccttgaggcgaaagtggtcggcattaataaccgtgacctgcgcgatctttctatcgatctgaaccgtacccgccagctggcgccacgcctgggcgcaggcgtcacggtgatcagcgagtcaggcattaatacctatgcgcaggtgcgtgagctgagtcatttcgccaacggattcctgattggctcggcgctgatggaatatcccgatctgaatgccgccgtgctgcgcgtgctgctcggcgaaaacaaagtctgcggcctcacccggtcagaagacgcgcaggcggcttttgaggcgggcgcgctgtacggcgggctgatttttgtcgatacctcgccacgcgcagtcagcgatgaacaggcgcaggcggtgatcaatgccgtgccgggtctgcgttacgtcggcgtgttccgcaatgcgccggtggaggatgtggttgcacgcgcgcaacggctggggcttgccgccgtgcaattacatggtacggaagaccagcagtatgtgaatgcattacgcgccgcgctgccggctgatgtgcagatctggaaagcgctcagcgtcacccgcagcctgcccgcgcgggattatcagcacgtggacaaataccttttcgataacggtcagggcggcagcggggagcgatttgactggtcgctgctggcaggccaacgcctcggcaatgtactgctcgcaggtggccttggcgccgataactgcgtggaagccgccagggccggttgtgccggtctcgattttaattcaggcgtagagcgtgaaccgggtattaaagatgccgataaactggcctcggttttccgcacgctcagagcatattaaggaagcaagcatgacaacattactgaatccctatttcggcgagtttggcggtatgtacgtgccgcagatcctgatgcccgccctgcgtcagcttgaagaagcttttgtaaacgcgcaaaaagatcctgaattccaggcgcagttcactgacctgctgaaaaactatgccggtcgtccgacggcgctgacgaaatgccagaacctgacggcgggcacgaaaaccacgctgtacctcaagcgtgaagatttgctgcacggcggcgcgcacaaaactaaccaggtgctgggtcaggcgctgctggcgaagaaaatgggtaaaacggaaatcatcgccgaaaccggcgcgggtcagcatggtgtggcgtcagcgctggcctcggcgctgctcggtctgaaatgccgcatttatatgggcgcaaaagacgtggagcgccagtcgccgaacgtcttccgtatgcgcctgatgggcgcggaagtgatcccggtctacagcggctcggccacgctgaaagatgcctgtaacgaggcgctgcgcgactggtccggcagctacgataccgcgcactatatgctgggtaccgcggctggcccgcaccccttcccgactatcgtgcgtgaattccagcgcatgatcggcgaagagaccaaagcacagatcctcgaaaaagaagggcgtctgccggatgcggtgatcgcctgcgtcggcggcggttctaacgctatcggcatgtttgctgactttatcgaagagaccggcgtcgggctgattggcgttgagcctgccggacacggtattgaatccggcgagcacggcgcgccgcttaagcatggccgcgtggggatttacttcggtatgaagtcgccaatgatgcagacggaagatggtcagattgaagagtcttactccatttctgccggtctggatttcccgtccgttggcccgcagcacgcgcatcttaacagcatcgggcgtgcggattatgtgtccatcaccgatgacgaagcgctggacgcgttcaaactgctgtgccgcagtgaaggcattattccggcgctggaatcttcacacgcgctggcccatgcgctgaaaatgatgcgcgaaaacccggaaaaagagcaactgctggtggttaacctgtccggccgcggcgataaagacatctttacggttcacgatattctgaaagcgcgaggggaaatgtaatggaacgctatgaaaacctgtttaaacgcctgaaggatcgcaaggaaggcgcgtttgtccccttcgtgacgctgggggatcccacccctgagcagtcgctgaaaatcatcgacacgctgattgaagcgggtgccgatgcgctggagctgggcattcccttctccgatccgctggcggatggcccgaccattcagaacgcgaccctgcgcgcctttgccgcaggtgtcacccccgcgcagtgctttgaaatcctgaccaccgtgcgccagaaatatccggatatgcccattggcctgctgatgtacgccaacctggtattcagccgcggcattgatgagttttatgcccagtgtgaaaaggccggtgtcgattccgtgctggtggcggatgtgccggtggaggagtcagccccgttccgtcaggcggcgctgcgtcacaatgtggcaccgatttttatctgcccgccgaacgccgatgacgatctgttgcgccagatcgcctcttatggccgcggctatacctatttgctgtcacgcgccggggtgaccggatccgagaacggcaccgcgctgccgctgaatcacctggtggataaactgcgggaatataatgccgcaccggcattgcagggatttggtatttcggcaccggctcaggtgactgccgcgctgggcgcgggcgctgccggggcgatctccggctctgccattgtcaaaattatcgagaagcatcttgataactccaccgcgatgctggcggagctgaaagcttttgtacagggcctgaaagccgcgaccctgccgcaataacctcatctgccgcctgaatgataatcgggcggcatattcctgtcagaatcgataacccgcgccaaacataaatacccagggatcgagacgggtatgcacgctctgctgctcgccaccggctttaaaacgtacatcggtatcaatatccatataccagactgacatgttcagcagccagtcacggttgatgagataatccagccccacctgccccgccagcccccatgaatctttcaggctcaaatccgacagcccggcttctttgccggtatcattgaatttttcatcaaagaacgtggtgtagttgacgcccgcgccgatatagggacgcgctttgctggtggcatcgccgaaataccactgcgccatcaacgacggcggtaaatgatgaacggtcgccaggtcgccggtcggccctgtaccgactttatgacggaacggcgtggcagccagcaattcaacgccaacattgtccgttgccatataagtgaaggtcagacccagttgggtattgttatcgacgttaaacccgccgaggctgcccagcacgttatcagagccttccgtcgggcgcacggtggcggaaccggcacggacaaagaattcgcctgcttcatgggcatacacgttttgggaaagacctgccagtaccagcgctgccacagctaactttttcatctccactcctttgatgtggttttatttgcgcggtgaatatacctacatcgaagtagaaagtgatctgccacagatcacatttaaaccaataatttaacctttgttgatctggattaattttaccgcccattccgataaaaccgtgtttaccggtctgcatcaatttttactttttgtgcgtaacgggcagccattactctcgctttacaaagatatgcttttccataccacccttgatgctgccacttgcgggtcaaccagggtacaatcggcagctgaataaacacctgcttaactcaaggagagggcatgtctatcacggcgaagtccgtttaccgtgacacgggaaatttttttcgtaatcagttcgttactattctgctgatcgcgttgttatgtgcatttatcacggtgatgcttggtcatgttttttcgcccagtgaggaacaactgtcgattttaagcgaaggcgataatctgtccggcagcgttggtctgatggaactggtgcagaatatgacgccggagcagcagcaggttttgctgcgcgcgtcggcggcgtccaccttctccgggctgattggtaacgccattctggccggtggtgtgctgctgatgatccaattgatctccgccgggcagcgcgtcagcgccctgcgggcgattggcgccagcgcgcctgtgctgccgaagctgtttgcgctgattttcatcaccaccctgctggtgcaggtgggcattatgatgatcgtcgtgcccggcgtgctgctggccatcgttctgtcgtttgcgcccgtcatgctggtgcaggaaaaaatgggtatctttgccgcgctgcgcgccagcatgcgcatggcctgggcgaatatgcgactggtggcacccgccattatcggctggctgctggcaaaaacagtgctgctgatgtttgcctccagctttgccgccctgacgccgaacgtgggcgcggtggtggctaatacggtgagcaatttaatctctgccgtactgctgatttatcttttccgcctttatatgctgatccgtccttaacattcacccgtcggccttcacgtcgacgggtattactatcggaattaaagaatgaagcagtttcttgattttctgccgctgattgtctttttcgccttctataagctgtatgacatttatgccgggacggctgcgctgatcgtcgccactgccgtggtgctggtttacagctgggtgcgttaccgcaaagtggaaaaaatggcgctgatcacctttgtgctggtggcggtatttggcggcttaacgctgttcttccataacgatgaatttattaaatggaaggtgacggtaatttatgcgctgtttgccggtgcgctgttattcagccagtgggtgatgaaaaagccgctgatccagcgcatgctgggcaaagagctcaccctgccacagcacgtctggtcgaaactgaatatcgcctgggcggtgttctttattctctgcgggctggcgaacatctatattgccttctggctgccgcaaaatatctgggttaactttaaggtgtttggcctgtcggccttaacgctgattttcacgctgctgagcgggatttatatttaccgtcatatgccgacggaagataaatcctgacgccgtttcagactgagataataatgacgacaacaaatgaggctccgcagggagaactggtattacgcacgctggcgatgcccgcagatactaatgccaatggcgatatttttggcggctggctgatgtcgcagatggacatgggcggcgcaattatggcgaaagagatcgcccatggccgcgtggtgacggtgcgcgtcgacggcatgacctttctgcgcccggtggccgtgggtgatgtggtgtgctgctatgcccgctgcattaagcgcggcaatacctctgtgaccatcaatgtggaagtatgggtgaagaaagtctcatccgaacccattggccagcgctataaggccaccgaagcgctctttatctatgtggccgtggacagcgaaggtaaaccccgcgccctgccgccacagccctgaatcgaagacaataaaaaagcctctgtacagaggctttttttttggcccggcggcccgtcagtccatcgaggccccgccgttcagtcggaagacgatgttaacggtgatgccgttacccggtttgcccggctcataacgccatttacgcatcgcggttttcacttcccgctcgaacatattgcgcggcgtggcgtccaggatctggacattctctacgcgcccgtcggaggtcacgtcaaatttaacccgcacacggccttcaatacgcagcgcctgcgcgcgcgcaggatactgcggctcaccacgacttatcgcgcgcggaccggccggagtgttattcaccggtcggctttgcgccggcgccgggttggtcacggtacgcggcgctaagctctgtgctggcgcgctcggacgcggttccaccgggcgcatatcccgcttcggctgctcaacgcgtttttccggttttggcttcggcttcggtttgggtttcggctttggcttcggtttttcgatcaccaccggcgcttcttttggcggctccggaacgggttccggctcaggctctggttccggttcaaccaccggttccggcggcggtgccacctgtggcggctccagctcagcgggggtgaccatggtgacggagatgggctgcgagggcgcaggcagttcaataacctgttttacggaactataaagcaccacggccaccacagcggcgtgtacaccaacagacagcagcgtcggccaggcaatgcggcgaggcgtatcaaaggtcattgaagtcataatcgtatcagttaaaaaaccaggccctgattttaaatgcaaatagcaatcatattcaataagccatctcatctatcgcgcatttagtgcgttcatttcctgtaaatagcgcatgtaaatcaaggttattaacaccccggctaactttgcgttgcagtccagaatactttcacttaacgtaacccgcgactttacccattaaggagtttgcccgtgctttatgtgatttacgctgaagataatgctgattcgctcgaaaaacgcatgtcagtgcgtccggcacaccttgcccgtttgcagttgctgcgtgatgagggtcgtctgctgaccgcggggccgatgcctgcggtggacagtaacgatccgggcccggcgggctttaccggctcaaccgtcattgcggaattcccatcgctggaagaggcgacagcctgggcagatgccgatccgtatgtggcggcaggcgtctataagaaggtttcagtgaaaccgttccgcaaagtattttaaggcgcgaaacagtgggcaccggctggcggtgccctggggatcagaattcctgaaacgcaaacagcagcgaattacggtgatggttgagtaaacattttctgatcgagtggatgcgcatatttcgacgtgactgcccttccagccagcgcgccttacggcggctcgcctggcgaaccatacgccagcgccctacttccggtctactacgcttcatgatgacaactctttaataacgaagcccgcattatagacccttgcacgggccataccagcgcttttgtcggtggtttttatttgccagttgaatgcttacgcgtaaactcaggggattacgcattcaaaaggattttttatgacaaccttctacacgctggtgagttggctggtcattttgggatactggctcctgattgcaggtgtaacgttacgcatcctgatgaaacgccgcgtcgtcacctccgccatggcctggcttctggtcatctatatcctgccgctggtgggcattattgcgtatctctcctttggcgagctgcatctgggcaaacgacgcgccgaacgcgcccgggcgatgtggccctccaccgctaaatggttaaacgatctcaaagcctgcaagcatatcttcgccgaagaaaacagcgacgttgccgcatcgctgtttaaactgtgcgaacggcgtcagggcatcgccggggtgaaaggcaaccagctacagctgctcacctcttctgatgatgtgatgcaggcgctgatccgcgatattcagctggcgcgccataatatcgagatggtgttctatatctggcagcccggcggcatggcggatcaggttgctgaatcgctgatggccgccgcccgtcgcggcgtacattgccggctgatgctggattccgccggcagcgtgaattatttccgcagcccgtgggtcaatatgatgcgcaacgcgggcatcgaggtcgttgagtcgctaaaagtgaatctgatgcgtgtctttttgcgccgcatggatttacgtcagcaccgtaaaatggtgatgatcgacaactatatcgcctacaccggcagcatgaacatggttgacccgcgcttcttcaaacaggatgcgggcgtcggccagtgggtagatttaatggcgcgcatggaaggcccggtgtcaaccgcaatgggcattgtctattcctgcgactgggaaatcgaaaccggtaaacgcatcctcccgcctccgccggacgccaatattatgccgtttgagcaggccagcggacataccattcacactatcgcttccgggcccggctttccggaggatttgatccatcaggcgttgctgaccgcagtctattccgcacgtgaatatttgattatgaccacgccctatttcgtgccgagcgacgatctgctgcatgccatctgtacggcggcgcatcgtggcgttgacgtgagcattatcctgccgcgtaaaaacgactcggtactggtgggctgggcgagtcgagcgttcttttcggaactgctcgccgccggggtgaaaatctatcagtttgaaggcggcctgctgcataccaagagcgtgctggtggatggcgaactgagcctggtgggtacggtcaatctggatatgcgcagtttgtggctcaactttgagatcacgctggtgatcgacgacgccggtttcggcgccgatctggcggcggtacaggacgattatatttcgcgttcacggatgctggatgccagactgtgggttaaacgcccgctgtggcaacggatcactgagcgactgttttacttcttcagcccgttgctgtaaaacgtgcccaacagtggttaaccaggtagtcatcatggaaatggatctgaacaatcgtctgactgaagacgaaacgcttgagcaggcttacgacatttttctcgaactggcggtcgataacctcgatccggcagacgtgatcctttttaatttacaatttgaagagcgcggcggtgctgaactgttcgatccggcagaagactggcaggaacatgtcgattatgatctgaacccggatttcttctcggaagtggtgattggtctggcggataccgacggtggagagctgaacgatattttcgcccgcgtgctgctgtgccgggaaaaagatcacaagctttgccatattctgtggcgtgaataaactgcctatcaatgtaaaaagggctgacgagtgtcagcccttttttattacttctgtgccgggtggcgctgcgcttacccggcctgcacagaacctgtaggcccggcatgcctgcgcccccgggcaaggttttaagttacaggggatcaaccttcaggcacgacaccgcgtgctggaaactgccctccagcaccggacgggttttcgcgcattccggtccggcaatcgggcagcgggtgcggaaaacgcagcccgacggcggattgatcggcgacggcagctccccttccagcaactggatctgcttgtttcgctccagatccggatccggtaccggcaccgctgacatcagcgctttggtataagggtgcagcggattgtggtacacctgatcgtaagtgcccagctccaccgcgtgtcccagatacatcaccagcacacgatcggagatgtgcttcaccaccgccaggtcatgggcgatgaagatcagcgacagccccatttcacgctgtaatttttgcagcaggttcactacctgcgcctggattgacacgtccagcgccgacaccggctcatcgcaaataatcagcttcggctcaaggatcagcgcgcgggcgatgccgatacgctgacactgaccgccggaaaattcgtgcgggtagcggttgataaggttcggcaacaggccgaccttcagcatcatcgctttcacgcgctcgcgcacttcctggcgggaaattttcggctgataggtgcgcagcggctcggcgatgatttcgccgatggtcatacgcgggttcagcgaggccagcggatcctggaaaatcatctggatatcgctgcgcacatcgcgccactcttccggcttcatccccagcagatctttccccagccacgcgactttaccgtcggtggctttcaccaggccaataatggcgcgggcaaaagtcgatttaccgcagccggattcacccaccacgccgagggtttcgccttcatacagacgcagcgtgacgccatcaacagctttcagggttttggacggctgccagaaccactgtttaccgtctttgatgtcgaagtgcactttcagatcggcaatttccagcaggacttttctttcttcggtcagcgcattcataccagttcctccaccggcttaaagcaggcacgcaggcggcccggggcgaattcttccagcggcggcgcggtgtgacaaatttccatcgcatgcgggcatcgcggctggaacgggcagcccttcggcagacgcagcaggttcggcgggttgcccggaatggtcagcagcgcttcgccttcagcattcaggcgcggcacggcgttgagcaggccaatggaatacgggtgcgccggctgatagaacacattgcgcgccgagccgtactccatggtacgtccggcatacatcaccagcactttatcgcagataccggcgaccacgccgaggtcgtgggtgatcatgataattgcggtgttaaattcgcgtttaagctcgttgagcagagtcatgatttgcgcctgaacggtcacgtccagcgcggtggtcggttcgtcggcaatcagcagcttaggacggcacagcagcgccatggcgatcatcacacgctggcgcataccgccggaaaactcatggggatacatgcgcatacgcttacgcgcttccggcatttttaccgcatccagcatacgcactgactcttcaaaagccgcggctttgccgaggtttttgtgcagcatcagcacttccattaactgctcgccgacccgcatatacgggttcagcgaggtcatcggatcctggaaaatcatcgaaatttgttcggcacgcagcttattaagcgcctgctcaggcaggttgaggatctcgcggccattaaatttcgccgatccgccgatcacgccgttggaggccagcaggcccatcagcgcaaaggcggtctgggatttacccgaacccgattcgcccacgatacccagggtttcaccggctttcaggctgaagttcaggtcatttaccgccgtcacgtcgccgtccggagttttaaacgtcacccgcagatctttcacatccagcaggatgtcggaagtttgctgcgcctgagacgtcgatacgatttcagtcatgctcattacagcgctccttaacgatctttcgggtcgagggcatcacgcaggccatcgccgataaagttgaaacaaaacagggttacgaccaggaatactgccgggaacagcagcagccagggtgaaacttccattgagtttgcgccatcgctcagcagcgcgccccagctgctcagcggctcttgcgtgccgaggccaaggaagctcaggaaggattcaaacagtatcatgctgggtaccagcagcgaggcgtaaaccaccaccacgcccagcacgtttggcacaatatgacgtacgacgatattaaaggtggagactccgccaacctgcgcggcttcgatgaactctttacgtttcaggctcagcgtctgaccgcgcacgatacgcgccatatccagccaggacaccatgccgatagcaacaaagatcagcagaatgttttgcccgaagaaggtcaccagcagaataacgaagaacataaacgggaaggagttgaggatctccagcaggcgcatcatcacggaatccactttgccgccgagatagccggaaagcgagccgtataatgtgccaagcaccaccgccaccagcgcggcggcaatccctaccatcagcgagatacgcccgccgatagccacacgcaccagcagatcgcggccagaggagtcagtaccaaagtagtgacccgattccatatccggcgcgctggacatcatgccccagtcggtatcgaaataactgaactgcgacagcgccggggccagcgccacaaacagcgcaatcagcaccagcacaatcaaactggtgacggcggcgcggttatgcataaagcgacggcgcgcgtcctgccacaggctgcgcccttcgacttcaagcttctcactgaagttttccagcgcctcgctgtttttcttacttaacatcatggcgtactccagcgttagtaacggattttcggatcgataacggcgtagagcacgtcaacaatcgcgttaaacagaatggttagggttccgacaaggatcgtcaggctcagcaccagcgaatagtcgcggttgagcgcgccgttaacaaacagctggccgatacccggcagaccgtaaatggtttcgatgaccattgagccggtgatgatgccgacgaacgctggccccatgtaagagagcacaggcagtaaagcgggtttcagggcgtggcgcaggataatacggcgcatcggcaagcctttcgcccgcgcggtacggatgaagttggagtgcagcacttcaatcatcgatccgcgggtgatacgcgcaatactggcgatgtaggccagcgataacgccaccatcggcaggatcatgaattttggcgcgccgccgttccagccaccggctggtaaccatttcagcgtgatcgcgaatattaataccagcaacggggctaccacgaagctcggaataaccaccccggtcatggcaaagcccattactgtataatcccatttggtattttgtttgagtgccgcgattaccccagccgcgacgccaaaaatgacggcgaggaggaaggctgctgcgcctaatttcgcggagaccgggaagctcgacgccaccaaatcgttaacggagtagtctttatatttgaaagacggtccgaaatccccctgcgccagctgtttcagatagctgaaatactgcgtcatgatgggatcgtttaaatggtatttcgcttcgatattcgccatgacttccggcggcagcgcgcgctcgctggtaaagggactacccggcgcaagacgcatcataaagaaggagatagtgataagaattaagagtgtcggaattgcttccagacaacgacgtaaaataaatttcaacattgcccgtaccttctggcctgtgcctttgcgtgcgatgaattaagacacgatggggcaaaacgtaaccgtcaaaaaatacggtgacgccctgccccacgaattgccattaatgtttgataacgtagagatctttagcgtaaacgttatccatagggtctttaccggaatatccgccaacccatggtttcaccagtcgggcgtttacgtagtaatacaccggaacgatggcagagtctttgccaagctgctgctctgctttgtcatacagcgcgctgcgctgcgcttcatcggccgctttcacggattcagccatgatgctgtcgaatgccgggctcttatagtgcgcggtattcattgagctgccggacagcatggtgttcaggaaggaagtcggttcgttgtaatccgcacaccagcccgcacgcgccacgtcgtagttaccctgatgacgggtatccaggaaagttttccactcctggtttaccagcttgacgttaacgcccaggtttttctgccagatggacgaggcggcgatagccagcttcttgtgtagatcggaggtgttatacagcaggttgaaggacagcggcttatctttggtatagcccgcttccgccagcagttttttcgcttcttcgttacgtttttcctgggtccaggtgaaccactccggcttggtcagtttcgcaccatccgcatacggcggcgtataaccgaaggctggcagatcgccctgcgctttcactttattggtgatgatatcgcgatccaggcccagtttcagcgcggtacgtacgcgagcatcgttgaacggcgctttctggttgttgatttcgtaatagtaggtgcacagatacggatcaacgtgaacttcctgcgggatctcttttttcagtttctggaagagttcaatcggcaggttgttataagtcatgtcaatctcaccgctgcggtagcggttcacgtcggtgacttcagacgagattggcaggaaagtgatctggtcgagaacggtttttgcgttattccagtagttggtgttacgcaccatcacgatacgttcgttaaccacccagtcctgcaatttaaatgcgccgttggagacgatatttgcaggctgcgtccatttttcaccgaatttctcgatcgcggttttgttcaccggcgacatagccgggttaaccagcagtttatagaaataaggcactggctcgctcagcgtgacttccagcgttttgtcatcaatggctttgacgcccagctcgctcggcttcattttgccgtcgatgatcgcatcaacgttaagaatatgaccgtactgcgggtagcttgcgtatggcgaggcggtgtttggatccaccagacgctgccagctgtagacgaaatcctgtgcggtgacaggctcgccgttggaccatttcgcatctttacgcagatggaaagtccacactttaaaatctttgttttcccatttttcagccacacccgggattggatggccgtcaaccggagacgtgatcagcagaccttcaaacaggtcgcggctgacgtttgactcaggaacgccttcgattttatttggatcaagggattgtggttccgcgccgttattacgcactaaaacttgtttctctgccagctgaacgcccgctggcacatccgccgccatagcaacattgccggcgatgagtgcagtcaggatccctgccgcgattaggcttttctttgtgatgatggacattgtgttgtgactccgatcattataattactggtgcgaacaccagcctgtttcatacccgttaagggttcctgtgcagtgcaggagtttttgctaccgccaggcgttttttgctttttgctatcaccgactttcattattaccggcagctcgtatggcagccttctgtcgattttcgcgcatttcccctgttctgaaatgcgtctgttctgtccggacgagggttatatgaaaatgattctcatctttattattcgtccacaaaatataaggccggaaagtaccaaaagcgctgatccctcgccaatacattttgcaaatttgttaagcaattctcttttatggcagatggcgggcggtcaaagacgggagttgatgttgcgtgtacatcagtaaactttttaagttcagtcgcttaccgcgttgctacttcgtccttgctgctttgtcgtgacattgattgttttttacacaaaaaagtaacaattggcgactaattagcacattcatctgcctggatgatgaaattactaatatcatttcaattatctgacagcaagcccaagagtatcatgtgaggaaaataacacggcgactgcgtttataatgaccacccccgaacggaggtggcgggtaactaaatgaaattcatggattaatagtaaacagtactatttattatatttgatgtaattttcaactttagttataagttttactgataatgaaaaacatcaggcgagcagccctggaaacagcgctttaataccggtaacaataaattcaatccccagcgccatcagcagcagccccataatacgcgtaatgacgttaatgccggtttgccccagcaggcgcaccagccagggcgctatacgaaagacgccccaacagcacagcgcaaaaagcgcaatggcgacagaaaagcacagcagatgcatccagttgtgataacgcgtgccccagacaatagtggagctgattgcccctggacctgccatcaacggcaatgccagcggcacgacgccaatgctttcacggatcgccgtctccgacttctcctgcttattctgtttatcttccccaagcttaccgctgatcatcgacatcgcaatggttaccaccagaataccgccagcaatgcgaaacgaatcgatggaaataccaaagagttgcagaatgccgttaccgagaaacagtgaggtcagcaggataatggcaacagacaggttggccgtcagattggttttgttccttgccgccgccgtctggtaactggtcatactaatgaagacgggaataatccccaccgggttaaccagagcaaataagccaataaaaaattttgagtaggttggaaaatcaaacaacgtctggatcacggtcggctccgcatagtggcaaggctgatggcaaaagtccctgtaaaaaccgtgctgaagatacgctttttgtcagcatagttcaccaggaaaatcattaaaaacattactatcccgggatgttagaaaattgtactaattattataatctccagggagtcttcccctgattccataacaattattgtacatcacgaaaaagagcctgctgaaaggtgtcagcttgggtaaaacttgatttagatcacgatttcactactcagaagtgagtaaccttgattacgccgccagggagaacagcgtcaagcgggttcgatgcttaggtaaggctcttttagtaaatcaggggcgcagttttgaatttaagttgttgtaagtaaacactttctcaggctgttgttggtcttgactatactgacgtgttagcagctgatttactaaaagagtttaacattatcaggagagcattatggccgttactaatgtcgctgaacttaacgcactcgtcgaacgcgtgaaaaaagcccagcgtgaatatgccaactttactcaagaacaagtcgacaagatcttccgcgccgccgctctggccgctgctgatgctcgtatcccgctggctaaactggcggttgccgaatccggcatgggcattgttgaagataaagtgatcaaaaaccacttcgcttctgaatatatctacaacgcttataaagatgaaaagacctgcggcgtgctgtctgaagacgacacgttcgggaccatcaccatcgccgaacctatcggccttatctgcggtattgttccgaccactaacccgacttctactgcaatcttcaaatcgctgatcagcctgaagacccgtaacggtattatcttctcgccacacccgcgcgccaaagacgctaccaacaaagccgccgacatcgttctgcaggctgccattgctgccggcgcaccaaaagatctgattggctggattgaccaaccctccgttgaactgtccaacgcactgatgcatcacccggacattaatatgatcctggcgacaggcggcccgggcatggttaaagccgcttacagctccggtaaaccagcaattggtgtgggcgcaggtaacacgcctgtggtggttgatgaaaccgctgacatcaaacgtgctgttgcttctattctgatgtccaaaaccttcgataacggcgtaatctgcgcgtccgaacagtccgttatcgttgtggattccgcctatgacgccgtacgtgcacgctttgcgagccacggtggttacatgttgcagggtcagaaactgaaagccgtacaggacattatcctgaaaaacggcgcgctgaatgccgctatcgttggtcagcctgccaccaaaatcgcagagctggcgggcttcaccgttccggctgataccaaaattcttatcggcgaagtgtctatcgtcgacgatagcgagccgttcgctcacgaaaaactgtccccgacgctggccatgtaccgcgcgaaagattttgaagacgccgtggttaaagccgaaaaactggttgagatgggcggtatcggccacacctcctgcctgtataccgatcaggataaccagccggaacgcgtcaagttctttggcgataaaatgaagaccgctcgtattctgatcaacacccctgcttctcagggtggtatcggcgacctgtacaactttaaactcgcgccttccctgactctgggttgtggttcctggggtggtaactccatctctgaaaacgttggtccaaaacatctgatcaacaagaaaaccgttgctaagcgagctgaaaacatgttgtggcataaacttccgaaatctatctacttccgccgtggctccctgccaatcgcgctggacgaagtgattactgatggtcacaaacgtgccatgatcgtgactgaccgcttcctgtttaacaacggttacgctgaccagatcacctccgtgctgaaggccgcaggtgttgaaactgaagtgttctttgaggttgaagctgacccgacgctgtctgtggtacgtaaaggcgctgaactggcgaactccttcaaaccagacgtcatcatcgcactgggcggtggttccccgatggacgccgcgaaaatcatgtgggtcatgtacgaacatccggaaacccacttcgaggaactggcgctgcgctttatggacatccgtaaacgtatctacaagttcccgaaaatgggcgtgaaagcaaaaatgattgcggtcaccaccacctccggtaccggttctgaagtcacgccgtttgcggttgttactgatgatgccaccggccagaaatatccactggcagactacgccctgaccccggatatggcgattgttgacgccaacctggtgatggatatgccgaagtcgctgtgtgctttcgggggactggatgccgtaacccacgcgctggaagcctacgtttccgtgctggcgagcgaattctctgacggtcaggctctgcaggcgctgaaactgctgaaagagaacctgccggcgtcttacaacgaaggttccaaaaacccggttgctcgcgagcgtgtacacaatgctgcaaccatcgccggtatcgcgtttgcgaacgccttcctgggcgtgtgtcactccatggcgcacaaactgggctcgcagttccacattcctcacggtctggcgaacgccctgctgatctctaacgttattcgctacaacgcgaacgacaacccgaccaagcagacagcgttcagccagtatgaccgtccgcaggcacgtcgtcgttacgctgagatcgcagatcacctgggcctgagcgcaccgggcgaccgcaccgctgcgaagattgaaaaactgctggcatggctggacagcatcaaagctgaactgggcattccgaagtcaatccgcgaagccggtgtacaggaagcagacttcctggcacacgtagacaaactgtctgaagatgcattcgatgaccagtgtactggcgctaacccgcgttatccgctgatctccgagctgaaacagatcctgctggatacctactatggacgtgagtacaaagaaggtgacaccgcagctacagcaacagaggctgtagcggtgaaagcagacaaaaaagcgaagaaaaccgcataactcctcgcttaaatgaaaaacccgcctgatggcgggtttttttatggcctgagaggcgctctgtgacgttttaacggctaaataggccctacccccgcacccgcttctggatcaccgtcagcgagccctcagcaagcgcatccttatagtgcttacggcacacggaaacatagcgttcgttgccgcctatcaccacctgctcgccttcgttgtacggacgccccgcctcatccaggcgcaataccatactggctttacggccacagaagcagatggtttttaattccaccagtttgtcagaccaggccagtaaatactggctaccgacaaataactccccgcggaaatcggtacgcagtccgtaacagagtacgggaatatcaagctgatcgaccacttccgataaatcatgcacctgctggcgggttaagaactggctttcatccaccagcacgcaatgtacgggcttacgcgcgtgctcagcgcttatttcatcaaagagtgaagactgctgattaaacaatttagcaggggaagagaggccgatacgcgagctgactttgccggagccgaaacggttatcgatttccgccgtgtagaccaccgcgcgcattcctctttcctggtaattgtaggaagactgtaacaatgcggtggatttacccgcattcattgctgaatagtagaaataaagctgtgccattggccgccacaccccgatcaaagtaaaaatatttcagggcgggatagtaccatattttatctggtcatcactgcgtcgacgcacaaacagcgtgtcgccgcccctgcgctttatccgggatatacaacctgagcattttggccgctgttactgccaaagaaacgtcagcgctattcacaataagtcacattttatgctttttttaaaccccttcgcttttagttatggttcagaaattattaatgatttgcgcttacgtggtggcgaagcgactaatagaaaaggttgatatttatccacagcggctttaacaccttgcggattaatcgtaaattcaccctgcctgcacgcggcgaggcggcatgatacttcgtgtggataagctatttttgcgaggcgtctcgtaaaaaatttaagatagcgcaattaataaagaggataaataacggctgattttgaattccttacattgtcagctattgcacaacgcaaattaacgctctattattagctcaacaaaccaccccattataagtttgagattactacaatgagcgaagcacttaaaattctgaacaacatccgtactcttcgtgcacaggcaagagaatgcactcttgagacactggaagaaatgctggaaaaattagaagttgttgttaatgagcgtcgtgaagaagaaaacgctcaggctgcagaaatcgaagaacgtacgcgtaagctgcaacaataccgtgaaatgctgattgctgacggtattgatccgaacgaactgctgaacagcatggctgccgctaaagtaggtactaaagctaagcgtgctgcacgtccggctaaatatagctacatcgatgagaacggcgaagaaaaaacctggaccggccagggtcgtactccggctgttattaagaaagctatggatgagcaaggcaaaaaactggaagatttccttatcaaaggttaatcacctgccccttgctgaaatcccgccgctggcgggattttttttgcctgcaaattacccctgcccgttacctgttatcacattaccccgttctgtttactggtgaaaaaccaggcatcccatacccctgttttcttaatggccgccgctaaataactgcgctggctggttgcgcaaacaatgaatataggggcagaaacaatcagcaataaaaaagccggagacactccgcaggtggcggcgttatctccggctcagttaaagcccgggtattagcgctttacttcttaaaacccatggactcttccagccaggttttaaattcttcgccatgtgctttgtgacgaataccgtattccacgaaagcctgcatatatcccagcttattaccgcagtcatggcttttgcctttcatgtggtaggcttcaacggtttccttctcgatcagcatatcaatgccgtcggtcagctgaatttcatcaccggctcccggaggcgttttcgccagcagtggccagatttctgcgctcagaacataacgccctacaacagccagattggaaggcgctacgtccgctttaggcttctctaccacgcctaccatcggcacgctctcgcccggtttcagctccgcgcctttgcagtcaaccacaccgtaagcggtcacgtcttctaccggctcaaccatgatctggctgcagcctgtttcatcgaaacgctggatcatctccgccaggttatcctgcgagagatcggattcaaattcatccagaatcacgtcgggcaggatcactgcaaccggctcattgccgacaaccggatgcgcgcaaagtacggcgtgtccaagacctttcgccagaccctgacggacctgcataatagtcacgtgcggcgggcaaatagactgaacttcatccagcaactggcgcttaacgcgtttttccagcatggcttcaagttcaaaactggtatcgaagtggttttcgatagagtttttagaggagtgggttaccagtacaatttcggtaatacccgcagcgatacattcatttacgacatactgaattaatggcttgtcaaccagcggcaacatctctttcgggatcgccttggtggctggcaacatcctggttcctaatcccgcaaccgggataactgctttcgttacttttgaattaagggcagccattgaaaatctcctggaatgttcacattgggaacatgtacataatgaatcacgcgttagagtatatcagcccggagctgtgagccgggtccgaaatgaacgcattgaggcttaattaagacaattacttataatactgcgcagatagtaacacccggagagaacggcaggtaaagctaaatcaccctgccgttgcgtttgctcattcggcagtcaacattaaacgtaaccgaccgcctgcgccccaaacctgacactgccatgcttcgctgcgatggctgacctggtttaaataggtatttcccagcgtacccagcggaacgccgttgctaatctgaatttgatgctcaccggtattaagcgtggcattaagaccggccgacaccagaatgagatttttaagctcatggtggtaatagccaaccagtagcggaaactgccctggtaaatttgcctggcgcagtaattgattaacctgctttaacaaacttcccagttcaggcaaacgctgacgctgatgagagagctgttcctgtaataagccgttaaacaatgcccgcagcaataatgcggctaacacaccgttatcgccggcgcgggtgacatccaggcaataaaatgcgaggtctttttcagagagtgctgcaatatcgagcaccagacccggctgatcggcagataccagctggcgataattaatacggcaatttgagatatgttgctgaaccggaggctgtaactcctgcaacaatttggcggcggcctgcggatcgcttaccagcgcatcccagtcctgaaaaaggcgttcttcttcctctacccgggaattaaacatattgggatagaggcaggcataaaccgtttcacgtaaacggttcagatcttttaccggtttcagtaatacatcctgtacgcccagacgtaaagcacgggcaatgtcggacatattttctgtcgctgatataaccaggatgggcatctggtcgcgctcattgcgcaaatgttccacgagtttcagaccgttcattcgtggcatggcaagatcgcaaatcattaaatctggtctcaccgtcttcatggtctcaagcgcatcgaggccatccatcgccagtgaagtagttgcgcctaaagaagtgagccatgaatccaacagtgaacggaaaacgggttcgtcctcaacaatcaaaatatgttttccagtcaaaggctgcgtcatgttctctcccctgctttgcagtagttcaatagtggcatgctattgcaactcgcgcctgtcagaatttcctgaagtcatcgaatatatttttcgctaaaccgcgccggaaagatgtagcttaccgtgcggttcccctttagctccggatgcgttacacaaaagctctccttgtccgcgtgagacaactggcggagacaagtgaacctcatagggttagcaaaacgtcggatacgttgtcgggaatgccgttgtgtgtaaaccgatgcaggaagacctgaagaggattgcacagctttgcgacgccgtcagggccaacaaactacaccttaatgcctcgcgactaaaccttttacgccctaaatcgttgattaaaccactggcgaacccgtcgccagtccagcctcacctttgctcgtgacgttttttacatccccggcttccagccatagcatcgaggctatcgctcggttaacatagatgcatccatgcgccgttgcgccattattattccaggattacgattttgtctcaaccttgtccctgcggtagcgctcaggagtatagcgcatgttgcgcacgttatgtgtctggtgaacagcttgcgccggatccgtcacatcttatgcgctcccgctatagcgcatttgtattaaaagatgcggattatctgatcaaaacctggcatccgtcgtgtcatgctgccgcctttcgtcaggacatcgaaaagggctttgcgcaaacggaatggcatggcctgacggtttacgcgcacgaagctggtgcaacccaagatgaaggctatgtcagctttgtggcgcgttttagcgagcagggtaaacccggcgctatcattgaacgctcacgtttcctgaaggaaaatggtcagtggtattatatcgacggcacgcgcccactgtttggccgtaacgatccctgcccttgcgggtcaggaaaaaaattcaaaaagtgttgcgggcaataaacccagcttcaccctcatgcaaactcaacaggattttcgcggcaatgcattcattacaacgtaaagtactgcgcactatttgtcccgaccagaaaggtcttatcgcgcgcatcaccaacatttgttacaagcacgaactgaacatcgtgcagaataacgagttcgttgaccatcgcaccggacgcttttttatgcgtaccgaactggaaggcatttttaatgatgccacgctgctggccgatctcgacagcgcgctgccggaaggatcgatccgtgaactgacgccggcaggccgccgccgcgtggtgatcctggtgactaaagaagcgcattgcctgggcgatctgttaatgaaagcgaattatggcggactggacgtggaaattgccgcggtgattggtaaccacgataccttacgctcgctggtggaacgctttgatattcctttcgagctggtcagccatgaaggtcatacccgtgaagcgcacgatgaattaatggcggccgccattgaagcccatcagccggattacgtggtgttggcgaaatatatgcgcgtactgacgccgacttttgtctcccgcttcccgaataagatcattaatattcatcactcgttcctgcccgcctttatcggcgcgcgcccgtatcatcaggcctacgagcgcggcgtgaagattatcggcgcaacggcccactacgtgaatgataatctcgacgaaggcccgatcatcatgcaggacgtgatccacgtcgatcacaactataccgcagaggatatgatgcgcgccggtcgtgacgtagagaagaatgtgctgagccgtgccctgtatcaggtgctggcgcagcgcgtgtttgtttacggcaaccggaccatcattctgtaagcggtaatgaaatgaattgcttagcattgctgcatgacgcataaaaagcaggcaaacgattcattttcacgaaaggaatgctttacagcggcgcgtcatttgatatgatgcgccccgcttccccagcggaggcaggccagtaccagtattaccccgtggtggggttcccgagcggccaaagggagcagactgtaaatctgccgtcatcgacttcgaaggttcgaatccttcccccaccaccatctcttctcaaaatttgaattacccctggtggggttcccgagcggccaaagggagcagactgtaaatctgccgtcatcgacttcgaaggttcgaatccttcccccaccaccatctctgtttcatcccctcataattaaatcaaacaccgacaatatgctttttgcccggtggcgctgcgcttaccgggcctacgaatatcctccaaagatttccctgtaggccggataaggcgtagccgccatccggcgcaacgcaaacaaaaaaccccgcctgagcggggttataacggcgctgaatgcgtgcttagcgacgcgcgcgcactacctgatacttacgcgtcaaatactctaccggtgcgctccagatgtgtaccaggcgcgagaacgggaacaggacgaacagcgtcatgcccagtaccagatgcacacggaaaataaaggccacgccgtccagatgcgcagatgcgccgccgtggaaggtcaccaccgattgcgcccagcccaccagtttcatcatttcactgccgtccatatgctgcgccgagaacggaatggtcagcaggcccagcgcgcactgcaccatcagcagggaaaggatcagaatatccgccccggtggtggtcgcccgtacgcgcgggctgaacaaacggcgtttcagcagtagcaggccgcccaccagcgtaagcacaccacatgcgccgccggcgatcatcgccatcttctgcttcacgtcaatcggcaggaaagattcatacatccagtgcggcgtcagcatccccagtaagtgccctgcaaaaatgccgagaataccgatatggaacagattagacgcaagattcatgcccttgcgatccagcatctggctggagcctgcccgccaggtgtactgaccatagtcataacgcagccagctaccgaccaggaagacggtccccgcaatgtacgggtagatgtcaaagaagaacatattcaggaaatgcattattgctgccccccgttagaaatattcagatactgcggagcgacagcccccgcaaaacgacgctgatgggcgctgatctccgactcgccacagctctgttcagcaaagaatttcacctgctcttcttcccagacggcgtcaagcgcctgcggggtgtcatcacgggcttcaccggcgattttctcggccactttgtcgctgtcaatggtggtgttcgccagattcagcagcacgccgaacagcgtcgcgtacgggctttcacgctgttgcagacgcgcacttaacagcgcgaggatcggggcgatgtcctgcaagccacccagcgcctcgtcttttggcaactgcgccagatattccagatacagcggcagatgatccggcagttcgcggctgtcgagctgcagaccgtggcgctcatactgcgccatcagatccaccatcgcctggccccggtcgcgggattcaccgtgcacatgctcgaacagcaacagcgaggtcgcgcgaccacgatcgaaaagttcgctgtagcgtgactggacatccagcatgtcctgctgcgtcaaatcacgcagaaagaccgtcagcgcctgagcgtcgcttttctcaagattttcagaggaggcgaaaccatcaaataattcctgctgatgctgccacagggcagcatccgggtattccagcaggcgggaaatcatcaccagttcgatcatgggtgcggctccgttttgctggtcacatcgaccgcgtcgatgcgacggctgttgaacaggttaaaggagctgtcagatccgtggcagccatcgccaaaggtaaatccacagccgcttttttccgggaaggcatcgcgcgccagttcacggtgactggacggcaccacgaaacgatcttcgtagttggcgatggccagataacggtacatctcctgcgcctgggcttcggtcagccccacttcttccagcgcacgggtatcgagcacgccgtccacggtttcagcacgtttgaagtgacgcatcgccagcatacgtttcagcgccagcagtaccggctgggtgtcgcctgcggtcagcaggttcgccaggtactgcaccggaatacgcagactgtcgacgtccggcagaataccgttgctgctcagctcgcccgcatcggcagcggactggatcggtgacagaggcggcacgtaccagaccatcggcagcgtgcggtattccggatgcagcggcagcgccagcttccagtccatcgccattttgtacaccggcgagttttgcgccgcgtcgatcacgctctgcggcacgccgtctttcagcgcctgggcgatcactgccggatcgttcggatcgaggaacacatccagctgacgctgatagagatctttttcattctcggtgcttgccgcatgttcaatggcgtccgcgtcatacagcagcacgccgagataacggatacggcccacgcaggtttcagaacacaccgtcggcataccggcttcaatacgcgggtagcagaaaatgcacttctcggatttaccgctcttccagttgaagtagatctttttgtacgggcagccggtgatgcacatgcgccaaccgcggcatttatcctggtcgatcagcacaatgccatcttcttcacgcttatagatcgcgccgctcggacaggtcgccacacacgccgggttcaggcagtgctcgcacaggcgcggcaggtacatcatgaaggtgttttcgaactgaccgtacatcgccttctgcatgttctcgaagttctgatctttggcgcgcttttcaaactcgccgccgaggatctcttcccagttcgggccgtgctcgattttgttcatacgctggccggaaatcagcgagcgcggacgggcgatcggctgatgtttgctttccggcgcggtatgcaggtgctgataatcgtaatcaaagggctcgtagtaatcgtcgatgcccggcagatgcgggttagcgaagattttacccagcagcgtcgcacggttacccatgcgcggctggattttgccgttgattttacggatccagccacccttccatttttcctggttttcccagtcattgggatagccgatgccgggtttggattccacgttgttaaaccacgcgtactccatgccttcacggctggtccagacgtttttacaggtgactgaacaggtatggcagccgatgcatttatcaagattcagcaccatgccgacttgtgaacgaattttcattttacgctctcctgtacctggtcgttgccttcgccatccagccagttaatatttttcatcttacgtaccactacgaattcatcgcggttagaaccgaccgtgccgtaatagttaaagccgtaggccagctgtgcatagccgccgatcatatgggtcggtttcgggctgatacgggtgacggagttatgaatgccgccgcgctgaccggtgatttccgatcccggcaggttcacaatacgttcctgcgcgtgatacatcatggtcatgccggacgggacacgctggctcaccaccgcacgcgccgtcagcgcgccattgctgttgaagacttcgatccagtcgttatcctcaatgcccagatctttggcgtcgctctcactcatccagacaatcgggccgccgcgtgacagggtcagcatcagcaggttgtcgctgtaagtggagtgaatgccccatttctggtgcggcgtcaggaagttcagcgctttctccggattaccgttggatttcttgcccatcaccgcttttaccgagcgggtgtcgatcggcggacggtacaccagcaggctttcgccgaagtcacgcatccactgatgatcctgatacagctgctgacggccggacagcgtacgccacgggatcagctcatgaacgttggtgtaacccgcgttataggagacgtgctcgtcttccaggccagaccaggtcgggctggagatgattttgcgcggctgagcctgaatatcgcggaagcggatcttctcttcctctttattggtcgccagatgcgtatgatcacgaccggtaaactcactgagcgctgcccaggcttttaccgccacatgaccgttggtttccggcgcaagtgtgaggatcatttctgcggcgtcaatggccgtattcagcatcggctggcctttggccgggccgtccgctttggtgtaattcagcttacgcagcaaatccatttcgctctgggtattccaggcgatgcctttgccgccgttgccgattttctccatcaacgggccgatagaggtgaagcgctcccaggtggccgggtagtcgcgttcaaccggaataatgtgcggcgcggttttacccgggatgagatcacattcgccttttttccagtccttcacatccagcggctgcgccagttcggcggcagagtcgtgctggattggcagcgtcacaatatctgtctctttaccgagatggccgacgcacacttcagagaaggacatcgcgatgcctttatagatttcccagtcgctttttgactcccacgccggatcgacggccgcagacagcggatgaataaagggatgcatatccgaagtattcatgtcgtctttttcgtaccaggtggcggtcggcagcacgatgtcggaatagaggcaggtgctggacagacggaagtcgagcgtcaccaccagatccagtttgccgtcgagaccgttatccacccattccacttcttccggcttaacgctgccctgctgaccgagatccagcccctgaatgccgtgctcggtacccagcaggtacttcagcatgtattcatggcctttaccggaagagcccagcaggttggagcgccagacaaacaggttgcgcggatggtttttgccgttttccggctgctctgccgcgaaacggatggtgccctctttcagcgccttcacggtgtaatccaccgggttcatcccggctttttccgcttcggcggcgatgcgcagcgggttggtgcctaactgcggtgcagatggcagccagcccatacgctcggcgcgaacgttaaagtcgatcaggttgccgctgtagcgggatttgtccgccagcggtgaaagcagctcctgcgcggtcagcgactcatagcgccactggctggagtggttatagaagtacgaggtgctgttcatatgacgcgccggacgctgccagtcaagggcaaacgccagcggctgccagccggtctgcggacgtagtttttcctggccgacatagtgtgcccagccgccgccgctctgaccgatacagccgcagaaaatcagcatgttgatcaggccacgatagttcatatcgaggtgataccagtggttcagtccggcgccgacgatgatcatagaacgaccatgggttttatcggcgttatcagcaaactcgcgggcggtacggatgatctgcgcgcgcggcacgccggtgatttgctcggcccatgccggggtataagctttgacctcgtcataactggtggcgcagttggcatcgtccaggccacgatcgaggccatagttcgccagcgtcagatcgtaaaccgtggtcaccagcgcggtgctgccgtcggccagttgcagacgtttgaccggcagtttatgggtcagcacgttgtccagcgccacgctgttgaagtgctcggtgccgtcgccgccaaagtacgggaagccaacgtcagcgatgtcatcgtgattgccgagcaggctcagacgcagatgcgcctcgtcaccggttgtgccgtcgcgctgttcgaggttccacttgcctttctcgccccagcggtaaccgatggagccgttcggcgcgatcagttcgtcgttgtcgttaacggcaacggttttccattccgggttattttcctggccgagggcatccaccagatcggcggcgcgcagcatacggcctgcggcgtagtaaccttcacgctcttccagcatcaccagcatcggcatgtcggtgtaacggcgcacgtaatcggtgaagtactggcttgggttatcgaggtggaactcacgcagcatcacgtggcccatcgccagcgccatcgcggcatcggtgccctgtttcggggccagccacaggtcgcacagcttggcgatttccgcgtagtccggggtaatggcgacggttttggtgcctttgtagcgaacttccgtaaagaagtgggcgtccggagtacgggtttgcgggacgttagagccccaggcaatgatatagctggagttataccagtcggcggattctggcacgtcggtctgctcgccccaggtctgcggggacgcaggcggcaggtcgcagtaccagtcgtagaagctcagacaggtgccgccaatcagcgacaggtaacgcgcgccagaggcataagacaccatcgacatcgccgggatcggcgagaagcccgcgacacggtccgggccgtaggttttcacggtatagacgttagaggcggcgatcagctcgttcacttcctgccaggaggagcgcacaaagccgccgcgaccacgcgcctgtttaaaacttttggctttttccgcgtcttcaataatcgatgcccaggcattcaccggatcgctgtgacgggctttcgcttcacgccacatcttcatcagacgtttacgcatcagcgggtatttcaggcggtttgcgctgtagagataccaggagtagctcgcaccacgcgggcagccgcgcggttcgtggttcggcatatccggacgggtacgcgggtaatcggtctgctgggtttcccaggtgaccaggccgtttttaacaaaaatcttccagctgcaagaaccggtacagtttacaccgtgcgtggagcgcaccactttgtcgtgcgaccagcggttacggtatccgtcctcccagtcccggtttgattcatgaatctggccatgcccatcggcaaaggtttcgcccttctgtttgaagtagcgaaaccggtccaggaatttactcatcgggtttctcctgtaaggagcctgtgcggctctctggtaaatcgacattgctgcaagttgcggcgaaggtaacgcgctgaatgatgacgggaattgatggcgatcaaggcacaccggcttagttatggcggtcgttaaacgccataccaccaaagggggataacctggattttcataacactttgaaatataacgtatttttaaattaacccgtaattttactgtcgatattcagccatgcggggtattagggggtagatgatttcaccctgtgacgccgcgcaacgtttttccacggtgcaacgggtgaaaaattaaagtatgttgtaactatatgaggggtaaaaaaagcgcggcgaggccgcgcaaggataatcaacagtacttactttttattagaattacggccatacaccgcccaggtgatgatcacacaggcgacatagaacacgaggaacactttcatggcatcggccggggaaccggtcagcgccagcgaggtgccaaaggctttcgggataaagaagccgccgatcgcgccaatcgccgagataaagcccagcgcggctgcggtgtcggttgccgcttcgcgcagcgcctgggcatcatcgccgccctgcgctttcacgcgctcaacggtcatcttgcggaaaatcaccgaaatcatctggaagctggaaccactccccagcccggccgtcaggaacagcaccataaacacgccgaagaaggcttcgaaatgaccggcgctggtcgccgtcggcagcgtcaggaacagcagcgcgctgaaaatggccataacgatgaagttcaccagcgtgacgcgggtcccgcccagacgatccgacagcgccccgccacaggagcgggcaatggcgccaatcagcgggccaaagaaggcataatgcagcacattaacatccgggaactgggttttcgccagcatcgcaaatccggcagagaaaccaataaaggagccgaaagttgccagatacaggaagccgaggatccacagatgggcgcgttttaataccggtaactgcgcacggagcgaggccttcgaggtcgccagctcgttcatgccgaaccaggccgcgagggtgaagaccaccaggaacggcacccaaatccatgcggcgttttccagatacagacgcgaaccgtcggcctgttcaacgcctgtgccgccaaaggccgcgaaaatggacatggagatcgccagcggtgccaccagctgcatcacgctcacgccgaggttgcccatgccgccgttaatgcccagcgcgccgccctgcttctctttcggatagaagaagctgatgttcgccatgctggaagcaaagtttgccccggcaaaaccgcacagcagcgcaatgatgatgaaagtactgaacggcgtggtcggatcctgcaccacaaaacctaaccatacgcagggtatgatcatgatcccggtgctgaacgccgtccagcggcggccaccaaagatcggcaccataaaggcgtaaggcacacgcagcaacgccccggatacggacggcagcgcggttaacataaacagctgatcggtcgtaaagttaaaacccactttattcaggtttaccgcgaccgcactaaacaacatccacacgcaaaacgccagcagcaggcaaggcacggagatccacaaattgcggctcgccacacgatggcctttttgttgccagaaagcaggatcttccggacgccattcagtaatgacggatccggtagccctttcaggaacggaagagtgactcatagacacctctgataatcaattcaacgcctgccaccttagggtttacagcggcgcttaagttgatataaatcaaaggaaaagttgacggtcagcggcacaaaaattaaccctactccctaatgggcacttaaaagcgtcaaaaatagtgtggtttttcacggcgctgtaggtattcgccgcatgcatggatctttgtcatccggcatgggcaataaagaggtaactctttttaggtatgggtatactccggggtatgtccgacaataccgcctcactcgcacctgtcccaggtctggagctgccctgacgatgttaaaacgcctgttttctcccctcacgctggttaatcaactggcgctgatcatgctgctgtccacccttatcggcgtgacgggcatggcgatttccggctcgctggcgcagggtgtccagggcagcgcccatgccatcaataaagccggttcactgcgaatgcagagctaccgcctgctggcggccatcccgttgactgctgacgatcagccgctgctggatgaaatgtcgaagaccgccttcagcccggagctggcgcaggccgctgtgcgtgacgaccaacaatcacagctgatcgccctgcaaaatttctggcgcagcgatgtcgagccgggcttaaaacgcgcccgcgaaccgcaggaggtttccgcggaaatcgccacctttgttaatcgcattgatatgctggtgaccgcttttgatcacagtaccgaacagcgtattgagcgcgtggtggtgatgcagtgggctatggcggcggtgatgggttgcctgctggtattcactattgtctggctgcgcgcccgcctgctacgtccgtggcaacagctggtgcgcatggcgcgggcggtcagccaccgggatttcacccgccgggcgaatatcagcggacgcaatgaaatggcgacgctgggcatggcgctcaataatatgtccgcggagctggcagaaagctacgccgtgctggagcagcgggtgcaggaaaaaaccgccgggcttgagcaaaaaaatcagatcctctccttcctgtggcaggccaaccgccgcctgcactctcaggtccccatgtgcgagcgtatttcgccggtgctgaacggcctgcaaagtctgacgctactgcatgatatcgaactgcgtatttacgatattgaagatgaggcaaaccaccaggaatttacctgccagtcggacgccagctgcgacaatatcggctgcaatctctgcccacgcagccaggaagcgtcccccgcagggggtataaccctcaagtggcggctggcggatgcccatatgcaatatggcctgctgctggctcagctgccgccgggccgtcatctcagtcacgatcagcaacaactggtggatacgctggtggaacagctcaccgccaccctggcgctggagcgtcatcaggagcgccagcagcagatgatggtgatggaggagcgcgccaccattgcgcgggaactgcatgactccatcgcccagtcgctctcctgtatgaagatacaggtcagctgtctgcaaatgcagggggatacgctgccggaaaacagccgccagctgctgggtcagatccgcaatgagctcaatacttcctgggcgcaactgcgggagttgcttaccaccttccgcttacagctcactgagcccggtctgcgcccggcactgcaggccagctgtcaggaatacagcgcccattttggcttcccggtcacgctggattaccagttgccgccccgctttgtgccctcgcatcaggcgatccatctgctgcaaattgcccgtgaagccctgagcaacgcccttaaacacgccggggccactgaagtaaccgtgtcggtgacccaacaggcgcagcgggtaacgctgtgcgtgacagacaacgggtgcggcatcccggaacatgccgagcgcaccaaccattatggcctgattatcatgcgtgaccgcgcccagagtttgcgcggcgactgtgtgatccgccgccgggaggccggtggaaccgaagtgataatcaccttcatacctgaaaagcttctctcatcacgaccaggagataacgatgactaatccggaacccgccactatcctgctgattgacgatcatccgatgctgcgcaccggcgttaagcagctcatcagcatggcaaacgacatcacggtggctggcgaagccagtaacggcgaacagggcattgaactggccgaggcgttagatccggacctgattttactggatctaaatatgccgggcatgaacggcctggaaaccctcgacaagctgcgggagaaaaccctctccgggcgcatcgtggtattcagcgtgtcgaatcatgaagaagacgtagtgacggcgctgaaacgcggcgcggacggttatctgttaaaagatatggagccggaggatctgctgaaagcgctgcaacaggctgccgcaggagaaatggtgctcagcgaagcgctgacgccggtgctggccgccagcctgcgcgccaaccgcgccacttctgaccgtgacgtcagtcagttaacgccccgcgagcgcgatattctcaaactcatcgcccagggtttgccgaacaaaatgatcgcccgccgtctggacatcaccgaaagcaccgtcaaagttcacgtgaagcatatgctgaagaaaatgaagctgaaatcccgtgtcgaagccgccgtgtgggtacatcaggaccggattttctgatcagggcgcgggcagcagcagccagcgcggatcgctgacaggttcactggtcagcggttgcgtcagcaccagcgtgatttcattggatgaaacgcgctgccccttctcatcttccaccgtcagcgacaacgtccagcgattgctcgcgccttcacgggcatcccaggcaggcataatgatgctccagccttcaggctgatgagcattgaccggcggcgtcaggctcagcgcctgagtatcgccctcccagacaacgttacgaatgccatgaacgctgcgcacctgcactttcagctccaccgtttcgccgggggagagatcccagggcggcgtggcgaggaacactgacagggttttacgctggcgctgttccaccaccggcagattgttgcgcgtcgggctgtcatagcgactgccgcgcagcgagctggtttgcgccacttcgctggcggaaagctgctttttcagcggtacgccgaaacgataattcagcttaagccccagatcgttctggctgtcgccgctctccccctgcttatgctgcgcggtgagcgtgaccagcggcaccggggtatagttcagccccactttcaccgccatcgggttgtgataaccggtgccggagtcaaagagatcgacgctgtcgccaaaatactgttccagactgaggctggtattgagatgctgataaaagggcatccgcgcctgagcggtaatatcgtagccgcgcgccatgcgctgttgcagggtcgcgccgtcatcatgccagccggacagcggctcatagtagttggccgacagccgcaggtattccccccaggcttccgcaccgacgcccgcgcgttgcagatgggtgtcaatctggttgtcgtaaaaggtgttgtagcccagcagccagttgcctgccatccagcgctggccgatgcccgcgttgctgaccagcccatcttcctgctgggtcaaccccagctggctccagcttaaatagcggttattgtcctgccagggaataaaccagctgccggaactgccggtaaagcgcccttcatcattgacctgcacgttgacgctggcgttgccccagggtgacagtaacgactccacctgctcgttcacttcgccactcaccgcatcgcgcaccttatccagcgcaaactgccgcgcttgctgtccggcgctcaacgtactgtcgctctggctggcttcaccgaaggccttcgccatctctgccagatgcttttcgccgttgttggtgggcggcgccatgcccagatcgggcaggccgtctgcatcattatcaaagggattttgcgcctgctggttccagccgggcgtagccgcgtggctgccgcctgtcagcagcagaaataacaggaaaggatgaaatggtcttaacgctttacgcatcaatatcttcagcgacgtctcacctgccgggtagttgagcggttataaaagtcaatgctaacgttttttacccgtggtttcagctttctgacaaattccaggaaaatccttaatcgctcccgcttcgtcaggactacagttatagaaccgcttatgcacgagatctggtcatgaataaaacgctgaaatgggctttatggagttcgttgatgttttatggtgccgccgccagcgccagcgaactctttatgctgcaatcccccgcctttggggataacgccttactggaaaaacgcttcgccggtaaggctgacaataatcctaactgcaccggcgataacgaatcaccggcgctgatctggagtaacccgccggccaataccaaaagctttgcgctgatcgtccacgatccggaaggcgcgaagggtttaggcgtcacccacctggtggcctataacatttcgccgtctgctaccggccttgccgccaacgatctgcgggacggcaaaaactttactggcggaaaaaatacccccggcaccgataaatggcatgggccctgcccgccgccgggcacaggcgcacaccattatacctttacgctgatcgccaccgaacaggcgcccgatctgcctgccggtttaacccgcgaggagttgctggaaaaactgaaaggtaaagcgctgggcgccgccgggttaatcggccgcttcgggcagtaacgccctcgccagcagagcgttaagttcaggaatacaggatccgcaattggtgccgcagcgcaacgttctgccgagcgaggcgacggaatggcagccgttgcggatcgcctcctgaagggtattttcccccacgccgtaacaactgcacacggtgcggcccggcgctgtctgctcgtccgccgcctgaccgcttaacagcgcatgtcgttcaaacgcggtcgcgggggcacgggcaaaggccgcttccacccgcgcgctgtctgtttccggcagatgacgatcgctccagaaggcaagcattaactccccgttgtgccaggcaagcagatgccacgcggttccggcctgcgcctgttgtaattgccagccctgcgcctcgcaaaatgccatcagccacggctgcgccggtttatcgcctgccagcgtatagtgcgtcaccgacgcggccttacgcagccagtgcaccgacggcggtagagtgacgttgtcacgaccgaacagctccccctgccaggcgggttgccagacactgatacgcacggcggtctgtttgctttccggttgccccgactgcggacagcataccggcgcgaccagcgtattgaccttgccctggcgggcgaacaccgcgttccagtgcatggggacaaataatgatctagggcgctgcgcctcgctgacgaaagcccgcgccaccatcaggccccgtggggaactgatgcgcagcagatcgccggtttgaacgccatgcagtgccgcgtctgagggcgcgatctccacccgcggttcggcgatgtgctgcatcagccgcgccaccgtgccggtgcgggtcatggtgtgccactgatcgcgaatgcgaccgctgttgaggatgaaaggatagcgcgcgtcgggccgggcgcgggggcgttccggcaataccggcaacatacgcaaccgcccgctgtcgcgccagccccgggtcagatcgaggggttttcccaccggccactgcaccggcgtcatctcatcccattgttcacgggtgaggtttgccagcggactgatatcaaacgcccgcctgccgttgttttcatagccggagagcgcggcatgctcgctgaacacctcatggacgtgctgccaggcaaaagcctcgccgtagcccagttgccgggcaatttgcgcgacgatccaccagtcggggcgcgcctcgccgggcgacggcaaaaacgcccgctgacgcgaaatgcgccgctcggagttggtcacagtgccgtttttttcaccccacgcctgcgccggaaaccggatatgcgcaaagcggctggtgtcggtatccgccgccacctccgagacgatgaccagcgggcatgtcgccagcgcctggcagaccgcgagactgtccggcagcgataccgccggattagtacccatgatccataccgctttcacctcgccacgtccgatggcctcaaacagctctaccgccatcagccccggcgtctgcgccagccgctccgtaccccagaagcgcgccacgcgggccagatcctcaggttcaaaattcatgtgcgccgccagttgcgtcgccagcccgcccacctcgcgcccgcccatggcattcggctgaccggtcagcgaaaacggcccgcagcccgggcggtgtattttaccgctcgccagatgcacgttaatgatggcgttgcatttgtcgctgccgctggcggactggttaatccccatggtgtaaagcgtgatggcgcgcggcgcggagataaaccagtcaaaaaaggtattgacctccataagcggcagctcgcaaaactgcgccacccgttccggcggccagtcagcggccacggcagctgcctgttccccctcatcaaacgcccctgcctcgccgccgcgctgcataatggcgtgcagcaggccgacaaacagcccgccatcgctgccgggcgccagcgccaggtgcaggtcggcgatgtcgcaggtggcggtgcggcgcggatcgatgaccacaattttcatctgcgggcgttcacgtttcgcctgcgccagccgctgataaagcaccgggtgcgcccaggcggcgttggatcccaccagcaccaccagatcgctctgctccacatccagatagctgcacggcaccacatccgcgccgaacgcccgtttatagccggtcaccgccgaggacatgcacagtcgcgaattggtgtcgatatttgccgcgccgataaagcccttcatcagtttgttggcggcgtaataatcctcggtcagcagctggccggaggcgtaaaacgccaccgcctgcgggccgaattcatcaataatgctgcgcaggcgatcgcccgccgtggccagcgcctgctcccagtcgcagcgctcgccgtccacctgcgggtgcagcaaccgtcccgcaaggccggtggtttcccccagcgccgcgcctttaacacacagccgcccgacatttgccggatggttttcatcgccgcgcacgctgacctcgccctgatccacgcgggcaatgacgccgcagccgacgccgcagtacgggcaggttgtccgggtttccgtcatgatgcctccgcgcgcagcagcagggcctgattgcccacccacactttgccgttttcaatttttaccggccaggcgcgaaccagcggctcgccgttgtccggcgcacgcccgtcccgcagacgaatgcgctgtttgtagagcggcgaaatgacaatcggctcacccgctgcgtcaccgatcagaccgcgtgacaggacgttcgcctcgctgcccggctccagatcgtccagcgcatacaccgagtgcccgcagcggaacagcgcgatctgccgctcgccgatacgcgcgccgatccctgcctgctccgggatttcctcgacgccgcaaattgcctgccagggtttgccgagggcctgagcatcgccattaatggacgttttaaactgcgccagctgttggggatcgttaagcgtggtctgccactcgcactggtaggtttccacgatacgcgccatctcctgctccagttctgcccccagtcccagcgaatcctccaggatcacctcacgcagatagtcgatgccgccctccaggttatccatccatacgctggtgcgctgtaaacggtcggcggtgcgaatgtagaacatcagcagacgatcgacggtacggatcagcgcggcttcatccatatcgctggcaaagagatccgcgtggcgcggcttcatgccgccattaccacagacatacaggttccagcccttttcggtggcgatgaccccgatgtctttactctgcgcttcggcgcattcccgggtacagcccgacaccgccattttgattttgtgcggcgcgcgcaggcccttgtagcggtgctccagcgtcaccgccagcccggtggaatcctgcacgccgtaacggcaccaggtggagccgacgcaggatttcaccgtacgcagagatttgccgtaggcgtgcccggtttcaaaaccggcgtccgccagttcccgccagatgtcaggcagttgatcgagctgcgcgccaaacagatcgatacgctgtccgccggtgactttgctgtacagctggtattttttggcgatctgcccgacggcaatcagcccgtcggcagtgacctccccggcgggcatgcgcggcaccacggaataggtgccgtctttctggatgttggcaaagaagcggtcgttagtgtcctgcaacggcagatgggcaggtttgcgcagataatcgttccagcaggacgccagcaccgagccgaccagcggtttgcagatctcgcagccctgcccctgaccgtagcgggaaatcagctgatcaaaggtgtggatatggttgacgcgtaccaggtggtaaatctcctgccgggaataagcaaagtgttcgcagatgtcttttttcacctccacgccctgggcggcgagctgaaattccatcacctgcttcaccagcgcgctacagccgccgcagccggtcgccgctttggtgcagcttttgattgcccccatatcagacgccccggcgctgaccgcctggcagatgtctgccttgctgacgttatggcaggagcagatctgcgcgctctccggcagcgctgccacgccgaggcctttcgccgggctgcctgccagctgcggtaaaatcaggctttccggctgcgcgggcagcggcagatcgttaagcatcatctgtaacagcgtggcgtagtcgctggcatcgcccaccagcacgccgccgagcagctttttgctgtcctggctgatgacgatctttttgtaggtctggtgcgggccgtcggtccactggtagctgaggcacttcggcgtgcgcccctgcgcatcgccaaaggacgccacgtccacccccagcagcttgagtttggtgctcatgtctgcaccggtaaagatcgcgttttccccggccagctgagcggcggccaccctcgccatctgatagcccggcgcaaccagaccgtagattttgccctcccacagggcgcattcgccgatggcgaaaatgtcgtcatcgctggtgcggcaggcgtcgtcgatgcaaatgccgccgcgctcgccgatggtgagatcgcagccccgcgccagcgcatcctgcggacggatgcctgcggagaacaccaccatatcggtgtccagcgttccgccgtcggcgaactgtaacgccatgccgctgtcggtttcgacaatggcggtggtggatttactggtgtgcacgccgacgcccagcgcagtgattttcctgcgcagcatctccgcgcccggagcgtccagctgcaccgccatcaggctgggggcgaactccacgacatgggtttccaggccaagctgttttaaggcattcgccgcttccagccccagcagaccaccgccgatcaccacgccgcgtgtggcggtggcggcgctttcgcggatacggtccagatcgtcaagggtgcgatagacaaagcagcccggcagatcgcgccccggcactggcggtacaaaaggatacgagccggtggccagcaccagcttgtcgaaatgggtttcatgcccggcggtatcgcgcaccacgcgcagatcgcggtcgatttccgccacccggcagcacaaacgcaattcgatgccgtagcgggcgaagaaatcgtcctccaccagcgacagggatcccgcgctgcgcccggaaaagtattctgacagatgcacacgatcgtaagcggcgtaacgctcctcacacagcaccacgatctgatacgccagatgcagatcgcggctgacgcactgttctaaaaaatggtggccgaccatgccgtgtcctgccactaccagcgttggttttgtcattgtcttatgtccttcagcctgtggccgggttgcgaaacggtcaaagagccagtcagcactggcgggttgcggggtggcgagcagttcggtaagggtggacgcgctccgacagtcgcccatcagcagcacgcccgcgagcctgccgtcgcggatcagcagacggcggtaatgcccggacagcggatcgaagctgtgccaggtttgatccccggcgtcggcgtttacctgaccggcgctgaacagatcgatgccggtgacttttaaacgcgtgccgctgtcgtgccagtgaaaatcgtcgccgggctggtcgcacagacgggccgccagcacgtcggcctgttgcagacagggggccaccagtccccaggtctggccgtcgatttcgcaacattcgccgagggcgctgataccgctcatagtggtgcgcagctgacgatccaccacaataccgcgccggcacgggatgccgctggcctgcgccagcgacgcgttgggtttcacgccggtggcgatgaccacgcgcgacgccggaacggtgcgcccgtcggtcagcgtgacggcctcctgcccgatgtccgtgataccgctgttcagttcgcaggtgataccgcgcgcccgcaggtgtgccgccagcagatcccctgcccggagatccagctgctgctccatcaggcgatcggcgcggtgcaccagcgtgacactgtcaccacggcgggcaaaggccgccgctgcctccacgcccagcacgccgcccccgagcaccaccaccggcccgcgcgttgccagcatggcgttgacatccgccagcgtgcgaaatgcaaaaacgtgcggctgcgcatgaccgggaatgggtggaataaagggcagcgatccggtggcaaacaccagttcgtcccaggagagctggcgctgatcggtttgtagcgttcgcgctgcatgatccaccgccagcacccgttcgccgtagagcacggtaatgcggttcgcgtcgtaccagtcctcaggcagcagccgcgtattggcaaaaggcttttccccgctcagcacgggggaaagctgaatgcggttataggccgcgcaaggctcgtcgccgataagggtgatggcaaagcgcgtcgcatcgcggctgataagcgcctgcgccagccgggtcgccgccataccgttgccgataatgatcagttgccgcatcatcgctgccccttacgccgctttcggctgtttttcgtagaggaaatgcaggatttgctgacgcaggtggtggtagcggctgtcttccgccagcgccacgcggtgtcgcggacgcggcaggtttaccgccagcacttcccccaccgtcgccgccgggccgttggtcatcatcatcacgcgatccgagagcagtaccgcttcatccacatcgtgagtgatcagcacgatggtggtattcagcgactgctggatctgcatcacggtgtcctgcaaatgggcgcgggtcagcgcatccagtgcgccgaagggttcatccatcagcagcacttttggcttcatcgccagcgcacgggcaatgccgacgcgctgcttcatgccgccggacacctcatccgggcgcttgtgcagcgcatggcccatctgcacgcgctcaaggttgtgctcgatccactcgcggcgctcggctttgctcatggtgcggcgaaacacctgatccacagccagcgccacgttgtcaaagcaggtcagccacggcagcagcgagtggttctggaacaccaccgcgcgttccgggccggggccggcgatttcgcggttatcgcagatcagcccgccctctgtgggcagcgtaatgccggcgatcaaattgagcagcgtcgatttgccgcagccggagtgaccaatcagactgacggtctccccttcgtgaatatcaaaagagacgttttgcagcgcgaggaattcaccgctggcggtggcgaaacgctggctgacggcctgcacctgaataatgggtttcatacgcgactccttatttatcctgccagctgaaacggcgggcgatgagcatcagtccctgctccagcagcagacctacgacgccgatgatgacgatggcgatgagaatgttttccacgttgaggttgttccactcgttccagatccagaagccgatacctgcgccgccggtgagcatttcggcagccacaatcaccagccaggcgatgccaatggacagccgcacgccggtgagcaccgcgggcagtaccgccgggaacagaatgcggcgcagcaccgtccattcagaaagctgtaacacgcgggcgacgttgaggtagtccgcaggaatgcgcttcaccccttcggcggtgttgatcaccatcggccagatggagcagataaaaatggtccagctggaggcgggctcggctttctgaaacagcagcaggccaatcggcagccaggccagcgggctgaccggacgcagcagcgcgatcagcggtgtgaacatgcgcgagaaaaagacaaagcggccaatcaaaaagccgagcgggatccccaccagcgccgccagcccgaaacctatcgccacgcgctgcagggaggccagcacgttccagccgatgcccatgtcgttaggcccgtcgttgtaaaagggatcggcaaacaatgtcagggcggaatccagggtggagagcggcgtcgggaagcctttgctgttaatggcggccagctgccaggcgaccaccagcagtcccagaccgagcagcgcggggataatacgctgcgcaacatcgcgcagatggcgattcaggcgcggcgtgcggcggcgcacctgcaccggcggcaggacgatcacttcgccctgggtggtttccggcttaacggtgatttttttctgtgcaagtgtcatgtcatgcccctttacgttgaatggcaaaacggctggcgtacccttccggatcggtgccgttccagacggtgccgtcaataagcgtgctggcgcgcagcggtgaagaaggcagcgaaatccccccgacctgggcggcggcatcgctgaagatgtcggtgcggttgatgcgagccgcgatggcggcatagtccggtgcggttttaagcagtccccagcgtctgaactgggtcaggaaccacatgccgtcggagtgccacggatagttaacctgtccctcattgaagaaacggatggcgtgggcgtcctgccagcggcggcctgcgccgttgtcgtactcccccagcagacggccggtaagaaactgttctttggtattaagccaggcgcgacgggcaagaatgcgcgcggtttcgcgtttgttttccgccgaggcgtcgatccagcgggcggcctccagcaccgccgccaccagcgcccgcgcggtgtgcggattctgctccacccaggcgcggcgggtgccgaggattttttccggatgatcgggccagatctcctgcgaggtcgctgcggtaaagccgatgcgatcgttaatggcgcgggtgttccacggctcgccgacgcaaaacccgaccatattgccgatacgcatgttcatcaccatctgcggcggcggcaccaccacggtgcggatatcgtcaaaggggttgatcccggcgttagccagccagtagtagagccacatggcatgggtgccggtcggaaaggtgtgtgcgaaggtgtagctgcctggcgcgctctggccgatcagggttttcagtccggcggcatcacgaatgcctttctcctgcaactccgccgacagggtgatcgcctggccgttctggttcagcgtcatcaggttcgccatcgcctggggtttggggccgatgcccatctccagcccgtaaagcagcccgtacagcacgtgcgccgcatccagctcgccggaagtaagtttgtcgcgcaccgccgcccaactggcttctttggttggtacaagggtgatgccatattttttatcgaagcctttaagggcggcgatcaccagcggcgcgcagtcggtaagcgggataaaaccgacgcgcacgatctgctgctccggcttgtcagagcctgccgcataagccgcctgcatcacgcccggtaacaacaggctgccgcccataacggcggtggcctgtaacaggcgtcggcgggaaagagaaaaggttgaatcagccatcaccactcctgaagcaaaaaaaagcgcccggcagtgctttcgcaccgcaggacgcctttatcctcaaaacctgcctgccgccattggcgggccggttcagtatgttgtgacaggagtaatgcaaaggggatgccaggtttcaacccctcaccccggccgtctccgcagatcgtaggcccggcaagcctgcgccgccgggcgggacggacggcacgatgtctgttgccgggtggcgctgcgcttacccggcctacactgaatcccgcgcaccgggcatgtgcatcttttgcccgtaaaccgtgcaactactccttttggattactgccagagatttttcaccgttaacagcgcccgggcgatctccaccatgcgctggtttttgtccatcgccattttgcgcaggcactgccatgcctgctcttcggtcatattctggtgtgtcatcagcacgtgcttggcgctgtcgatcaccttgcgctcgtcgagggaggctttcagcgacgccagctgcgtagtgagctgatccagttcgcgcgcctgctggcgcaccagcggcaacagctgatgatcagagcacagcgacagcccctccccggcgggttcaagaaaggcggcgcttagcggcggggcctgatcctcttccgccagtaaggtcgccacggtatgcatcagggcgtcgatcagtgattcttccagcgcgcgtagctgttccagccgctgcgtgtgcagcacaaaccagcgcagcgcgttttccccctgatcctgcggcggctgacgggtacaggccagacgacgcagctgttcgatctccagcgtcgccccgcagcgggcgtgaaaaatgtcgctcagttcgccggtggtgagcgaaaggaaagtatcaaaacagggctgctgaccgtcgatgcgatccaccagccgctggcgcagggcgtcgctgaaatgaccgagggtaaaaccaagcgcccccagcgcccgctcctgccccgccagctctttaccctgcatcaggctgtagagcgccaccagcggctgcacaatgcgcggatcgtcgagggtgtcgttcagctgcggcacaatacttaacagatgacggatggtggcactgaactgttccatggcttccgctgcttctgttcgttgttcgtgcacgcgctgacgtaattcaggcagctgttccagcccccagagcgcggaggcgatacgctggcacagggcgctgctgttcagcggctggtcaaaacgcagcagcggcagcagcgcctgccgttgttcatccaccagcgcgcggctggcgcgacactcggcttcatacaatcgcccctgcgaacagagccagatgttggaagcgccgcgttcgcactgtagcatatgcaccagatggcagatcctgcttgccagctcacccgactgcgccagctggcggagttgttgtttctggatctggcgcgcgtaacgaaaccagtcgatggcgctgttcgcgcggtcagcatttatggtcatgcttattctcccggtcaatgtgtccgctgaataaagcaataatcatgccttgtcgaaggagtgaaaatgcaaaagatagtgatcgtcgccagcggcgcggcgtacggcagtgaatccctgtttaacagtctgcgtctggctatcgccctgcgtgagcaggatcctgcccccgaactgcggctgtttttaatgtccgatgccgtcaccgccgggctgcgcggccagcgtcctgccgaaggctataacattcagcagatgctggagatcctcaccgcgcaaaacgtgccggtgaagctgtgcaaaacctgcaccgatggacgcggcatcagcgcgttgccgctggtagagggtgtggaaatcggcaccctggtggagctggcgcagtggacgctggcggcagacaaagtgctgactttttaataatcacgctgctttaatatatatttcttatagatgtcatacgggcatcaagtttgcctgctgcgttgccgatagcttttttataacaacacagcaggtacaacatcatgatcaggtccattcgcgcgcgcattattgtggcgacagcaggctgtctggctatcgctttgcttcttaacactattattaattatcaggtggcccgtcaggacaaccagcagacccggcaggatattttaaccagcacgagtaacagccacagtctggcaatcgccgactgggtgaacagcaagatgacgatgatcgcctcgttacagagcgtggcggtgcaggacgatccggtgccggtcttcaaacagatcgctcaggcgggcggttttactaacgtttatgtcggcaatgcggcgaaaaccgccaaattctccgatcccaccggcgtgcccgcagattacgatcccactatccgcccctggtatcagcaggtgctgaaagccgatgcgccagtggtcaccgcgccctatgtggacgcgggcaccggtaagttggtggtgacctttgcggtgccggtgaaagtgaacggtacgctgacggcggtggtggccggtgatgtgaccatggacagcgtggtggcgaacgtacagggtattcagcccacgccgcaaagcagcggcctgctgctggacagcgacggcacggtgatcgccgccagcgaccccgcgctgaccttaaaacccttcagcgacgccatccagggcgtggaattcagcgcccttaaagcgggtcacgctgaagacggcacgctggccggtgccgacaaaaccctgctcgcctcgccggtgaaaggcacacagtggctgctggtggtggcgctggatgacaatgatgccaccagcggactgagcgcccagcttaaagcttcggcgctgtcgcttgtcgtgctggtgcttactggcggcgcggtgatgcactggctggtggcgaccctgcttaaacgcctggtcaccatccgcgatgcgatgcacgccatcagcaacggcaccgacgatctgtcccagcgtctgccggaaaacggcaacgatgaggtggcggagatcgcccgtgcctttaacgccttcagcgataagctggcggtggtgatggtcaaactgcgggattccagtacctcggtgaaattcgccgcccgggagatcgccgccggtaaccaggatctctccggacgtactgaacaggccgcctccagtctgcgcggcactgccagcgccatcgagcagatcaccgcctcggtgggccagtccaccgattccgccgccctggccaatacccaggcgcaggccgcctctgaagccgcatcacgcggtggcgacgtggtgaaacaggcgatcaccaccatgcagtctattgaagaggcatcgtccaaaatcggcgacatcaccagcgtcatcgacggcatcgccttccagaccaatattctggcgctgaacgccgcggtggaagcggcgcgggccggggaacagggccgcggtttcgccgtggtggccggggaagtgcgaacccttgccagccgcagcgcgcaggcggcgaaggagatcaaatcgctgatcgaatccaccacccagagcgtgtcgaccggctcacgttatgtgcggctggcaggggaaagcatgggggatattgtatcgggcatcgacagcgtatcggtgatcatgcgtgaaatcaccgtcgccaccagcgagcagatgaaaggcattcaggaaattaaccacgcggtgatcgaccttgaccgcatggtgcagcagaacgctgagctggtagtggaatctgcggcagcggcggatgcgctgcaattgcaggcagcggagctggcggaaaccgccgggcacttccgcatctgagtctacggcagcgcggcgtgcgctgccggtcctgtcaggcaaaacctggctgcatctccgggccgggtttttcgtcgcataataagcggcgtactttacccaccagatcgtttaagcagtcgtcgtgcatgccgagcttaatcagctcctgctccagcgagaaaagatactgcgcgttggtgccgagcgggccgctggcggcggcaatcagcggggcgatcacctgggcgcgggtatcggattcataaagcgcatgtcgcggatccataataaagaccagcgcgttaatggtacggccatcgtcgagggtgagtttgcaccagctcggcagatagcagccggtgatcatctcgcgcttccacagcagcgaaagttcgtcgtgcagggtgtcatcggcgagccggtaggccacgcccgtggtgcgtccgccctctttcagggcaagcatgcgacccggctggcaggcgctgccccgtccggcggtcaggcgcaggcaaaaggcacgatgccagccaaccagggtgccggtacaggattcggtatattccagcgccgggttccacatcagggagccatagccaaaaatccacaccgggccatcgtccgggcggcaggccagggtcgccgccagcgaggctgcccgctgttctgctgaccagagcagggattcttctatctcgccaaaagccgttttacagtcggccttcatcaaaaaatcacgcgttaacatcgtttacctccaccactgcgtgcatccatgcgactacttttttgacgccttccaggcttttttggtgctttttaagaaagcaacccgctacgacgatatgcaattcacgggccgcttgcaagccagacgcaggcgtaagcggctcacttattgttatcgggcggtggaggaaaatctaaagcgtatttatttcagctgattatttccttttgtgccatttgtcgtcatcacccttttcatagtcatgtttcaccgctgcccacgccactttgtgggcggtctcttcacggctggcatcgcccttgcgatcctctttatctttgtactgatcccaggcgctgttgaaggcttctttatagatatcctgcgcatgggcaggtagcacatgttgtacgctgtccggtaagtcggttcgggatttaaacggcatgataagtcctcagtcagggataaaacctaagtgtggacgacaaccggcattgctgccagcgcagaggtatttttgaaaatcaaacgatataaataactgttattaatgggtataaatataatatcttataaatatagccacttcatattgataatatgattttcccgtaaaattaggtaaacataacaccgcttattaacaggatctgttattttaccggtctgctgaattttcaaactaaacttattacgcacctgcaaacacggagatggataatgccgacaacgatcgaggcggttaaaacccgccacaaggagacctccctcattttcccggtagtggccctggcagtgctgctgctgtggggaagcagccagtcactgccagtggtcattggtatcaacctgctggcgctggtcgggatattaagcagcgcatttagtgtggtacgccatgccgatgttctggcacaccgcctcggcgagccttacggttcattaattttaagtctttccgtcgttattctcgaagtgagccttatttccgccctgatggcgaccggcgatgccgcgccgacgctgatgcgcgatacgctctattccatcattatgattgtgaccggcggtctggtgggcttttcactgctgctgggtggtcagaaattcgccacccagtatatgaatctgtttggcattaaacagtatctgatcgccctcttcccgctggcggtgattgtgctggtcttccccatggcgctgccgggcggtaatttcagcacctcgcaagccctgctggtcgcgctgatttccgccgccatgtacggcgttttcctgctgatccagaccaaaacgcaccagagcctgtttgtttacgagcatgaagatgatggcgatgatgacgatccgcaccacggcaagccctccgcgcacagtaatctgtggcacgcgctgtggctgattattcatctggttgcggttatcgccgtcaccaaaatgaacgcgaatccgctggaaacgctgctgacggagcttaacgcccctgtcgcctttaccggtttcctggtggcgctgctgatcctctcgccggaaggcctgggcgcgctgcgcgcggtgctgaataatcaggtgcagcgtgcgatgaacctgttctttggttcggtgctggcgaccatttctctgaccgtaccagtagtgacgctgatcgcctgggcgacgggtaacgatctggtgttcagcctgggcgggccggagatgattgttatgctgtccgcgctgttgctgtgtcagctgtcattctcgaccggtcgcaccaatgtgctgaacggcgcggcgcatctggcgctgtttatcgcctatctgatgacgatattcgcctgacaacggacgggagtgtaggcccggcaagcttgcgccgccgggcacaaaacctggcaaagtgttcgttttatgtcaggtgtcgctgcgctaacctgacctactcaaaataacgcttacataagtgaaaacgtcacgccgggatggcgtgacgtcgggcaggaattagtgctcggtatccagctcagggaagcttttcaccagatcgtcaatggctttgatctgggtgaggaactgttccagcttcgccagcggcagtgcggacgggccgtcacacttcgcgttatccgggtccgggtgcgcttcgataaacagacccgcaagccccgttgccatgccggcgcgtgccagctcggtcacctgaccgcgacggccgcttgacgccgcgccaaagggatcgcggcactgcagggcgtgggtcacgtcgaaaatcaccggggagttgccggagactttcttcatcacgctgaagccgagcatgtccaccaccaggttgtcgtagccgaagttagcgccacggtcgcacaggatcaccttctcgttaccgccttcgcggaatttatccacgatgttgcccatctggccagggcttacgaactgcggtttcttcacgttgatcaccgcaccggttttcgccatggcttccaccaggtcggtctgacgggctaggaaggccggcagttggatcacgtcaaccacttcggataccggctgcgcctggctggcttcgtgcacgtcggtgatcactttcacgccaaaggtctgcttcagctcctggaagattttcatcccttcttcgaggcccgggccacggtaggagtgaatagacgagcggttggctttgtcaaaagaggccttgaacacgtacggaatacccattttctgcgtaacagtcacgtagtgttcacaaatacgcatagcaagatcgcgtgactccagcacgttcataccgccaaacagcacgaacggcaggtcgtttgccacgttaatatcgccaatgctaaccactttttgtttcataggatcgccttatcaggtttggatcgggaggtatcagtgcagcgtgatctgcttgtgcgcgatgttgttaatctgcgcgcggatcatttcgctgatcggatcttccggacattgttctacaaaataacttaaatcattgagcgcgacatggtcgcagtcgagctgggcataaatcaggccgcggtcgcgaatttcatacggatcttcgggattgaactgtaacagcgcttcgctggcgcgcagggccagctccatttgctgctcttccatcagcgccgatttcagcgtatccagcagtttgcggatcacttcggcgttgtcggcctcgtccagatcttcattaaagagttccgcaatggggctgatattacccttgagccacacttcgagggtgtgctcgtccagcgtgtcgccgttgaacggattgatcagccacatttcgctgtccatccattcggcgcgtaaaattaactgcgtcgggaagatcaccggcatcagcggaatatccagcctgtccgcgacccacagcaaaatggcgcccagtgaaacggcgctgccctgacgatttttcagcacgtgatccagccacagagcatctgacaggcggtagacgccgcgcgtgtcccgaaagccccactcaccgtaaaacagctcgatgagtttctccagttgccagtcctgaggcttcgcctcgctaatctcttcccgggccagactgaccagcccttccagctcgtcgtagacatactgtgaggggaaatcatcgcggatcaactccgatacgaggatcatcccgtcacataacggcgctttattaaattcgaaatctgccaacgacttcatcatttaccccagtaacggtatttttgtggtggcgagtttaatgatgatgtacagcaccaccagccccagcagaagcgcgataaacccggcctgctggctgcgagggcaacattacccctgcgcaagaaaacccaaaacgctgtgatgataacgccaaatgacgtctgcgtcagccatgccgctttcatcatcgtgacaacagcgacgagaaaaggcatgccgagacgggttaaagcattcaccgcgcttattcctgtagcgctaaccggccaagcgtgatgcgctcattaccgccataatcgcgacaggtttcgatctgcgcataaccctctgcggcaaaacaggcgcgcacggcggcgccctgctgccagccatgctccagtagcagcgttccgccgggtagtaagaatgattgtgcgtgatggataatccacgccagatccgccatgccctgatcgcccgccaccagcgcggtgcgcggttcaaagcgcacatccccctgcgacaggtgcggatcctgctcatcaatgtagggcgggttactgacgatcatcgcaaaccgctcgccgtccagcgcgctgaaccagtggctttgcagcacactgacgttgcggatatgcagatgctccgcgttgcgccgggcaagggccacagcgtcgggcatcatatcgacggcaatcacatcgcagtccgggcgttcgcttgccagcgccagcgcgattgcgccggtgccggtgcccagatccagaatacgacagggtgagtcaggcagacgcgccagcgcctgttccaccagacattcggtgtccggacggggtatcagcgtggcgggtgagacgaaaagcggcagcgaccagaactcccgtacgcccaccagatgcgccaccggctcgccctgcacgcggcgcgccagcagttcgctgagctgcgcctgttctgcgtccgtcagcagcgtctcgccgaaggcaagaataaaagtgcgggcgcgtccggtgacaaatcccagcaggatctcggcatcgcgccgcgggctgtcgctgcccgcaagctgttcaatggcaaggcgtagccaggcgtggtaatccatcagtcctgctcggaaagcgcggcaagctgatcggcctggtattcctggacgataggctcgatcagcatatccagttttccttccatcacttcatccagacggtagagcgtcaggttgatgcggtggtcggttacgcggccctgcgggaagttataggtgcggttgcgatcgctacggtcgccgctgcccagcaggttacggcgcgtggacgcttcggcctgctggcgtttggcgatttcggcggcgcgaatacgcgaacccagcacggagagcgctttggctttgtttttgtgctgggaacgttcgtcctggcactccaccacgatcccggtcggaatgtgggtgatacggatcgccgaatcggtggtgttaacgtgctgaccgcccgcgccggaggagcggaaggtatcaatacgcagatccgccgggttgatgtccggcagttccgcttccggcaattccggcatcagcgccacggtacaggcggaagtgtgaatgcggccctgggattcggtggccggtacgcgctgtacgcgatgaccgccggattcaaatttcagtcggccatagacgccttcgccgctgattttggcgataatttctttataaccgccatgctcgccttcgttggcgctcatgatctccacgcgccagcggcgggattccgcgtaacggctgtacatgcggaacagatcgccggcaaagagcgcggcttcatcgccgccggttccggcacgcacttctaggtaggcgttacgttcatcatccggatcggtcggcagcaacagcacctgcagatgctgttccagttgttcggttttctctttcagctcgcgcagttcttcctgcgccatgtcgcgcatttccggatcctcgagcatcagctgcgcggtttccatgtcttcctgaacctgtcgccagtcagtaaagcagcgtgagacatcgctcaactgagcgtattcgcgcgataaggcacgaaaacgatcctgatcggcaatggtccccgcgtcgcccagcagcgcctgtacttcttcatgacgctcgtgcagggcttccagtttggcaacgatagaaggcttcataggcgtaaatgcaccctgttctgttattagaggttgttgtgctactccagcccgaggctgttgcgcagaatatgcaggcgttcgtcatccccgttacgggcagcctgctgaagagatttggttggggcgtggatcagcttgttggtcagtttccacgccagatcctgcatgatggcctgcgcatcgccgcccttttccagggctgcgagggcttttgctgtcagttcatcccgcacctgttcggcctggctgcggtattcgcgaatggtctcgctggcgctttgcgcacgcagccaggccataaattcgctggtttcctgctcaacgatggtctccgcttccacggcggcggctttgcgctgcgccaggttgtgggaaatgatgctctgtaaatcatcgacgctgtacagataggcgttcgccagcttgctgacgtccggctcgacgtcgcgcggcacggcgatatccaccagcagcatcggctggttacgacgggctttcagggcgcgttccaccatgcctttgccgatgatcggcagcgggctggccgtggagctgataataatgtcggcgtctttcaggcgctcatcgatatcgctgagcgaaatcacctcggcacccacttcatccgccagcacctgtgcgcgttcgcgggtgcggttggcgatgatcatgttcttcactttatgctcgcgcagatgacgcgccaccagttcgatggtttcacccgcgccgaccagcattaccgtgacggtggataacgattcaaagatttgacgcgccagcgtacaggcggcgaaggcgacagagacggcgctggcaccgatgtcagtttccgtacgcacgcgtttggccaccgagaaggatttctgaaacatgcgctccagttcggtggcgttaaggtgcccgcggctggaatcggcaaaggctttcttgacctggcccaggatctgcggctcgcccagcaccagtgaatccagcccgctggcgacgcgcatcagatggcttacagcgtcgttgtcctgatgccagtagaggcttttacgcagttcttcttcattaagatgatggtaatcgcacagccagcggatcaacgcttcctgtaaatcgtcacgctcttccacgctgaggtaaagctcggtgcggttgcacgtcgagagcaccacgccgccctgcaccattggctgagccagcaggctttccagcgcctggtcgagcgtatccggcgaaaacgaaacacgttctcgcaacgcaacaggcgcagttttgtggttgatgccgagcgctaaaagggtcatgtcagcgggagtagtaccagcgttgataaggttagtctgtgcgcatcatacaggatgcgtgaggtcaataaaagagagcgcccccttttggagtaatcgataatataatgatttaagacaagttgaacgtagacgctgtgccgccgcggcgctagcattaacgatataactgcaacgtattacaaggatttttcctcattatgatgtcagccaatacccgcctgctccgccttctgccgctcgccagccttgtgctgaccgcatgtacactcaccgcgccaaaaggaccgggtaaaagccctgactccccgcagtggcggcagcatcagcaggaagtgcgtaatcttaaccagtatcagacccgcggtgcctttgcctatatttcccctgagcagaaagtttatgcccgttatttttggcagcaaaccggccaggataactaccgtctgctgttgaccaatccgctgggcagcaccgagcttgagctgagcgcccgtccgggtaacgtgcagatcgtcgataataaaggccagcgctataccgcgaccgatgcggaagagaccatcagcaagctgaccggcatgccgatcccgctcaatagcctgcgccagtggatcctgggtctgccgggcgaggcgacagactacaaactcgacagccagtaccgtctgagcgaactgaactactctgaaggcggcaaaacctggaaagtggtttacggcgactatgacgagaaaaccaaaccgagcctgcccgccaatatggagctgacgcaggacggacagcgcatcaaactcaaaatggataactggattgtgaaatgatgacccagtggccctctccggcaaaacttaatctctttttatacattaccggtcagcgcagcgatggttatcacgagcttcagacgctgtttcagtttctggattatggtgacaccctcagtatcgcgccccgtcacgatggcgctatccgcctgctgacgccggtggctggcgtgccggatgaggaaaacctcatcgtgcgcgcggcgcggttattaatggacgccgcccgtcagcgtgattgtctgccagccgggagcggcgctgacatccgcattgaaaaacgtctgcccatgggcggcggtctgggcggcggttcatctaatgccgccaccgtgctggtggcgctgaaccatctctggggctgcggcttgtcggtggatgaactggcggatctgggcctgcaacttggcgcggatgtgccggtatttgtgcgcggtcatgcggccttcgcagagggcgtgggtgagcagttgatcccggtcgatccgccggaaaaatggtatctggtgatgcatcccggcgtcagtattcctaccccggttattttcaaagatcctgatttgccaagagacacgccgaaaaggtcaattaatacgttgctaaattgtgaattcggcaacgattgcgaggttatcgcaagaaaacgttttcgcgaggttgatgccgcgctttcctggctgttagaatacgcgccgtcgcgcctgactggcacaggagcttgtgtctttgctgaatttgacaccgagtcctctgcgcgtcaggtgctggagcaagccccggactggctacatggttttgtcgcgaaaggtgtaaacctttctccactgcaccaggctatgtttgggcaacctgagctccggtgacaacgtcaccctgttccagacgttgcatcgcgctctttaatacaccgctggatagtgttttgcctggcccgcacagtttttggcgacgctatccaccactggacgcatgcctgaggttcttctcgtgcctgatatgaagctttttgctggtaacgccaccccggaactagcacaacgtattgccaaccgcctgtacacttccctcggcgacgccgctgtaggtcgctttagcgacggcgaagtcagcgtacaaattaatgaaaatgtacgcggtggtgatattttcatcatccagtccacttgtgctcccaccaatgacaacctcatggagttggttgttatggttgatgcgctgcgtcgtgcttctgcaggtcgtatcaccgctgttattccttactttggctatgcccgtcaggatcgccgcgtgcgttccgcgcgtgtgcctattaccgcaaaagttgtcgccgatttcctctccagcgtgggcgttgaccgcgtactgaccgttgacctgcatgctgaacagatccagggcttctttgatgtgccggttgataacgtgttcggcagcccgatcctgctggaagacatgctgcaactgaatctggataacccaattgtggtttctccggacatcggcggcgtggtgcgtgcccgtgctatcgccaaactgcttaacgataccgatatggctatcatcgacaaacgtcgcccgcgcgcgaacgtctcccaggtgatgcacattattggtgacgtggccggtcgtgactgcgtgctggttgacgatatgatcgataccggcggtaccctgtgtaaggcggctgaagccctgaaagaacgtggcgccaagcgtgtattcgcctacgcgactcacccgatcttctccggcaatgcggctaacaatctgcgtcattccgtcatcgacgaagtagtggtttgcgacaccattccgctgactgacgaaatcaaatctctgccgaacgtccgtaccctgaccctgtcaggcatgctggcggaagcgattcgtcgtatcagcaacgaagaatccatctctgcgatgttcgagcactaatcggacacagcgtaaaaacccgccgcggcgggtttttttgtctgtgatttttatttgtatgattaatgctttccattttaattattcatgaaataaatggattgcgcctgaatgaaatgaaaacagtgaaaaaattgacgtcttttgatgctcttccttttcgcgcccttatcgacgcctgctggaaagaaaaatactctctgtcgcgctttacccgcgatctgattgccgggatcaccgtcggcattattgccatcccgctggcgatggcgctggcgattggcagcggcgtggccccgcagtatggtctgtacacgtcggcggttgccgggattgtcattgcgctgaccggcggttcgcgcttcagcgtctccggtcctactgccgcttttgtggtgatcctttatccggtatctcaacagttcgggctggcggggctgctggtcgccaccctgatgtccggcgtattcctgatcctgtttggcctcgcccgttttggtcgcctgattgagtatattccgctgtcggtcacacttggctttacctccgggatcggcatcaccatcggcaccatgcagatcaaagattttctcggtttgcatctcacacaggtgcctgaacactatctgcaaaaagtaggcgcgctggcaggcgcgctgccgacactcaatccgggggatgccgccatcggcgtggtgacccttggcacgctgattttctggccccggcttgggatccgcctgcccggccatctgcccgcgctgctggcaggttgcgccgtgatggtggtggttaacctcgcgggcggccatgtggcgaccatcggctcgcagttccattatgtgctggcagacggcacccgcggcaacggtattccgcaactgctgccgcagctggtgctgccctgggatatgccgggatcgcactttaccctgagctgggcctccctgcgcgccctgcttcctgccgctttttctatggcgatgcttggcgccattgagtctctgctttgcgcggtcgtgctcgacggcatgaccggcacgcggcataaagccaacggcgaactcattggccaggggctgggaaacctggtggcgcctttctttggcggcattaccgccaccgccgccatcgcccgttcggcggccaacgtgcgcgccggagcaacctctcctgtttcctctgtcatccacgctttgctggtgatcctcgcgctgctgatcttagccccgctgctctcctggctgccgctgtcggcgatggccgcgctgctgttgatggtggcatggaatatgagcgaagcgcataaagtggtgaacctgctgcgcaccggcccgcaagacgacatcattgtcatgctgctgtgcatgtcgctgacggtgctgttcgatatggtgatcgccatcagcgtcggcatcgttctcgcctcgctgctgtttatgcgccgtattgcgcgcatgacgcggctggcaacggtaaatgtcgaagtgccggaagatgtactggtgctgcgggtgatcggaccgttatttttcgcggcggcagacagcctgtttaccgatctggcgacgcgctgcgtgggcaaacgcatagtggtgctgaaatgtgatgcggtgccggtgctggacgcgggcgggctggatgcgtttaagcgcttggtggaacgtctgccggaagggtgtgaactgcgggtgagtaatctggagttccagccgctgcgcactatggcgcgagcgggtattaagccgattgaagggcgtctgtcattctatccggataaaactgcggcgctggccgatctgtgacgctatggcccggcggcgcaagcttgccgggcctgaaggccagaaccaatgttatcagctgtggcgatgattctggtcgcggcggcagcgtttatcgtagtgacgcacccaccagtacttatcgcatacctgttcatgcccgccgacgcgcgcccccgccagccacaggatcgcaccgacgaagatgcttaaaatagcgccatgggcgaagtattgcggcaggtcaaactgcggaagctggttcagtatggagtagcccacgccaaccaccatcactaccagccctaaccccattaatacgttaccgagcaacgacgcgtttttgcgtttcatctgtcacctccgggatgccgggttgcagggaaaagtccctgttccttgtgtgtaaagtataggcaacaccccgcagaacggttgcggcgacgatcacagttattaacatcagataaacacaactttacatataaaccgctgaactgcttgattttctaatagttcacactctgaattattgggatttcctgataaccgcagcagaactttgtcaaccggccccgcaccacgtaaactacgccccaaaatgtgatcccttcaggaacgaagacgtgacgattaaactcattgtcggcctggccaatccaggcgctgagtatgctgccacccgccacaatgcgggtgcatggtatgttgatttactggccgaacgctttcgcgcgccactgcgtgaagagccgaaattcttcggtttcacctcgcgcattaacgttgccggcgccgatgtgcgcctgctggtgcccaccacctttatgaatctcagcggtaaagcggtggcggcgatggctaccttctatcgcatcaatccggatgagatcctggtggcgcatgatgagctggatctgccgccgggcgtggcaaaattcaaactgggcggcgggcatggcgggcataacggcctgaaagacattatcagcaagctgggcaataaccccaattttcatcgcttacgggtgggaattggtcatccgggcgataaaaacaaagttgtcggcttcgtgctgggcaaaccgcctgtctccgaacagaagctgatcgacgatgcggtagacgaagcggcgcgctgtaccgaaatctggcttacggatgggttaaccaaagcgaccaaccggctgcatacttttaaggcccagtaagcgcggtgcatggcttttttgccccgcacgatgatggttacgtgtataataggcagagttattaacttttctacaatctgttatctctaacgggttgaatatcaagacattaaggtgatttaaaccatgggattcaaatgcggtatcgtcggcttgccgaacgtcggtaaatctaccctgttcaatgcgctcaccaaagcgggcatcgaagcggcgaacttcccgttctgtaccattgagccgaataccggcgttgtgccgatgcctgacccgcgtctggatcagctggctgaaatcgtcaagccgcagcgcattctgccgaccaccatggaattcgtggacatcgcaggcctggtcaaaggcgcttccaaaggtgaaggcctgggcaaccagttcctgaccaacatccgtgaaaccgaagctattggtcacgtggtgcgttgcttcgaaaacgacaacattatccacgtgaataataaagtcgatccggctgaggatatcgacgtcatcaacaccgagctggcgctgtccgatctggatacctgcgaacgtgccctgcaccgcgtgcagaaaaaagccaaaggcggcgataaagacgcgaaggctgaacaggcggcgctggaaaaatgtctgcctcaccttgctgaagcgggcatgctgcgttccctgaacctgaccgacgaagacaaagccgcgatccgctacctgagcttcctgacgctgaaaccgaccatgtacatcgccaacgttaacgaagacggttttgaaaataacccgtacctcgataaagtgcgcgaaatcgccgccaaagaaggttcagtggtggttgccgtttgtgcggcggttgaagcggatatcgctgagctggacgatgccgatcgcgctgaatttatggcggaaatgggtctggaagagccgggcctgaaccgtgtgatccgtgccggttacgaactgctgaacctgcaaacttacttcaccgctggcgtgaaagaagtgcgtgcctggaccatcccggttggcgccactgccccgcaggctgccggtaagatccataccgatttcgaaaaaggctttatccgcgcccagactatcgcgtttgaagacttcatcgcctacaaaggcgaacagggcgcgaaagaagccggtaagatgcgtgcggaaggcaaagactacatcgtgaaagatggcgacgtgatgaacttcctgttcaacgtctgacgatcgcgttatacctgctcaaatccacgctccggcgtggattttttttgcccgcgcttcagggtgcgttccgtgccagtaaggtgataataaacacgccaccgatacccgccgtgataatgccaatcggcaactcctgcggcgccagcattgtccggctgacaatatccccgccgcacagcaggatcgccccccagatgccgcataacggcagcaagcgcagatgctttacccccgcgaaatgccggcacaggtgcggcaccattaatcccacgaagccaattacgccggttaatgccaccagcagtgaggtcgccagtgcacagcagagaaatatctcgatgcgcaggcggctgacgttaatacccagcgagagcgcggtctgttctccggccagtacgccatccagggcgcgccagcggaacaggacaaaaataacgatcaccagcaggctgagcagcgcgaagggaagattactccaggtggctaaccccagcccgcccagtgaccagaacagcacggaactggctgcccgctgatcgccggaaaaaatcaaatagctggtgagcgcgccaaataaaaacgagatggccagcccgcaaagcaccagatgctcagcgccgcgttgttttttaaaatgaaacaggagcagtaccgcgattgccgaacaaagccccccggcaaacgccgcgacgggcagcgtcagggcccccagccgatcgccaaaacgggtgatcaccagaaccgccccggccgacgcgccggatgagaggccaaacaggaagggatccgccaggtcattacgcgtggtggtctgcaatagcgccccgaccatcgccagccccgccccggtcagtgccgcaaggagtgtcctgggtaagcgcaaatccgtgacgatagtggtgaccatagctgttaccggtacatccaccaccttaagcgcccccagcacctgtaacagcgtgagaggaaccgcgccgcgggtaatactgaacagcattaagccgatcaacaccgccagcgcgccccacatcgcccagtgatagcggtaggccatacgcattaatttgccgccgtcgggtacatcgcccgcgccagcttttccaccgcctcaacgttagccggtcccggcgtcagttcggcatactgaagtttaaggtagcgctgatgctgaaccgcgggggtttgtttcattagcggatgattctccagaaaatgacgcagcgcgtccgcgccgctgcccgcctggtaatccagcaaaatgataaagtccggtgccgtcgccgcgacgctttcccatgaggtcgtgccccagctggtctccagcgcgtccagcgcatttttaccgccagccgcctcaatgatcgcttcaggcatggcgtatttgccgctggtaaagggcttatcctcgcctgaatcataaacaaagacctttaaaggtcgggttcccgcggcccgctctggtaaggcattgagtctttttttccagccgctgaccagcgcctgcgcctcttcgcgcttaccaaaaatcttacccagcgtgaggacgtcgttatacaacagatccatagtggctttatttttgtgtgcagtggtgaatacgcagctttcactgagaacaaaggtcctgatgccgtatctggctaaggtatccggcgtcacttcaccgccgggcttcatgccatagttccagccggcaaaaaagaaatcaggttccgcggccagtaagacctcaagcccgggatactttggcgccagttccgggatcgtccccatcgcctgtttaaattgcggcgtcatcttgtaccagccgctgatccccgtcagcccgacaatgcgatcctgcagatgcagcgcaaaggccatttccgccatattcagatcgttgataatcgctcttttcggcgggccggtgaaggtcaccggcgttccgcaactctcaatggtcaccggaaaatctgccgcgctggctgcagaaacagacagcacggccagcagggtgataagcatttttttcatgactgactctcagaattcatttacgcacaatgcggcacttcaaaaatacgcaacgcccttcctgtctcagggtgcggtacggtaaagctggttaatccaaagacgggatacaggtgttctgaaatcagaactttatccggggtgtcgcagattgtggaacgcccctgtgacaggagaagcacccgatcggcaaaggatcccgtaagggtcagatcgtgcaaaaccgccaccaccgccatccccttacttttcaccagcgacagtaattcctcgcgcccggggggatcgagatggttggtcggttcatccagcaggatcagatcaggcgtctgcgccagtacacgtgccagcgccgcccgctgcctttcgccgccagaaagggcaaacagcgatcgcctgcgcaggtgctgcaatccgctttctttaatggcgctggcgataatcgcgtcatcttcatggcgcggcacacgtccggcatgaggaatacgccccagcgccacatagtcttccagggaaagccgtaaatcaggcgtatcattttgcgccagtacagctacctgtctggcccgctgttgaggagatagacaggataaagaccggccccgcagacgaatgtcgccgtgaagggacgtcagttcctgactgatggcccgtaataatgacgatttcccactgccgttaggcccgataatggccaggcattccccggtattaaccgtaaaacggatgtctgaaagtaaccttccgccccccggtcgcccggaagaccggatatcgacactcagaacgcaatcctgtgcatccgcatggcctgtttgcgggatagcgctgttgtttttcacgatgctgtttactgatcaagaaacacatgcaatatgttataacataacattaagcagaaaatccattttctctgctgctgcgatttatgccccccgcccaagacataaagatcaaacgagggttttcttttcagactatcccctgccatacccgccttaccctcttcctgatttatgccaggcttgtactaccttctgttttactggcaccgctaaccatccggggaacgcatgacacagacatcttctctttctgaccatgacattgcactcatcgatcgctactggcgagccgcgaattatctctccgtcgggcaaatttatctgatggataaccccttactgcgcgagccgcttaaaccggaacatatcaaaccgcgcctgctggggcactggggtaccacgcccggcctgaattttatttatgctcacctcaaccgcgccatccgcgagcgcgatctgaatatgatctatatctgcggccccgggcatggcgggccgggcatggtggcgaacacctggcttgaaggcagctacagcgaaatttatccggacgtcagccaggacgccgcagggatgcagaagctgtttaaacagttttccttcccgggcggtattccaagccacgctgccccggaaacgccagggtcgattaacgaaggaggcgagctgggctactcgctgtcgcatgcttttggcgcggtgtttgacaacccttccttgatcgctgcctgcgtcattggcgatggcgaagcggaaaccggcccgctggcgtccagctggtttggcaataaatttatcaatgcggcgcgcgacggcgcggtactgccgatcctgcacctgaatggctataaaattgccaatccgacgatcctcggtcgcgccagcgatgagaatttgcaggatcttttccggggttatggttatgagccgctgctggtaagcggtcacgagccagaaaaaatgcatcgccagatggcggaaaccctcgataacgccctcaatgctatccgcgattatcagcagcaggcgcgagcgggtacggcgtcttccacgctgccccgctggccgatgataatcctgcgcagtccaaaaggctggacgggtccacagagcgtggataataaaaaggtggaagatttctggcgcgcgcatcaggtgcccgtctccgcctgccgggaaaacgacgatcatcgtcacatccttgaacagtggatgcgcagctatcagccggacgatctctttgaccagaaaggcctgctgaaagaagagctgcgcgccctcgccccgtccggtgagaagcgcatgggggcatcgccttgggcaaacggggggctgctgcgccgtgagctgaacacaccgccgctgcgggaatttgccgttgatgtcgcctcacccggcgagacgcaaaccggcaccaccgccgcgctgggggcttatctggcgggaatttttcagcaaaacccggataatttccggctgttcgggccggatgaaaccgaatcgaaccggctgggcaaagttttcgatgtcaccagtcgtacctggctgctgccgaaaaaaagctatgatgagcaactggcggcggatggccgggtaatggaaatcctgagcgagcatcagtgtcagggctggctggaggggtatctgcttaccggccgccacggtctgtttaactgctatgaagcctttatacatattgtcgattcgatgtttaaccagcacgcgaaatggctgaaagtcacgcgcaagcttccctggcgtaaaccggtttcctcgcttaactatctgctttcgtcgcacgtgtggcggcaggatcataatggatacagccatcaggatccgggatttattgatcatgtggcgaataaaaaagccgatattgtgcgcatctatctgccgcctgatgccaataccctgctctgcgtcgccgatcactgcctgaaaacctgggatcgcattaacgtgattgtcgccgggaaacagccttcgcctcagtggttgacgctggaggaagcagaaaaacactgcgcggcgggcatggggatctggcactgggccggtaccgtacaggaaggtgaaaagccggatgtggtgattggttgtgcgggggatgtgccgacaatggaggcgctggcggcggtggatctgctgcgcggctacctgccggagttgcgcattcaggtggtgaacgtggtggatctgatggcattgcagacaaaggatcagcatccgcacggtcttgacgacgacgcttttgaggcgctgttcccgtcggatacgccggtgatttttgcgttccacggttatccgggacttatccaccgcctggcctataagcgcaagaaccagcagcatttccacgtgcatggatttattgaagaaggcaccacaaccacgccgtttgacatgacggtgctcaatgaactggaccgcttccatctggcgcaggatgccattcagcatatcccttcgctggaaggaaaagcggatgccattcttgatgcgctggcggaaaaaattgccgaccatcaccgttatgtgcgggaatacggcgaggatctgccggaggtacagggatggaaatggccgtcacagcaggatggcgcaaatattcctgaataaaaaaacggctgcatcagttactgatgcagccgtttgtcctgcgccttaaaaccagcccggcccctgcgccagctctttacgctcaggcggccgggtgtcaatcggacgggcggcgagatgcttcgcccacagatccgcgacccacttcacccctttttgcgtaaagcgcgcctgtgaccaggtatgccggttctcaccggtaccgccatgcagagtaaaatagcctgcctggatatgatgcagcggcggcgtcagcgtgccgttggtgcgcatcataatgttgcgctccagcaggaaattacgaaaatccacttctttcgccttcagcattttgcacagctgacgaaaacccagcgactcatttacctgcacaaactcatcgaaaaaggccgccttaggggcaaatagctcaagctgcttttccgcacgctggcaccgctcatactgttcggcccaggcacgcgccgccgcagccggattagtgaaatccggcaggctgatgtctttttcacgctcctgccagcgatccagcatctctgcggtataggctggagaaatgcgtgccaccgtcagcagcgagtcccgtttattcaacaagaactcttcgcgcatctcaccgtcggattcgtactggttgcccgtgacaggcgatgagagacgttgcgcggtttccaggcttttgaccatacgcttcacttcagtgtgggcaacgcccatcaacttcgccagctcacggctgctcattgtcacggcccgattctgcgcctggagagtatctacagaaatcatcatagggttcaccactcacttcattgacacaataaccaccaaactgaggaaataataaacaattgctgtgtatttatccagtattatttttgttcacctgagattaatggcctcaggaaaatttcctgtcgcctgtgacaatggtcacctttctgccaggattaaaatatgtggattaatcaatcaggtaacacatcacaggagaaagaatgtctattcgcggtatcgaacacattggcatcacggtttctgatttagcccaggcagaacaattttttatcggcgcgctgggggcttctgtactgtacagaatgatcccgcccggggatgacagtaaacgggtggaaggtgaaaatatgaatcctctgaatggttttccgcctgaaatgaacgtgattggcctgtcgatgctgcgcctggcaaatggcagcaatgttgagttgttccagactgcgcctgcggtcaacgatcgccctgcacatcctggcctgccgggtattaatcatttttccgtatacgtcgacgatattcagaaagcgggcgtacagatgcgcgcccacggggctaagatgttcgacgggccttcagactgctttggtcaggaagaaggccagggaaatcagacctggtttggcatgacgccgtttggcgtgttaatcgaactgatttccctgcctgccggggtgaattgtgacgacggcacaacgcagcagcgctggatcccggcaccataaataaaaaatccacgcggctgcgtggatttttctttgtaagcgatcagttgagtttaaatacggccacggtttcttccagaacttttgactgctcctggagagaatgcgcggccgcagaagcctcttccaccagcgcggcgttttgttgcgtcaccgtatccatctgcgccaccgcctgattgatctgctcaatgccgcggctttgctcgccggttgacagggcaatttcagacatcagctcggaaacctgcctcaccgaggtaataatacgctgcatgcttgcccccgcgctggtcacgcgttcgctgcccagcagtacctgcttaccagattgctcaataagctctttgatctcttttgccgccacggatgagcgctgcgccaggttacgcacttcactcgccaccaccgcaaaaccacgcccctgctcccctgcgcgggccgcttccaccgccgcgttaagcgccaggatattggtctggaaggcgatgtcttcaatgatgccaatgatggtgtcgattttgccggagctggattcgatttccttcatggataccacggcttcttcaacaatggcgttgccttcctgcgcggcgctgcgcatgttgctggcgagcgtgttagcctggagggtgttttctgacgtatgtttcaccgttgaggtaagctgttccatgctggctgccgtctgccccagcgacgcggcctgttcctcagtacgcgccgacagatcggtattcccggcggcaatttcttcggctgcatgggccacgctctgactggagtgacgcacctgggcaatgatctccaccagcgcaagacgcatctgatccagcgacgacaacatgtcaccaatttcatcccgtgcatgggaaatcaccgggacatgcagttcgcccgccgccattttctgacagtgcagacgcgccctgtccagcggcgacaacactcggcggcgcagcaggacgtaaatggcagcgatgatcagcgtaaataccagcgcaaaaataccaatcgtcagcatgctgttcataaagcgattctgtgcttcattattcagacgctgagcgtatttttcgcggaacgccagcaggttatccagcgtaatttcaaactgacgatcgagctgcggaatagaggtgctgaccagctgattaaagcgagcgctatcgttgcggcttgcggcgtccatcagcgggcgcagtccctcatcaacataggtctgccaggcgagacggtaaggcgcggcgaattcttcttcgccagccacgcgcggcgcggcctgatagttattaaacgccgctgtcgctttttgcattgtctcattcgcgctggtcagcgacgcctgcgctttctggttatcgcccagggacgcgttaatcatcgcctccattaaacgcacccgcagcgtgcggctgtggttaataggatcgataacggaaaggacgacacgaatttccttgttcacattatcaagcgactgattactacgggtgagtgaccagagactggaggccgcgctggcgagaaaaatacagagtaaaaaagtgaaaacgagtactgaaaaacgccttactgacatgatatacccttgcataatagtgctatgtaaaaactaacgcctcagaatgaagagcgtcatcagcagttatcggcaaatggtatggttaacttagtaaaaataaggagatttacagaccagtccgccctgaccggcctgcgtcttttaccccggacttagctgcgatgagtattgactacctgaccaatacccttaccttccagcgtttcctgcggatcggcaaagaaatcaatattaaagtacgtatcgtcggtcagcagttcgacgtgatgccagtattccggtgggctgatgccaaaatgcccggcctcgataaccacttcgatttccggcgtggcgtcatgttcgctggcgaagccatagtacttcaccgcgccctgcatcacggataaccggccataaacgccttttttggtgttatggtgcgttaacagcgcctgcggcaccgtctctttagtccagaacggggtggaacgggtgtgacgaaaatgaacgggaatttgtaaagccataacgggaacctccgattttagtcgtgttaccagccacaaacattagtctcttcatctgactcgtagccacgaacgatattaatcaggtctttaacggcatcagcaacaacaaggggatccctgagttcgtcaatgctgtcaaaatctttatccacggatacgccattattattattggtaacagtcagcacaaaatccttatcgttttctttgctatcagataatcctgcaaccaattctgttaccgcctgcacggcaatatccggaacatataacgccatcggtttgagatagattttttcctgaatctctttactgcggcgattttccactgctaaagaatagcctttattatcaggtgccatcatactttccttaactttcaatcaaaatttgcggatcgacgtaaaaatccacgcagaacagggtgtcatcggttagcgcttcgatgttatgccatttctcgggcggaaataccccaaactcaccggcgttaattgttaacgtctcaatgggttgcgggctggtttcatcggcgtaaccgtaataacgaataatgccgcgcatcacgctcagacggggatagacgccctgtcgcgttccggcatccagatgccgacgccagatagaagaaggtgcggtctctttagtccagaaaggcgtactgcgggtgtgaatataattagcgggtataacgatacgttgcatgtttcaacctcgttcatttcgttaagcgcggcttaacgggaggggaaaaccttatgttgcatatcatatacctgttttataatttgtggactactttttagaaataattttccgctcttaatgttaaatatttacagcgtttattaacacgtgctgtcatttgtcctgccgctgagcataaatggataattaatataaaatgctgctatataccccttattaactattgcaataaggcaagccagtaacttgagtagaaaaatattactccttaataattacgcgcaaaaaacttgatgaattcctaaaagtaaggtgaagggtcaggaggtaacaaatttctggtggggggaaggtaaactgccggtgggtgcttgaggctttctggctttgagcatttgcaaggttcagaaagacgaaagccccaggcgatgttaatcaacctgaggccaacgtatgaacctagacaattcagatgttagtctcttcttcgcacggaggcaagacatgctgacaaagtacgccctggtggcgatcattgtgctgtgtttgacagcgctgggattcacgctgatggtgcgcgattcactctgtgaactgagcatcaaagagcgtggtatggagtttagggccgttctcgcttacgaaccgaagaagtagcctgaacgcgggggctcagtccccgcgtgtctggttgccgggttgaattctcaatgcacccgtttcttttctgttactgccccacctttatatattcctaaaagcaaataacgaccttcaatcgtgatagctttcacaatatcgccatgtaggatcgcgggtgggtgcttgaggctttctggctttgagcatttgcaaggttcagaaagacgaaagccccaggagatgttaatcaacctgaggccaacgtatgaacctaagcaattcagatgttagtctcttcttcgcacggaggcaagacatgctgacaaagtacgccctggtggcgatcattgtgctgtgtttgacagcgctgggattcacgctgatggtgcgcgattcactctgtgaactgagcatcaaagagcgtggtatggagtttaaggccgttctcgcttacgaaccgaagaagtagcctgaacgcgggggctcagtccccgcgtgtctggttgccgggttgaattctcaatgcacccgtttcttttctctcttccagccatacccatattgacttattttgttatcagcgtacttttcaggacatgaaaacttttttgattattgttcccgatggcggcatgttgttcgaagctgccggtatcgccgatatcctgatgcaggccaaccgcgtgcaggcagagcagcacgcgccgccgcgctatcagatcaccattgccaccactcagccgcaccaggtgatccacgggcagtcggggttgaacctgctggcggattatcgtctgccgcagctcgatccgcgtgagctccgcgacaccattatgatcaccgggcgcggcacaaatgaagatgaaggcgtggcggtggtcgactggctacgtcttgccgccccgcacgccaggcgggtagtgtctgtttgcggcggcgcgatgctactggcgcaggctggcctgctgaacggacgacgtgccacgacacactggaagctgctggaggagatgaaatcccgctatccactggtggcagtggaaagcggcccactctatgttcaggacggccctatctggacctccggcggcgtgagttccgggtttgatctgacgcttgcgctggtagaggatgattacggatttaccctcgcccgtgaagtggcccaggatctggtgatgtatctgcgtcgccctggcgggcagatgcagttcagccgtttccagctgcaaaactgcgatcttcccggcccgataggtgaattacaacgctggatcctcaataacctctctgctgatttatccgttgaaaatctggcggatcgggtggcaatgagcccgcgcaatttcacccgtgtctttacccgcgacgcgggtgtgtctcccgcgcgcttcgtggcggaagcgcggctggccgcagcacgccaccagctggagcagacccgcgacaccctggagcgggtcgccatcagcacgggctttggctccagcatcaatctgcgccgcattttcgagaagcagctcaagctgacgcccggcgaataccggcagcgatttcacagccgcaatctggcgtaatgtgatccatttttgtcatttacgccactcctgacccggcctactctgaatgcagaaaccgcataacaggaggcaatcatggttaagatcggtattaatggcttcggcaggatcggacgcaatatgctgcgtgccgcgctgggtagcgacgacattcaggtcgtggcgatcaacgacctcaccgacagcaaaaccctcgcgcatctgctgaaatacgacaccctgcttggcacccttgccgcgccggtggaagccagcgaaggcgagctgaaagtagacggaaactccatccgcgtcttctccgagcgcgatccggcgaacattccgtggagcagcgtgggtgttgagatagtgattgaagccactggtttcttcaccgagcgtgaaaaagccgaagtgcatatcacccacggcggcgcgaaacgcgtgatcatctccgccccggcgaaaaacgacgacctgaccgtggtgctgggcgttaaccacgaaaattacgatccagaaaaacactttgtggtcagcaatggcagctgcaccaccaacggcctcgcccctgccgcccaggttttacatcagcattttggtatcgagcacgggctgatgaataccacccacgcttacaccaacagccaggcgctgcacgatcagccggagaaagatctgcgcggcgcacgagcagcggcagagtcgattgtgccttactccagcggcgcggcgaaagccctcggcaaagtgatccctgaactggacggtcgcctgaccgggtactcgctgcgcgttccggtgccggtggtgtccattgtcgatttgaccgtcaccctgaaacgcgacgtcaccgttgaagaagtgaacgccgccttccgcgaggctgccgcatccggtccgctacaaggtattctgggttacagcgacgaaccgctggtatcgagcgattaccgtggcgatccccgttcatccattatcgacgggctgtccacgctggtgattggcggcaatctggtgaaaattctcgcctggtatgataacgaatggggcttctcgaaccggctggtggatctggcgcggttgatggcgaaacgcgggttgtgattgatacgttaatgccgggtggcggctgcgccttacccggcctacatcaccacaatgttcatcgttcatgtaggcccggcaagcgcagcgccgccgggcatttagattttaaaacaggcccagcggctttccgctgtagctgaccagcaggtttttgatctgttgatactgactcagcgccattttgtgcgtttcacgtccgacgccggaatttttatacccgccgaaggccgcatgcgccggatacagatggtagcagttggtccacacacgaccggctttgatcgcccgtcccatacgccacgcgcggttaatatccagcgtccacaaccccgctcccagcccgtactccgtatcgttggcaatgcgcagcgcttcttcttcatccttaaaggtcgtaatacccagcaccggtccaaaaatctcctcctggaagcagcgcatactgttgtggcctttgatcagcgtcggctggatatagaagccgttttgcagggtgtcgccatgatcgatatgcgccccgccggtgatgatctcgccgccctcttccctggcgatctcaatgtaggagaggatcttgtcgtactgctcgcgggaagcctgcgcgccgatcatggtgtccgtatcaaagggatcgcccttgcggatggtttccatgcgggcgatgactttctccacaaactgcggatagatcgactcctgcaccagcacgcgcgacggacaggtacagacttctccctggttgaagaagccgagcaccgcgccctcaacggctttgtcgataaactccgcgtcgccgttcatgatgtcttcaaagaaaatattcggcgatttcccacccagctcaacggtgctgggaataatattttccgccgcacaggagagaatatgccgcccgatagaggtggatccggtgaaagcgattttctcgatacgcttgctgcgcgccagcggctcacccgcttcggtaccgaaaccgtgcaccacgttaagcacgcctttcggtagcagatcgccaatcagttccatcagcacgctgatgccgagcggcgtctgctccgccggtttcagcaccacgcagttgcccgccgccagcgccgggccgagtttccacgccgccatgagcagcggaaagttccacggaatgatctgaccgaccacgccgagcggttcataaatatggtacgcgaccgtggtgctgtcgatttctgccgcggtaccctcctgggcgcggatacaaccggcaaaatagcggaaatgatccaccgccagcggtaaatccgcccccagggtttcgcggatcggtttgccgttatcccaggtctccgtcagcgccagcagctccagattttcctcaatgcgatcggcgatcgccagcagcacatttgcgcgctcctgcgcgctggttttaccccaggcgtcggcggcggcatgagcggcgtccagcgctttttcaatatccgccgcgcccgaacggggaaactgtgcgatagcttcacccgtcaccggcgtggtgttatcgaaccagcgcccttcgaccggatcgacaaattcgccgccaatatagttgccataacgttttttaaacgagactttcgcgccgttcaggccaggatgagcgtagagcataagatgttcctctgtttttataagtaggggtgaggcgtctcgccggtggcggacaatatggaataagcagttcttatgccagttcagcggcataagaactgctgtttatttttttattaattattaaatacatacgcttattccttctcatatcgccgtgcgccgatccagacacctgttgcggaagtgtgttgcacgtcgctacacgtgagacacctttatgctacacattcttaacattcctttttccggagtcagcgatgccgcaacccgtaccctgccaggtggaagcctcctggcaacgcagcctgaattatggcctgcaacgtgacgacgacagccagccgtgggtcgcatccggacagctgaaagaggcgcgagcggaaaacacctggatcagccgcctggcggatccgctgctggcgcggctgcatccggaactcgccagccatccgtcgataatggtgctttccgacgccagcgggctggtgctggaaacgcacggcaacagcgattttctgcataaagcccagcgctatgccctttctcccggcaatttgtggggcgagcacgcccgcggcactaacgccatcggcacggcgctggcgctgcaacagcactgcgaagtctccggcggcgagcactacctcagccgtaacgccgggcttttctgctccgcctcaccggtgttccgcccggatgggctggtcgccggagtgctggatctctcgacgcccgcccacgcaccgcgccccgatgcggcggcaattgtgcgacgcgccgtttgtcagatcgaacacgcctggaccaccagcgccgcgggtacacagcgctggctgctgagtctgcacgcggatgccgccctgcccggcagcgccggggaattgctgtttatcgttgaagataatgtcctgctcggcgcgaatagcctggcaatgaaagagttcgccctgctgccggcgcattttggcagcaccgccatcagcacactgctgccgcagatcgccctgaccggcgggaccacccgcaccgtcgcctgcaaccagcggcattacaccctgcgccagacgccgcccacccgccgttatcccggacgcggcatcgctgcgccacaggccgtggtcgatccgcaaaaagccaaagcgctgcgcgtactgaacgccgggatcgccctgtgcgtgaccggggaaaccggctgcggcaaagaacatctgagccgcgagctgcacgccagcagccagtggcgcactggcccgtttgtggcgatcaactgcgccgccctgccggaaaatctgatcgaatccgagctgttcggctatgcgcctggcgcctttaccggcgcaagtccgcgcggttacagcggtaagctgtgcgaggccaatggcggcgtgctgtttctggatgagatcggcgatatgccactgacgctgcaaacgcggctgctgcgggtgttgcaggagaaaaaagtcaccccgctcggggccagcaccagccgtgacgtgaatttcgcgctgatttgcgccacacatcaggatctggttgcccgcgcggcagccggggcgttccgcgaagatctgctttatcgcattcaggaatatcacctgcgtatgccgccactacgggagtggcctgaccgcgaagcctttatcctcaggctgtggaatgaactgggggccgcaaaacgtcagctgacgctgagcgaagcggtggtcagtgagctggcggcgcgcccatggccgggcaacgtacgccagctgataagccagctgcgggtgctgatggcgctggctgatgatggtgagcacattgggctggcggatctgccggaaagcacgcctgcacccgcttatagcgatgagcttgccattgccgaagcgcagggcaacatgagtctcgccgcccgtaaattaggcatctcgcgcagtactctgtatcgccgccgcgaaaaacgccagccggtttaaccggggcgcatcccccggcggcgcaggcttgccgggcctacaaatgaacgctgacccgcaggccgggtaaggcgcagccgccacccggcatcccgcaccacgctaccgccgaacctcatactccggctcatccgccagcagtttcgccatatacacccggtcaatcgccccggtatcgtaatgcgccagcgtcagcacccgcgccttactcaactccagcgccagttccggcgtgatggaaaaactggcggcgacttcgtgcttttccagccccggacggcggcggcggcgctcgacgcgaaaacggtgctgattatatttcgcccagccaatcagcacggcgccgatcagtaatgccacagccatatacagcatcaccgtaccgtaagtgctgtaaaaaggccgcaccccgctgtcaggcgactccgccagcgcgaccatcagcccggtatagatcagatacgaaaagcccagccaggccaccagcgtcagcacggcgtccatcacccgcgggaagacccgctgttcagtaaaaatcagaggttcattcatgattcaattctcccgataccgcgatccgggctgacccagcgtgccctgctgcgcttacgcgccagcatgaccttagggaaagccaccagggtggtaaataaactcaacatccagtagaccaccgggaaccagatgatccagaacagcgacgccgcaatgcccttttcgtaacgccgctcaatcagcaaactgaccataaactgcaacagacacaccacgccgagcatcagcccggtaaacgccggtggaaacagatgttgaacatgtaaggaatccggcataggcagcaccatgccgaagaggaacagcaaaatgctgatcgcataggcgaaggcccaaatcgtcgataagcaaaactccagaaacagcggccacatgcggcgatattcccaggcccacaggcgacgcatgttgacgataaacacttcggcgccgccctgcgcccagcgcaaccgctgcttccacaggcctttcagcgtctccggcatcaggatccagcacagcgcccgcggctcaaaaaatactgaccagtgacgcagttgcagcttccagctgatgtcgatgtcctcggtgatcatgtccggactccagtagcccacttccgccagcgcccggcggcggaaagcggcgatcacgccggagacggtaaacacctgaccgtagatccgctgggtgcgtttgataagcccgatgatcgacgtgaattcccccacctggacgcggccaatcagcgtggagcgggtacggatgcgcggattgcccgtcaccgccccgacccgcgggtaaagcagcaacggcgtcaccagataagccgcggcgtcgcgatccagcagcgcatcgccatcaatacagacgaggaaatcgctgtttgccgccgccgcgcccgcctgtagcgccaccgccttgccctggttttccgccagatggatcacccgcaggcgcggaaactcttccgccagtccatccagcaccgccccggtgttatctttcgaaccgtcattaatggcgatcacctcgatgttctgatagcgctgcgccagcgccgcctcgatggtttcccgcgcgttcagcccttcgttataacaggggataagaatggagatcagcgggttgcccggcagttccggcgcgggcgtccctttcccccagggccagtgccgctcgcggtagaaccagaaatacagcccgccgctgatccacagtgcggacataaacagcggccagaaaaacacgaaattgaggatcacttcacccgtgaaaatggcagccacgcccagcgggaagctgaacatcaggcaaaggatcagaaacgcgacgatgcgatcggtcatttttgcgggtaccagtaagaggaaaaggtggggcgtattgccgacatttcagggtgatcgttaatgaaatcgtcggggtaatagccatagttttttgcgccgctgagtttcagctgacgcatccagtgagccagctgttcaccgctgatatcggcatgttcgccgcttttacgccagtcgcgggcctgcagctcaaagacggttttatccagcgcgccggggatctgcgccacgcggttaacaaggctgtcgagccaggcatcgtcctgtccggcgggcacgttttccatcagcggcatcgccattggcgcggtccagtcgtacgcgccgaggaaatcgttcaggttttgcgcaaaccaggcttcgctggcgggatcgagcaccggcatggcgtagatattgcgcgcggttttcacctgcgggccacggatggcgcgcacggtttccgtcagctgtttcgtgaagtcgatcagcgcccggctcttgaagcgcgtccagcgctccatcgtttgcggattgctgcggatctccgcaatgctggcggggaatccggcggcctgataggcgcgcatcgcgtccggtgacgcatcctcgaaatcagtcagcatggcgtcatcgtggaacaaaatgccgtggaaggaggcgtgccgggccagatcctcgtagatatccttaatgcgctggcgcgccaccgggctccagggcgacagccgcacataatgctgacgatccaccgccgcccggccgctctccggcgaccaggcctcaacgcgcggcaccgaggcatccagatcgaaggccagcaccggcatccaggcataaacgttcaccccgccacgggtctgcaattgccaggcgataaagttgaacagatcagcgcgcatcggcagccagcggttagggaaatagagctcacgaatattgccatcaccctcgggatcggcgtacgcctgcaaaaagacgtgggagatgcgcatgtcgtaaacgcgctggatcagcttgtcgatgttcttgcgctgctgcaccggatccttgtcatagacataatccagatcgatatgcatcacgcgcattgtctgctcctcgcgcacctgcgcgacctggctggcaaagttacgcagcgacgggttatcagagatcagaatgcgcggcacatcgtcgagactggcggcattggcaaggccagggttcagggtaaaggccatctgataaccatgctggcgcgccagtttcagcgtcgtgccgttggccgcgccgtaaggccagacccaggcgcgcggcggcttaccggtcacctcggcgatctttttggtgacgcgttcgagatcggcattgatgcgcgcttcatactgcgcatcggtttcgtactgcccggtatttttgtcatataaccggttcgccaccgccggttctttactgccctgtggattcgcctgcacgccgtagtgcgatgcccaggtatgcgcgccgatctccactaaaggcgacttgctgacttcgcgcaccatctcccaggtggcgaacttatcgcgcgcggttttcaggccgccaaaatccaccggctgattggctggcgcgtccacccagctgccgacgggcgcccataacgccgggaacttatagcgctccagcagcggccagacgcgggtgtaaaaactgctgtaaccgtcatcgaaggttaacagcaccgctttttccggcaggacgatcttcccggcgtgagcatccgctatctgctgtacgctgatcgggtgatagccgttgtcacgcagccaggccagctgatcgttcagcgcgctggtacgcactgacagatagcgctgatccgcggcgtcatcttccacatcgtgataccccagaacgaggaaactgtttttcggccaggcgtgatccgcattaagcggtacccggtcggcggggggaatatagcggggcgtctcggcgctcccgcacgcggtgatcatcagcaatcccgcgaaaatgatcccggcgtgcagccatcgtctaaacatgaaacgtcctcaaaacctgacattcaaatcaaaagcgagggcaatgttgcgctcccgcttaccatcgtagggacgcttatcccaggtgagcatcaccccggtatccaccacgttattccattgcacccgctgcccgtaaccgaactgcgttatcgcgccgctggactggcctttctgccagtagcgccccgccccggcctgaaactgctgtttccataccgtgtcgtaatggcgataaatcacatgctccgcgctcagacccggcgccagcgagaaatcccgctgcgggttgtaatagggcacgtcttctttagtgttgtgactgccgctcagccccggcgtgaaatccagcgtgaagcgtggcgtggtccacagccgctctttaccgctcaggctgtattccaggcgatcgttgccatcggagaaatgcgcggcggacaccgaaactgaatattcgcggcgttcgttcttgtaccagcgcagccacagatcgccgccgtcggcgctgacgccattacgcagagcgcgcagcggggtattgcgcgacagccgttcggcggagccgccgatgcgccagttgtcgttaaagtcgtgccagccggaaaagcgtgcgccgatcttttgtccgtcgccatagttgcgcccggagatctccagttccgcccagttattgcgtgaggtccactcgacgcctgcggcaatatcccggctgatgcccttcccttcttcgaactcgccggtggcaaagttgaagccggtgaacaagcgccagttatcgttgatcggcgggctgtagagcgcagagttaagcgtgaaatcgtgctggccgctgatcgggctgtcggagtcgatgccctgcccgccgctgatgcgcagctcggctttttcgtgcacatcgatgatgcgtttgagccgcagactggcggcatcgtccgggctgcgggaaataacatccgccgtcagctctttcgcctgccgccactcctgtagttccagcgcagtggcggcctgctgacgttcaagggaaaggttgctcggctcgatcacttccgccagcttcagttcccgttccgactcacgcggcaggccgcgcgccagcagcaccgcggcgtaggtaatgcgcagcgcctggttgccggacccggtacgcgccagcctttcggcatggctttccgcggcgggcagatcgttggtggcgatctcatattcggtcagcagcgtctgcccgagcagccagttatcgttcggctgcggcgtcggcgagccgtagacccgtttcagataagggctgtctttgatcagcgtatcgacctgcgctttggcttcttcaaaatggttattatcaagacgagcgtaaaacagctcctgctcatcgtcgctggtcagcggcgttaccggcagcgggccgcgcgggaaatacagctgctccagcatggcttccgctttatcgggctgttcttccgtcagccaggccgaggcgatccaacgcttcgcatagtcgggaaccggcttgtcatcggcggtgagcgactcatattcacgaatggcttcggcggtgcgtttgcggatcaccagcgcgcccagacggtcaatacgggcgcggcgcagatcggctgccgcctgcggattatcctgccacgcggcgatcagccggtcgtagcgggccagcgctttatccgccaccagaaagcgctcctcttcgttgcgcgtcggcgtgaacgcggtgcgtaccgtctgcgcggcggcatcaagctccagcctgcgcgccagcgcgtcaggggttttgctggtttccgacagttcgagcgccggtccggcaatacggttcgctgacatcgccgccagcagcgtcggctgcacgcttttattctgcggatccagcgcctgggcgcggctggcggccagcagcgcgtcccagtttttgccctgcgcgtgataaacgtaagccagcaccgcatcgctctccggccccggcgtgctttttgcccaggcggtggcctgggtgatggcctcctggttacgacgggcgtccgccagcgtcatgatccagcccgcgcgcgcatctttgtcgtccggcatttcccgcagcacgttgtcccataccgccagcgactcatcccatttcttctggttgcgcagcgcccgcgccaccgccagctgaccacgtgccgggatcgccatgctgccctgataacgcgaccagatggccagggtttgcgcgtcgttatccgaccaggccgagacctgtagccagtcggcgacctgacccggcgtcagacgcgtttgggtttcctgctgtttgagataattgagtaagggcgcactgtctccgctgcgagcctgaataatcagttgatcgtagaccggggtttcagcccaggcgaaaaccggaaacagaatacttgctgtaaataaacaggttccgggactaaagcgctttacgcaattttcacgtcgtcgaatactgaacataactgtccttatatccttataccagagatgagcttttcattaatttattgcggcaatatgaccggctttaattcaatacaccagacttaaaattcttctcaaaaataaataaatatcatactttagtcgtatttaaatttatttcagcatcatctaaagcgggtaaaataattatcatgacgctaatccaacgttagcctttatatataattactgcactactacatgcgtattttttacataaaaaaagccacgcattagcgtggcttttgtaggaaggctgcgagttatctgccgctgtggtgatccacccggagatggtcgacaatcagcgcgcgggtgctggtttgctcatcatcataaggcgtgcgggtttcttcaatcagacgcccggcgttatattttttcaccgtctcaacattgtgcttttcagcagcctgagtaacggatttcacttcccctttttcattgaatgccagcgccgtttcagtgctgcttctgtcatcaatctgatgatagctatagttttgcgacgaggcttcaagggttaacgccagcggaacggttttatcaatcgcctgatgataactggcctgcaaatgcgcagtggttttctgcgtcagcctgccggcattttcgcgttctgtgcgctgagaagaggaataagcaaagctatcgcgctcatctttacggaatggatttggtgatttatcggcctgtttaaaattcgcagaataatctgccagaccgcttaaattttcctgcacgacattatcgttagtacgcgtaataatattaaggcgattatccacttcatttgagccgtactgactgttcagcgccataaagctatttttaaacatatcaataaggtttttatcaccctgaccgcgtgctcgggcgctgtcgagctgactggcccagctggcgagcgcctgctgttgctgcccgtagctgcccaccgtttccgggtgcgacagatcggtgctcagatcgaacgccaccttgtcggtttgataactcatcgcgcgggcgctgctgtcggcatggaatttcagcgactgcagcgaatccgcatcttttcgcacatccgtttgcagatcgacggctttcagcagcgtgctgtcaaaattcatcagcccctgcaggttaagcgacggcgtgtcagccgacaggccatcgagcgtgctctggaaagcatccgctaaaccggcgatggcggcggtttcatcttcagttaattcacccccggcggttttcagttccacgaccaggccgttctggttgcgcgtcataccgaggctgacgttgataccggaggcggtggtgatattcagcgccaccgcacgatccggctgacgctcctgcgcgccctgcgtgtcaaccgtcgccgacagggtgatgccctgcggatgatcttttagcccttcgagcagcgcttttccgaggccctggaaggcatccgcctgcgcgccgcgcacgttggtgccgatcaaaatgctcagctggctgtgatcaagccctgcggtgttgacggttttcgccggattcaggctgtataccgccggcagcgtggtggtgttattcagcgagacgatagcggacggctgagccgccgcggaggatttgttctgcgtggcctggggaggctgcacgcgcggcgccagcaggctgttgatggtggtggacaatggtgaccggacttgcatgatattccctcatttcatgacgttattcggttatcggcggggaatggtgaaacattaagcttatatatcgagcacttgatgcagataacatttggcagggtgcagggacaggtccagtggtaggttcagtggtagtgttccgttcactttgcgtttcgtgtcaggcgtgacgccgctgacggtgaacgtgctaagggggccaccgcggcccccttagcaatccccgcggccccgcaaagaaaccggtgctgcgcattgcgctcacctcccggccgtctgcccgcggtcggctcgattcggcatcctgcctcatttcgcctctggccgccatccatggcgtccagcccttgtcatccggcctccggctcgccggtttcagcggggactcaacccctcgcgttaattacgatgacggtttgttacgactgagtggctttgtgtttgtctgaacttacaggaagctgtgaatggtgttttttagaaatcatgaagtgtggggagtccggctgaaaatcgctgaggcgttcccttacggccggggcagcccgcatggatgcgggatgagggcgcgacttgcagggacgctgcatcgcgcccgacccgaagccggaagggataagccgaaggcaccgcgcagcggcgattttcctgccgggagcccgggggtgcagggggcggcggcgactggccgccccttgcgcgctctgtgcgcccactgttaaagccttacaaaaaagccagtaagagcgcaacctacccggtaccaaacataatactcataagagcgcaccttaccccgtacaaaatgcaaccttaagcttcaagccggaactgcgccaccgtctgtgccagctgccccgcctgatcctccagcgagctggctgccgctgacatctgctgcaccagcgcggcgttctgctgggtcacgccgtccatctcattcaccgcgatggtcacctggctgataccgcgcgactgctcttccgaggcattaacgatctcgccgataatactctgcaccgagctcaccgcctgggtcatctcctgcatggttttaccggcgtcctgcaccagctgcacgccgctttccacgcgctgggtcgactcctcaatcagggtggcgatctctttcaccgcgctggcgctgcgctgcgccaggttacgcacctcggtcgccaccaccgcaaagccacgcccctgctcccctgcgcgcgccgcttcgacggcggcgttgagcgcgaggatattggtctggaaggcaatactgttgatcatggtggtaatgtcgcttattttgcgggaactctcgtcaatctgcgccatattctgcaccacctgcccaaccagtttttcaccgcgactggcgatgcgggtggcgttcgccgtcagctcggtggcctgatgggcgttgctggtattgtgtttaacggtagcggtgatctgctccatgctggccgccgtctgctccagcgccgcagcctgttgctcagtacgggaagccagattcaggttgccgctggcgatctcctccgccccctggcgcaccgacaggctggcgtctttgatctgcccgacaatctcccgcagttgcgtctgcatggtattgagcgcgtagaacaggctgctgcgatcgttgccgtgcacggtaatcgcgttgcttaggcgtccatcggcgaccgccagcgcgaagcttgccgcctgacggggttcgccacccagcggtttgagcactttacggctgaacaccagccccagtaaggcgctgacaatgacgatgcttaacaccatcaacgcaatggcccacatcaactggcggttagccgcctccatcaccagactgacaggcgcgaccacgcccagcagccagtgctcatcgctgttgccgacggtaatcggctgccaggtgaccagcgcgtcttcgccgaggatcggatcgtggcgttcagccatggtgctgctcaggccacccaccggttcggaccaggctttgctggtcagggatttatccggataagcgacaattttgcctttactggaaagcagcactgcataacctgcgccatgccagggtttgatctgcgcgattttgtcctgtagcgaggcgagtgaaatatcggccgtcactaccgcccacaatttcccttcctcgacaatgggcgcggccacggaggtgagcagcgtatcgacgccgttataggcgtaagtgtacggctcggtaacggtgtctttgcgggatttttgcggcagcagatagtaatccccctgccccggcgtcagataactggtcagcgggtgcatgctgtatttaccgcccgcgtctttatcaacgaaccaggcgtagcgaccaccgggcgcctggcccggcagcgcggcaaactcggcgtcacgtccgtcgagggcgttctcttcgaaaatcacggacattgaaagatattcaggattggcgcgcagggtgtattccgccattttgtcagcaatggcgcggtctgccttgcctgccgccggtagcgcgatcaggttatgaccgagattgcgcgctacatcgcgggcatagctcagttcatgctgcactttcaatgcattcgtttgcgcgatttgttgcaaatactcttcggccagttgtttttgctgacggctggattgccagctcagcacgccgatggtcaccgcaaagcccagcgtaatggtcaatgcgccggtcagcagcatttgtgcgcgtgtacttaatgttttcttattgtgttgtgttgccattacggctctccccggagttgcagattctgtgtggcacagcctgtgcagcaacatccctcacaggatctatcggcgtggggagagataacttcatcgcaaaacgaaattattccatttacatataaattacatccctgtaaacatctgaagtccttagtgttctgcgatcaccaccacacactgaccggcgcgcaccggggatccgggctgcacgcgcacctgctccaccacgccatccgcgcttgccaccagcgggatctccattttcatcgactccagcaccaccagtacgtcgccttcacgcacctgcgcgccgggttcgacgttaacctgccacagatttccggcaatgggactgtcgatgccgcgctgaccgggcttcagtgccgcatcgtcgctttcatccgctgtcgcctcgtggctgtcaaaatgcgcctgaccggaggcttcccagcgctggcgctcggcgttaaaagcggcctgttgatggcgacgggcggcagcgatgctgtcggcttccgccgccagaaactgctggtactccgccagacgcagggttgtggtttcaatgcgcagcggataacgtcctgtcgggaaatcccggcggatgtcgagcagttcctctgccgaaaccggatagaaacggatctgatcgaaaaaacgcagcagccagggcttgccgccgaagtccggcagctcatgatagcgatcccacatttgcagcgtgcgtccgacgaactgatagcctcccggtccttccatgccgtaaacgcacatataggccccgccaatacccaccgagttttccgccgtccaggtgcgcgccgggttgtatttggtggtcaccagccggtgccgcggatcgagcggcgtggccacaggcgcgccgaggtagacatcccccagccccatcaccagatagctggcgtcgaagacggttttatacaccgcgtcgatattttcgaggtcgttaatacggcggataaactccaggttgctcggacaccagggcgcatcacgccgcacggtggtcatgtatttgtcgatggctttctggcacgccggatcgtcccaggagagcggcagccagacgatgcgcgatggcacctgtaaatcctcctgctgacagaccccgcgccaggcttccgccaccgtcttcagcaaggtggcgagtggcatggcgtccggctggtagtgaatttgcagcgagcgaatgccgggggtcaggtcaataaccccaggcaacaccagcgcctccagcgcctgcatcagcccgtgaccgcgaaaacgcagcaccagatccagctccgcgtcgccgatttccagcagcaaatgcgtatcgcctgacagccgcgccaccagacgcttgtcgccatgaccggtctccatcatcaccggcgaggtgagcggttccggatgccagttgatactgaccggcgcaagcgacaccagctcctgcgcccgggcgtgggccagcagtcgcgcagtctcaatactcaccggcacaaagcgcaccttatccccggcgttaagctgcccgagctgatacagatccgcttcaataatagtgaccgggcagacaaatccgccgaggctcgggccgtccggccccaggatcaccggcatgtcgccggtaaaatccaccgcgcctatggcgtaagggttgtcgtgtatattcgacggatgcagacccgcctcgccgccgctttcgcgcacccactccggtttggggccgattaaacgcacgccggtacggctggagttgaaatgcacttcccagtcggtggcgaaaaaggtgtccatgtagccgggtgtgaaatattccggtgcgccgtgcgggccgtagatcacccgcagttcgcgcaccgccggcagccgggtgtgcagcgcatcgggcagcgccgccccggtgcgggtatcggtgagcggcgtcaggtgcagcacatcgccggtgcgcagcgcgcgcccggcatggccgccgaactgcccgagcgtaaaggtgcttttgctgccgagatactccggcaccgcaaagccgccgcgcaggcagagatagctgcgcacgccctgcgccgtcagatcacccagccgcagcgtcgcccctgccggaatggcaaatacgcggttcatcgcctgcggctcgccgtccagcgtgatcgccagcgccgcgccggtaacaacggccacggcggcagtattaaacttcagcgtcgggccgctcagggtgatctccagcgccgcctcgccgggcgcgttacccagtaagcggttgccaagccgcagcgcgcgatcgtccatcgggccggacggcggcacccccactgcccagtaaccgaggcggcccggataatcctgcaccgtggtctgggtgccggggtttaacacttccagggtatcagcctgataatgcagattttccaggcagcgcgtccacggctggccgcaggcaaaaggcgcgtccgcgataatttgccgcagatagtggcggttggtctccacgccgtacagccgggtctgcgccagcgcctcatccagcgcggcgatggcctggtcacgggtgggctgatgggtgatgattttagcgagcatcggatcgaaaaacggcggcacctcgcagccggactccacccaggtgtcgatacgcagcgcctggcgatcctgcagcgggaacaccacttcggtcagcagaccgggggacggctgaaaatgacgtcccggatcttcggcgtacagccgcgcctgcaccgcatgcccgcgcggcgtgagggtggcggcgatgtcgcgcagcggcggcagatcccctgccgccagttcgatcatcatgcgcaccagatccacaccccatacctgctcggtgacgccgtgctccacctgcaaacgggtattcacttcgaggaagtaaaactgcccggcgtcgctgtcataaacaaattccaccgtaccggcgctgcgatactgcaccgcctgcccgagacgcacggcggcggcgcacagggcatccgccatgccgtcaggcaaaccgggcgcgggggtttcttccagcaccttctggttacggcgctgcacggagcagtcgcgcacgccgagggcgatcacctcgccgtgaccatcgccaaaaatctgtacttccagatgacgcgcgcgctggatgtatttctcaataaacacacccgcgtcgctgaagttgtttttgccgaggcgttgcactgcatcaaaggcatcagccagctcctccggggtctggcagacgcgcatgccgatcccgccgccgcccgcggtgcttttcagcatcaccggatagccaacctgttccgccgccgccagcgccgcgtcgctgtccgccagcagatcggtaccttcgagcatcggcacgccgtgctgttttgccagggcgcgggcggtatgtttcaggccaaagacgcgcagctgctctgccgtcgggccgataaaggcaatgcccgcggcgtcgcaggcatcggcaaaggcggcgttttccgagagaaagccataacccggatggatggcctgcgcgccggtctcacgcgcagcggcaagaattttatccacctggagataggtttgcgccgccgggccgctgccgaggcagatcgcttcgtccgcctcacggatatgcaggctgctggcatccgattcagaccagacggcgacgccctggacgttgatgtcgcgcagggtgcgcagaatgcggcaggcaatggccccgcggttggcaataaggagtttcgtgaacatgatccagccccgaaccgtggcgggtcgtcccgccggaaaagtgtcgccgcctggtcgtccagggggaaaatttatttggattatccgtttacgcccggcggcgcaggcttgccgggcctacaaacttacaatcatcatcgatccgtaggtcgggtaagcgcagagccacccgacaaaagcccgcctcatttcagccggttggcacgcacttcgaacaggcggaaaatcgcgcggcgcagtttttgtaagcgcgtcagttccataccagcacctccgccggcgtcgggttccagccgttgcagggattattcagctgcgggcagttggaaatcagtacgatgacattgcattcggcgcgcagctcgacgtatttgcccggcgcagaaatgccatcggcaaaggtcaggccgccctccggcgtcaccggcacgttcataaagaaattgatgttcgcgccgatgtcgtgcttgtgcagacgaccatcgtgcaggcaggcgcagagaaagttgtcgcggcagctgtgcatatagcgcacctccggcgagtagcgcacggtgttgctctcctgggcgcaggcgccgccgagggtgtcgtgacgcccgcaggtatcggcgacgatggtcagcagcggattgcccagccccgaccagagtacgctgccggtagtcaggtaagcatttcgctgacggcgcagcgtgcgctggggatcgtagcgctcgcgcgggttatcggcgttatagaacagcgtatcgatcgcctgattgccttccagatcgaccaggcgcagcgtctgcccgcgtttaacatcaaacagataatgctcccctgccgggatcacatggcggaacaccgcctgctgcggatttttttggctttcgaccagcgtcatgatgcgtctccttacagggcaaacaggtgagtgttatccagtgcgcgaccgttttccgggcgcgttaacagcgcgtgctccgcagccaggggatcgtccgccgtgaaccagctgagcgccaccgggcgcggcgcgtactccgggtctggatccaaaggatgttgtaacgaagtgagcacgatcagcgtatccatcgccgcatacagttcgacgacgcttcccggcgcggaaaaatcccgctgaaaatggaaacgcccgtcttcatccacgctgaccttgctgaaaaagttgaccaccatcagcagatcttcgaggttcagatcccacttgcccatctccaccagcaggttatccatgccattgcggtaaaaaccgttgcgtcgctcctgatagcgcccttcgccgtatttctccagggtttccgccgcgttcagcacgccgccgaagggatcgtgccagccgcagctgtctgtcagaatgccggtcagcacacggcccatatccgagtaaaagcagtgcccggcggtcagccgcgcggtgtgctgacctttcagcgtgtccggcagattcaggcgttcacttttttcatgtgcgttaagcatcatcatgctgacgttggccccgccgtgcagatcggtcatgcgcaggatctgcccacgcttgagaataaaagagagatggccgccgccggggacggtttcctcccgcagcgcgggggcggaatgatactgttgcgtcatcagatgtactccttcatggatacgacgttaaccggggccgcggccatcacttccgccatgcgcgcttcgttaagcggaatgtcgtaggtgatgcgcgcgccatacgcattaggttcgtggggatcaattcgcactttgtcgaacaccagcagacgggtgccaaggttgaagccctcggacaggtcatgagtgaccataaacaccgtcatgcgggtttcgctccacagctgtaaaagcaggctgtgcatgtctttgcggataccgggatcaagcgcgccaaagggctcatcgaggagcagcacgcgcggctgcataatgaacgcctgggcgatggccagccgctgttgcatcccgccggagagctgcgccgggtatttatgcagcgcctgtcccagccccactttgtgcagcatctgcgccgcctgttcccgggcggcttttttacggttgccgaagagccgcccgagcagcggcgcatggggcagttcaaggccaatggccacgttatccagcacgttgagatgcggaaacacggaataacgctggaacaccaccccacggctgcgatccggctcggcggtaaggggtttgccgtcaagggtgatagtgccgcggctgggcgcttcctggccgagcagcagacgcaggaaagtggatttgccgcagccggacgcgccgaccatcgagcagaactccccttcccggatttgcaggttaacccgctccagcaccacatgatcgccgtactcctgccagatattgttgatattgataaaactcatgctttgcccccttccgcccacgggaaacagacgctgtgcagtttgcgcagggccagatccatcagccacgccagcagcgtgatccacaccacgtaagggatgatcacgtccatcgccatgtagcggcgcacaaggaaaatgcggtagcccagcccggcggtggacgaaatcgcttcggcggaaatcaggaacagccaggccgagcccagcagcagccgcagcgaggtcagcaggcgtgacagcagttgcggcagcaccacgcgcagcaccagcgtccagctgttcgcgccgagggtctgggctttgataatgatctcctgcggaatttcacgggcgcggtgctccagatcccgcgccagcatcggcgtgatgccaataactatcagcatgattttcgacagctcatccagcccgaagacgataaacagcaccggcaagattgccagcggcgggatcatcgacagcacggtcatcagcggcgacaacgatgcccgccacagcggaaaaacaccggcggtaatgccgatgcacagcccgagcagcgaggcaatcagcagcccggtcagcagacgcgccagactgaccagggtgtccatccagaacaggtagtcaccgctgcggcggtctggcgtaaaagccatgcggtcgagggcgctcagcatctgatccagccctggcagcagcttgtcgtgcggattagcgtccaggcgcaccgcggagccaatgaagtacacccccagcagcaggaaaaacggcagcagcatcagcatgatgtgcatcccccgggacggatggcggttaatctggcgcatcagagcgtcccggccacggccattttcaggaagctgtcgtcaaagcgcagcttaatgttgccggcatcgccctgagtgacgttgccggggaaagccatgccgatgaaatccgcgctctgtgcgccatcgccgagcagccctttatcaaaggagaactgcgccacgcgctgcatggtttttgccagatcggccgaggtggtgaacgtgaggttatccgccggggtatagaacaggtgagtggttttgagctgcgcctggtagcccgccagatcggtgccggaggccgccgccatcgcattaagggctttcgcatcctgcgctttcatcaggcccatcatttcataccaggcgccggtcagggctttgccgagcgcgggattgtctttcagggtggcggtgttcaccaccatcatgtcgataagctcgcctggcaccgcagcagagctgaacacttccgtcgcctgcggcgtactcttgatcactgacaactgcgggttccaggccaccgccgcttcgacgtccggcgtactaaaagcagagacaatatccgcatcggaggtattcaccaccgttacgtcacgctcggcaagcccggctttctccagcccgcgcaccagcagatagtgggacaccgacagctccggcaggtagatcttcatgcccttcagatccgccagcgttttgccttcgcctttcatcaccacgccgtcgttgccttccgagtagctgccaaggatcagcgcggtggtatcgacgccgcccgcagccggaatcgtcagcgcatccatattggtcatggtgcaaccatcaaactggcccgcagtgtactgattaatggattcgatatagtcgttaagctgcacaacattgattttaatgccgtatttgctggcccatttgtcgatgattttgtcacccgcaatggtgccccagggcatccagccggcgtagatggtccagcagacgttgaactcttttttggcggcagcaagggctggcaggctggtcagcatcacaagtgacagcgcgagggtgcggatcaagggaaatgtcttcatggttcgacctctggttggacaaaaagggggcagcgcgacaccatctggtgctgctgtctcccgggtttttgtcccgccgtgtaacctcacagaggtcgcgtgctctcggaccagcattcacctgggtgaaccggaaccctagcccgctattttttacagataattgtctgatgcgctgccttctgaaatgaataaagcaagcgctgtgccagttttacctttccccggcggcggggattttcactggcgataaggaggcggtgagcaaaaatagcgacccaaaatggggcagtgccgcaaagcggtgcaggcctatttttcagtggcaggcttaaggcgtgttttgatgcgctgatttaacctaagaaaaatctctttttttagtcgattgtcacgtgcgaaataacgcaatatagcctttactcaacaccataagataagctgggattaacccctgtcaggtaagggataagaatcaacttaatctcatacttatgcatgatggcggtttattcagcattgtgagaggcgggctggcaaacgccattgaattgttaatcagtcaatgtaaaatcataaagatgatgctaatccatgttaattgctttaccgttttgcgttggcagatttgccggtgcaccggttatccaggcagcatggcatatttcacgtcgggttcaactttattgcagggaaagttacgatgaatttgcgaagcttgttactccttttagtggtcagcaccgtcgtggggtgtaaagcgccgccgccgaaaatcaccgacgataccatcgtgaccagtcaggtaaatggtgtaacgctgacccaccgtcatattgtggtcccgcctaaagaatttaacccggttaacgatgaataccgggcgatgtaccccggctccatcctcagcaagcccgatttcagcggcaaggtgctgggcgagctgaaaaccggcgaaacctatatggtgttaggttttgttgaacaatcctggctggccatcagcaccacggataaccctcagctgctgggctacgtgccgcagcgcgccatggtggtcagcgagcgttacgagcaggcgctgaaaagcgaccgtccgcgtccgaaacgcgcggcgaaaaaatccacctgcgtggccgtggatgacagcagcaaagcctgtcagaaaggcgacagcggtacctggatcatcgactgaattcataacggggagcagatgcaacgtcgctcccccttctcataagataattctgaactaaaatacgtatccagggtgatgaagtcgcaacttcatttttcacaggctaacaaggatttttatgaaactctggctctccggtctggcattgcttctggcaaccactaccgcgtcagctgggaattatcgcatcgtgcaatccccttcgcagaagctggatgtctggatagacgatataaaggataactccccgcaaagctggtgcgccgctgaactcccgctgcgtattaccacgatgggcgataaaaacccgttcattctcagtaactttatgccacgcctcggcaaactgctgttgagtcagtgcagcaccctgacgcagattagctggcagctggtggatccgcaggatcatgtgctggcgaccggcaccgccagtaaagagagtgactgggcgctggatatcgcgccgcaaacgctggagccggaaggcgcaccggcgcaggccaccctctccgccccggccgatcgcaccccctggctggaatttaccctgcaggatggctgccatctgcgcaccttctggcgcggcgatgccaatgcctcggcgctgtttattccggccaaagcgcaggatcagtgtgagaaaggcggctggctgaacggccgcagcgagatggtgcaaagcggcgtcaatggcgataagcgcatgatgatgacctttgtgcacggtttcccggtcagcggattaagcagcgcggtgaatgccgatacgctccttatcaccagcgtcaataatgaacgcatggtggtcagcaacgagcaggccccgcagagctggatgattttgccttacagcccggagattaacggctggaaaagtaacggcacggtggccgtcgaagtgtcccgtgaactggcgctggacgaagcgcgattacagacgcgcctgaatgcggtacgcaaggtctggtcgcaatggctggagccgggcacaccgctgacgctgctgttaatcgataatttgcatccgcaacttcgcgacccggccgccggttcgtggcgcacgcaaaaatgatcacgtccgtctggaacagagaagccgcataatgacaaccagcgattacactccagcgatagccgacgctctgccgccgggctatcgttttgacgaatttgaaatacaggacgttttgcagaccacgccgtgcgagattgtctatcgtgcgtgggatcatcagctggaacgcgccgttatcattcgcgaatatatgccgcgcgcgatggtggtgcgcagcgatgacatgcacctcgcgctacgcagccagcaggatcatccggcatacagcgcaggtcttaccgcctttattcaggacgcccgccgcctggcgaagtttaactatccggaactggtgcaggtgctgcgcttctggacggaaaatgacacggcctacacggtgacgcgctattacagcggcatcaccctggcggaactgcatcagcaacagccggacgtgctggacgaagagtgggtgcgtcgtatcctgccgatgctgtgcggcgcgctggcggcgctgcatgcagaaggcgtgatccatcgcgatttatcgcagaaaagcattcagatccaggacaacggcgtgccgctgctgctgacctttggcgtctcgcgtccgcagggcgacgaggtgcgcgatctcaataccactatgctgcatgcgggctatgcgccgctggagcagtacagcagcgatctggaaaatcagatcggaccctggaccgatatttacgccctgggcgcggtgctctatacgctgatcacaggcgttgcgcccccagccagcgtgacgcgcagcattcaggataactgtattcgtctgacggaaaatccaccggcaggctggtcaccggcgctgttacgggccgtggatcaggcgctggcgctgaaaccggaagcccgtccgcagtccattgaagcctttgcggcgctggcggagatcaatacccatcgcagcacggaaattggcgggctgaaaaaaaccggcacgatgctggtgccggtagaagaagccgcggcggcaaaaccgctgtgggcgcgcgttaaatcgccgttgcaaatcgccgcaggcgtgctggtcggggtgatcgtcggggctttattgttccgcggcgagcctgcggaggttcctgatgcgccaccaaccgcgacggccaccccaacggccacgccggtgacgcctacgcctgcgggcgggcttatcgcgcgggtgtatatccgcatgagcgatgcggatcatctgctggtaaacggcaagccgcagaaggcggtggccgcgtcgagcgggttcgcgtttattcagctcccggccgggaagtatgatattacgctgcaaagcggcagccagacgcatacgcagtcgctggcgatcgccacgccgggtacctggctgattaatccgcaggggtgattcgtttcgtagtaaattgcgctcttactggcttctgagtacggctcagactccaggcgcacagagcgcgcaaggggcggtcagtcgccgccgccccctgccccccgggctccccacacttcacgatttctaaaaaacaccactcacagattcctgtaagttaaaaaaaattaacgccactcagtcgtcttataaagaataaaaataatgacgcgaggggttgagtccccgctgaaaccggcgagccgtaggccggatgacaagggctggacgccatggatggcggccagaggcgaaatgaggcaggatgccgaatcgagccgaccgcgggcagacggccgggaggtgagcgcagtgcgcagcaccggtttctgtgcggggccgcggggattgctaagggggccgcggtggcccccttagcacgttcaccgtcagcggcgtcacgcctgactcaaaacgcaaagtgaacggaacattccaccaaaccaaacattccacagaaccaaacatccctccaaaccaaacattccacagatccgcctgcccccctcaaaatttgccttccattgcgcaaaaagttaaatccaccacgcaccctgcccgatattcgtctactgttttctcaaggttgattgcagcggtttcgctgttcacccctcaaggagaataattaatgaccaaaccttttatgcgccgtccccacacgctgtttttcgccatgcaactcgcgattggtggcgcactgctgtccctttccgccccgctgctggccgatgaagtgcagaacaaaggccagccgcagtcgccggatgtcctgcttggcccgctgtttaccgatgtgcagaccgccaaactcttcccggatcaaaaaaccttcgccgatgcggtgccgaaaggcgatccgctgatggtgctggcggattaccgcatgcagcgcaaccagtccggcttcgatctgcgccactttgttgacgtgaactttattgtgccgggcgaaggcaaaaaatatgtgccgcctgccggacaaagcctgcgcgagcatatcgacggcctgtggtccgagctgacgcgcaccaccgataccgccggaaaatgggactccctgctgccgctgccgaaaccttatgtcgtgcctggcggccgtttccgcgaggtctattactgggacagctatttcaccatgctggggctggctgagagcgaccactgggacaaagtgcaggatatggtcgacaacttcgcccatgaactggacgcctggggccatatccccaacggcaaccgcagctactacctgagccgttcgcagccgcccttcttcccgtttatggttgagttgttagccacccacgaaggggatgatgcgctgaagcagtatctgccgcagatggaaaaagagtatcagtactggatggagggcgcagacgccctgcaaccgggagaagccagtaagcgcgtggttaaacttccggatggctcgctgctcaaccgctactgggacgatcgcgacaccccgcgcccggaatcctggctggctgacgtgaccacggcgaaaaacaaccctaaccgcccggcgacggaaatctatcgcgatttgcgtgcggcagcggcctccggctgggacttcagctcccgctggatggacgatcccgaacagctcggcactatccgcaccaccagcattgtgccggtggatctgaacgcgctgatgtacaagatggaaaaaatgatcgcccgcgccagccaggcggccggcgatacgggcaaagcgcagaagtttgaagcgctggcgaatgcgcgccagaaggcgatggaagccaatctgtggaatgacaaggacggctggtacgctgattacgatctgaaaaccaaaaaggtgcgtaatcaactgaccgccgccgccctgttcccgctgtatgttaacgcggcggcgaaagatcgcgcggataaagtggccgcagcgaccgaggcccggctgatcaagccaggcgggctcaccaccaccacagtgaacagcggtcagcagtgggatgcgccgaacggctgggcgccgttgcagtgggtcgccaccgctggtctgaaaaactatgaccatgagaaggccgcaatggatgtcacctggcgcttcctgaaaaacgtccagcatacttatgacagcaagcaaaaattggtggagaagtatgacgtcagcagcaccggcaccggtggtggcggcggtgaatacccgctacaggacggctttggctggaccaacggcgtgacgctgatgatgctggatctggtctgtccgaaagcgcaaccctgcgataacgtaccggagacgcagcccgctgcgcaatccaccgcgcaaccggctaccgcgcagtcatctgctcctgccccgacggcagaaaaagtcgcacaataagcggttcgcctgctaccagatttggtagcaggttttaatgtgcgaaatcaacacattgcccggcggcgcaggcttgccgggcctacagcaatctcctcactctcccctcggttaatcccacactgattttccgttgtattctttaacgttaacgataataattcgcattccttttacatttgttaatacaaatttcctgtttgtggcggaggcttgttccgcgcacaacggtactcaggatcccggaatgaccacgacattatccctgaaacgttcgtccctgctgtgcgctcttgcgctggcgcttcctcatgcggtgctcgcggaagataccgtggtggttaccgccaccgcgcctcagtcagccattgcgccgaccgaaggctataccgtgcaaagcacccgcggcgcgaccaagaccgatgaaccgctgatcactaccggtcagtcggtgtccgtcgttacccgccagcagatggaagatcagggcgtggcgacggtgtcccaggcgctggcctatacgccgggggtttattccagcttcggcggcggcgctacccgcttcgataccgtttccctgcgcggcttccacggcggcgacgtggataacctgttcctcgacgggatgcgtctgatgagcgacggcggcagccacagtgtgttgcaggtggatccgtggtttattgagcgtgtcgatgtggtgaaaggcccgtcatcggcgctgtacggtcagagcgtgccgggcgggctggtgaatctcacctccaaacgcccgcagtttaaacaggaaggccatttccgtctcagcggcggtacccataacaccaaaggcggcgccttcgattacaccgacgcgatcaacgagcagctggcgttccgcattatcgggatgacgcgcagcagcgatacccagtatgacaacacccgcgaagagcgctacgccatctccccgtcgctgttgtggcagccggattcggataccagcctgctgttgcgcgcttatctgcaaaaagatccgaccggcggctatcacggctccctgcctctcgacggcacgcgctttgcccacaatggccgcaagctcgacaccagtacgaatgaaggcgaaagcgaagacggctaccgtcgtcgtgagcagatctacagcctggagttcgatcaccagttcaacgatatctggtcagtacactccagcggcagctatacccatgccaatgtatcactggatcaggtgtatcagaccggctggatcgacggcggcgatacgctgtctcgcggctatagcggcaaccgtggctcactggatgcgtggtctacggataaccgcgtgcaggcggatttcaataccggcgaggtggcgcatacgctgatcctcggcggcgaataccatcgctatcgcaacaatctgtggacaggcgcgggcagcgcttcgccgctcaacccgtacaccggttacactgcgcagcatggccacgttgtgacctacagcgatgacaacaaccgccgctattaccagaccggcatctatttgcaggatgagatggtgtgggatcgctggcatatggatctctccggccgctatgaccgcatcgtctctgagcaggtgagcgacagcaatgccacctcgaatcgtcgccaggatgatcatatcagcggcagagcgtcactgctgtatgcctttgaaaacggtctttccccctacatgagctacagccaggcgatcaccccggcctcgctgccaggtgcggacggtacgctgctgaaaccgaccaccgccgagcagtatgaagcgggtctgaaattccagccgccgggcacctcggatatgtacagcattgccctttacgacctgacgcagaaagacgtcgccacccgcgatattaatatcgccactgcgagctatctgcctgccgggaaagtgcattcccagggagtggaaatcgaagcccgtaaccagttaacgccacgcctgagcaccattgcgggctatacctggaatcgcctgaagtatcaggattcgctcgatggtaacaacggtaatacgccgcagctgacgccggaccagatggcctccttctgggcaaactataagtttgattacggcctgagcgtcggcgcgggcgtgcgttacatcggcaagcagtgggcggatgatacaaactcatcgcgcctgccgtcggctacggtgtttgatgcctcggtgcgtgcggatctgggcgagtggtcagcgccgctgaaaggggcgttcgtgcaggtgaatgccaataacctcggcgatcgtgagtacgtggcgggatgctacggaaccaataactgctattacgcggcggagcgcagcgtggtggcgaccgtgggatatgacttctgatcgcgttgcgtatttcctgtcgaacagggtttagtggaatgttccgttcactttgcgtttcgcatcaaacgtaacaccgctgatggtgaacgtgctaagggggccaccgcggcccccttagcaatccccgcggccccgcacagaaaccggtgctgcgcactgcgctcacctcccgaccgtctgcccgcggtcggctcgattcggcatcctgcctcatttcgcctctggccgccatccatggcgtccagcccttgtcatccggcctccggctcaccggtttcagcggggactcaatccctcgcgttaattacgatgacggtttgttacgactgagtggctgtgtgtttgtctgaacttacaggaagctgtgagtggtgttttttagaaatcatgaagtgtggggagtccggctgaaaatcgctgaggcgttcccttacggccggggcagcccgcatggatgcgggctgagggcgcgacttgcagggacgctgcatcacgcccgacccgaagccggaagggataagccgaaggcaccgcgaagcggcgattttcctgccgggagcccgggggtgcagggggcggcggcgactggccgccccttgcgcgctctgtgcgcctgaagtctgagccatactcagaagtcagtaagagcgcaacagaccacaatactaatagctaatttacccgcgacgcagcaaacggaacagcgccagtaccacaatcgcacctaccaccgcgaccaggaagctgtgcagatcaaaacctgtcacgtcgccgccaaagccgaacatcgtcgccagccagccgccgaccacggcacccaccaccccaagaatacaggtcagaatgaaaccaccgccatcacgtcctggcatgattaatttagcgataacaccggcaataagaccaaaaatgatccacgcaataatgcccattttgcatttcctctttttgttgtgacttgatattgcaagattgatttcctgcccacgacgctaagtataggcaaccacagcaaaagggttagttgtcacagacttaattcagtttaatcgcaaaaaatatttggtcgtttgtattaagtttcccgccgccatgccgatatattcccgacaggcgatacgctattaaggagccatccggcgtgagtaattatagtgagcagtttctgaagcagaccccactggccgtactgggggtattgcgcgatctgcaaaaaggccaggtgccactgcgcatctcatgggccagcggtcagttcatcagtaagatcctcgatgttacgccggaagggctggtgatggactatggcagccaggaatacgataacaaagccgttcagcgtgccgaaaatatcgccatcacggcggaaacccgtggcgcaaaagttgaatttacgctgccccgtttacagagcggtcagtaccaggcactgccagcctttaccacgccactgcctgctgaactctggtttatccagcgccgggaatatttccgcatttccgccccgctctatccggcctattactgcaaagccagaatgccggataaatccatgctgcgtttccgtttgtttgatttgtcccttggcggcatgggcgcgctgctggaaggtaacgcgccggaagcgctgaaggaaggtctgcgctttacgcagattgaactggatatggcgggatggggtcagttctatttcgatgcccagttactgtcgatcagcgagcgcaccgtggtggacggcaaaaacgaaaccgtcaccacgccgcgcctgagcttccgctttctgaatgtgaatccggcagttgagcgcgagctccagcgcattattttctcgctggagcgcgaagcgcatcaacgggcgaacaacgttcgctaggcgttacatggcatccatcgcctgctggactttccagatatagcggggtgcctggggtgcagggtgattgtcggccacatggtcgacaaactcatccgggctgagcgagttgatctctttgatggcctttttacgatccgatgagaaggtgcgcaacagcgcccccgccccgttcacataagacaccaccagcgcgtactgcatcacttccggatcttcgatccctgccagcacgccgtgttccagtatgctcaggtaagcggttcccatagagatattacgctccgggtttttcagctcgctggtggaaggttgccccttccagcccatatgccggtacacttcacgtccggcggttgaggctttcagctgcatcaggccaaccgcgttggatttgctgaccagcgtcggattaccgccggattccaccgcaatgatcgcagtgatgagtcgtgggctgacgccccatgccgctcccgctttctcggtgatcggcatccactgcatggcgcgttttaccggtacttccgggttccatggtggatttttatagtcctgttttgaactgcatcccgccagtaacacaatcaaaaaagcaaaccatcttaatttcacgccaacgatccttataccggtatgtaatgttcagtcgcccgccagccagcagatgccgcttgaagtgtgacgggcgtaagcggcatgataaacgtttcaccttatatgtcagcaaggaattgccatgtcagtgtttcatttgattgcgccttcgggctactgcatcaatcagcaggcagccgcccgcggggtcgcgcgtctggaggccgccggtcatgaggtacgtaatcgcgaggtgatcgcccgtcgctggcagcgcttcgccgggagcgatgccgagcgtctggcggatctcaacggacttgcccggctggccggtaaaaacactatcgtgatgccggtacgcggcggctacggggccagccgtctgctggcgtcggtggactggcacgggctggcgcagcgccagcagcaggatccgctgctaatttgcggacacagcgatttcaccgcttttcagatgggactgcttaagcacggcgtgatgagcttcagcgggccgatgctggcgggcaacgtcggcgcggaaaccgtagacgctttcaccgaacgccacttctggctggcactgcgcaacgaaaccttcacagtggaatggcacggcgacggccagccctgccaggcacaggggacgctgtggggcggaaatctggcgatgctggtgtcgcttatcggcacgccctggctacctgttatcgacaacggcattctggtgctggaagacattaacgagcatccgttccgcgtggagcgcatgctgttgcagctgcaccatgccggtattttatcccgccagcgggcggtgatcctcggcagcttcagcggcagcgccccgaacgattacgacgcgggttacacgcttgaggcgatgatcgactatatgcgcacgcaaattcctattccgttaatcgccgggctggccttcggccatgagccgcaaaccgtcaccctgccccttggcgcgcaggcgacgctggatcacgatggcagccataccgggttaaccctgacagggcattctgtgctgcatgcgtaaaaaaaccattcatcgcacttatcaaatctgacctcctgccgttaatataaagaagcgtattgagatgcacggtcaccgatcgtgcatgttgtctggcagtaacggtgttttaaggagtaattcgacattggaagcagaggcgataatcggtctttttatcctgggttctgttcttgtaacctgtagcatcttattaagttctttctcctctcgtctcggtattcctatcctggtcatttttcttgccatcggcatgcttgccggggtggatggtgttggcggtatccctttcgataactatccctttgcctatatggtgagtaacctggcgctggcggtgatcctgctggatggcgggatgcgcacccaggccagttcgtttcgtgtggcgctgggcccggcgctgtcgctggcgacggtgggcgtgctgatcacctccggcctgaccgggatgatggcggcctggctgtttcatctggacataatggaaggcctgctggtgggcgcgattgtcggctcaacggacgccgcagcggtcttttccctgcttggcggcaaagggcttaacgagcgcgtgggctcgacgctggagatcgaatccggcagcaacgacccgatggcggtctttctgaccattaccttaattgagatgatccagcagcacgaaagcgggctgagctggatgtttgcagtgcacattattcagcagtttggtctgggtatcgtgctcgggctggccgggggttatctgctccagcagatgatcaaccgtatcgcgctgcccgccggtctgtatccgctgctggcgttaagcggcggcattatggtgtttgctatcaccacggcgctggaaggcagcgggatcctggcggtctatctgtgcggctttttactgggcaaccgcccgctgcgcaaccgctacagcatccagcaaaactttgacggactggcgtggctggcgcaaatcgccatgttcctggtgctcggcctgctggtgacgccatcggatctgctgccgatcgccattccggcgctgatcctctcagcatggatgattttcttcgcccgtccgctgtcggtctttgccgggctgctgccgttccgcggctttaacctccgcgagcgggtgtttatcagctgggtgggtctgcgcggcgcggtgccgatcattctggcagtcttcccgatgatggccgggcttgataatgcgcggctgttcttcaacatcgccttcttcgtggtgctgatttcgctgcttttccagggcacttcactcggctgggcggcgaaaaaagcgaaagtggtggtaccgccggtgggctggccggaatcccgcgtcgggctggatattcatccggaaaatccctgggagcagtttatttatcagctcagcgatgacaaatggtgtgtcggcgcggcgctgcgcgatttacacatgcccgcggaaacgcgcattgccgcgttgttccgtgataacgccctgctgcaccccaccggcagcacccggctgcgtgaaggggatgtgctgtgcgtaattggccgtgagaaagatctgccggcgctcggcaagctgttcagccattcgccgccggtggcgctggatcagcgcttctttggcgactttatcctcgaagccagcgcgaaattcgcggatgtggcgctgatctacggcattgacgtcggcgcggattaccgcgacaagcagcagacgctgggggaaatcattcagaaactgctgggcgcggcgccggtcgtcggtgaccaggtggaatttgccggtatgatctggacggtagccgagaaggaagacaatgccgtgcgtaaggtaggggtgcgcccgatggaagacgaggcggaataaccgccccgttaaaagttacaccgtcacgacaggcacgcgcggggctaaggcgcacatcagttcatagcccaccgtgcctgcggcagcagccacatcatcaattttgatctcctgcccccacagctccaccggcgtacctattcccgcctgcggacagggagtgagatccaccgccagcatgtccatggacaccgtgcctaccgtacgggtgcgcacgccgtccaccagcaccggcgtgccgtccggcgcgacgcgcggataaccgtcggcataaccacaggcaacaatgccgatacgctgctcgccccgtgcctgataacgctggccgtaacccacacgatcgcccgcctttaacgtctgaatgccgatgatctggctgctcagggtcatcaccggtttcaggccgctggtggccacgtcctgccactggccagacggcgatgcgccgtaaagtatgatacccggtctgacccagtcgaaatgcgccgccggatgccagagcgtggccgccgagttggacagcgagcgcgggcaatccagcccttctgccgcctgttcgatttttaccatcgcctcatcaatgccatccggccgttccgcaacggcgaaatgcgacatcagcgtcatatcgccgacgttgctcatcgcccgtagttgctgccagacggtatggatccgctccggctgaaagccgaggcggttcataccgctgttcaccttgagataaatatccagcggcgcctgcaggcgtgcattttgcagcgctttcagttgccagttgctgtgcacgctggtggtcaggcgatactgatcgaacagcgccagttcatcggcgtgaaagaacccttccagcatcaggatcggccctttccagccgcgttcgcgcagcgcaatggcctcctccagattaagcatcgcaaagccatcggtgctgctgagcgcattccagacccgctcaatcccgtgaccataggcgttggctttcaccaccgaccagacgcgggacaccggcgcggccagccggacgacctgcaggttgtgccgcagcgcctgagtgtcgatggtggccagtacaggacgagacatgactgctcctttttagttttgcacaccgtgcaggtgttgcgcgcgggccggggtaaaaccgggctggtagcgcgccacgctcagatcctcgaacggaatggccggagtacggccggagagtaaatcgcttaacaactgcccggaaccgcaggccatggtccagcccagggtgccgtgacccgtgttaagccacaggtttttaaacggcgtgcgccccaccagcggcgtaccgtccggcgtcatcggccgcagcccggtccagaaggttgcctgctccacatggccgccgcgcgggaagagatcgcgcaccaccatctccagggtttcgcgccgcggctgtaacagttcggtgttaaagccgacaatttccgccatcccgccgacgcgaatgcgctggtcaaaacgggtgatggcgattttgtagctttcatccagtatggtcgaaactggcgcgccgtcatcttcggccaccggaatggtgagtgaatagcctttgagaggataaaccggaatatcgacaatatttttcagcatcgccgtggagtaagagccaaaagccatcacataagcgtcggctttgatcacctcatcgccgcacttcacgccatagattttttcgccttcatacagcagttgctccaccggcgtgttatagcggaacaccacacccgcctgttccgccatcgccgccagacgttgggtaaacagctggcagtcgccggtttcatcgttcggcaggcgcaggccgccggtcagtttgtgtgccacttccgccagcgccggttcgacttcggcaaggcgggaagattccagcagctgatacggaacgcctgcgtcttccagcaccgcgatatcgcgggtggcgttttcatattgctgcgcggtgcggaacagttgcagcgtgccgccctgccgcccttcgtactggatgccggtgctgtcgcgcagggctttcaggcagtcgcggctgtactccgccagacgcaccatgcggcctttgttttccatgtagtgacgggtgtcgcagttgcgcagcatttgccacatccatttcagctgtgacggggaaccatcaaggctgatggccagcggcgcatggcgctcaaacatccatttgatggccttcagcggcacgccgggcgcggcccagggggcggcgtaaccgggggagatctgcccggcattggcggcgctggtttgcagcgccgggcccggctcccgttcgatcaccgtgacctcgtgtccggcctgattcagataccaggcgctggtgacgcctactacgccacttcccagtacaacaatgcgcataaccactccctttgagaaagaacaatgttctgattacaaattgataacccagatgaaaatgttattcaacatatggcttttttatggtgacttacctcacatcttcgcccgcgcggcctgtgatggcggatttaggatctcctgctgaccggcgattttagtcagcatttaatgctgcaaacaggcgcttttaccccgtcaccacaaggcgaaatggcgaagaaaaaaatttaccaggcagaccctttgtgacaccttgatctatgcttgaaatgaggctctccatacagagagatccgccaacaatgagggcgcgctaatggctacgattgattccatgaataaggatacgacacgtctcagcgatggacctgactggacgtttgagctgctcgatacctatcttgctgaaattgaccgcgtggcaaagctctaccgtctggatacctatccgcaccagattgaggtgatcacctctgaacagatgatggatgcctattccagcgtcgggatgccgatcaattatcctcactggtctttcggtaagaagtttatcgagacagaacggctctacaaacacggccagcaggggctggcgtatgaaatcgttatcaactcaagcccctgtattgcttatctgatggaagagaacaccatcaccatgcaggcgctggtgatggcgcatgcctgttacggacataactctttctttaaaaataactatcttttccgcagctggaccgatgccagctccattgtcgattacctgatcttcgcccggaaatacattaccgactgcgaagagcgctatggcgtggacgaggtggaaaaactgctcgactcctgccatgccctgatgaattacggcgttgaccgctataaacgtccgcagaaaatttcgttgcaggaagaaaaagcgcggcaaaaaagccgtgaggagtatctgcaaagccaggtgaatacgctgtggcgcacgctgccgaaacgcgaagaggtggaaaccgtggcgcaagcgcgccgctatccgtccgaaccgcaggaaaatctgctctattttatggaaaaaaatgccccgctgctggagtcctggcagcgcgaaatcctgcgtattgtgcgtaaggttagccagtatttttatccgcaaaaacaaacccaggtgatgaacgaaggctgggccacgttctggcattacaccatcctcaatcacctgtatgacgagggtaaagtcaccgaacgttttatgctggagtttttgcacagccacaccaatgtggtattccagccgccctataacagcccctggtacagcggtattaacccttatgcgctgggcttcgccatgttccaggatattaaacgcatttgtcagtcgcccactgaagaagatcgctactggttcccggatattgccggatcggactggctggaaacgttgcatttcgccatgcgcgattttaaggacgagagttttatcagccagttcctgtcgccaaaggtgatgcgcgatttccgtctgttcagcgtactggatgacgatcgtaataattatctggaaatttcggctattcataacgaagacggttaccgggagctacgcgccaggctttcggctcagtacaacctgagcaatctggagccgaatattcaggtctggaacgtggatctgcgcggggatcgttcgctgacgctgcgttatattccgcacaaccgcgcgccgctggataagggccgtcgggaagtgttaaagcatgtgcatcgtctgtggggttttgacgtcgcgctggagcagcaaaatgaagatggcagcgtggagctgttggatcgttgcccgccacggccaaacaatctgtaaaacaaaaagccctctccggtgagagggctttttcttagcgtccgtgcattgagataccgccgggcagcgtcttttgcatgcggtgccagatttcgccgctctcgcgaccgtaacgacgcacggtgtcatatacctgatcaagctcgccccgctcacacacctgcgccagctggtgataaaagccgagcgccaggctgcgcgcttccggattagcaaagtaatgacggccaatacgcgtatataaacctttcatgccgttgatgatcaggccataaatcgggttacctgatgcaaacgccagcccgcggaagatgttgtaatccagctcggcaaaggcatccgcatgatcttcaatagcgctggcggtggccagcaccttcagcgcatcttccgggtgctggcggaaggcggtacggataaaaatggtggcgatgttggtgcgcacggaaagcaggttatcgatcagctgaggaacgctttcgtgatcgaggcgtgccagcgtttcaagaatattcagcccggacgtttcccagaaattatttactctggtgggtttgccgtgctgaatggtcagccagccgtcgcgggccagacgctgtaacacttcacgcagggttgtgcgagtgacaccaatcagttcagaaagctcacgctcggctggcaggatggttccaggggcgaagcggttattccagatactttcgatgatgtattcttcagcgaaacccgccgggctttgcgccttaatgaccatagtgagatttccattacacagcttaacaaagacactcatcataccagagcgatacaggcgcagatagcgccaggcatgaagaaaaagggatcgggacttcatttttaagattttgtcagacgcatttttctggtgaataaaaccagcaaactgacttaagggacaggcttatcctggcgacgattcaggtaaaataatccattacttattatttttattgtggctagtggcgcaggaagtgaattcgtttacactgcgttgtccacgcttgtcttagggaaatgattatgttgcgatttttgaacaagtgctcacacggacgcggtgcctggctgttaatggcactcaccgcgctggcgcttgaaatggtggcgttgtggttccagcatgtgatgctgcttaaaccctgcgtactctgtatttatgaacgaagcgcgctgtttggcgtgatgggtgcggggttggtgggagccatcgcgcctaaaacgccactgcgctatgtggcgatggcgatctggttgtacagcgcctttcgggggatccagctggcctgggaacatactgacattatgttgcacccgaatccgtttgcgacctgtgattttgccgcccgcttcccgagctggctgccgctggataagtggctgccgcaggtgtttgtggcgtccggcgactgcgcggaacgtcagtggtcgttcctgtcactggaaatgccgcagtggttgctgggcatttttatcgcctacttcgcggttgcggtactggtggtgattgcccaggcgttcaaaccgaaaaaacgcgatctgttcgggcggtaatcttttagcccggctttacagaaatccggaaatacttaatgtttccggatttttttatgccctccatctcatatcctcgaaataaacaacaaaatatatccacgcacaccagaccttctcaatcgtatctgattgaattcattgacaataaatacttgttccaatgttttgtatttttaatgaatttatttatttctcagtagacaaattttgtctatgagattatgctcaataaaaatttatcatttggtaagattatgtttcgatcgattcagatgcttagagctttggctgtctggcttgtcgtgctacatcatgtcaagcagattgtcttttctgatgccattggaataccattcattgaccaaattgctcataaaggcgcagcaggggttgatcttttctttatcatcagcggctttatcatttatcagtcaatatattcccgccatataagtgctcaacaatttgccatcaaccgcataatgcgaatagtaccggcatactggctgtttacaggcctcgttgcgctgctggcagtatattttgatggcctaatgtttgctacttctacaaatcctgagttactgatacgcagtctgcttttcattcctacagagcgtgctgacataatgggttatatccccttcctgacggtaggctggactttaaactatgagatgtttttctacctgctggcctgtctggtcattttaatctctcgtgagaggtttatagtcttaatttcgttagtgataatttttagttatgaattcctgaaaccttccctggcgcaaatgcctttttatggcaacggtatgatgctggaatttttgctggggatttttatagctgattttcacaagaacgggatgctggaccgaattaacccaatgattctggcaagtctgttgctggcctcaatgatatttatttataacaggaaggaagaccacgatatactattcataggtatcccgtgcgctatcattgttgcaacagctattggcctggaagcacagataagtgaaagcaaagtggttaaatttattataagattaggcgattattcctactctacttatctttgccacgtcatcatcatttgcagtctcctgtacatattcagcgattataaatattgcaagtatatcgtatctgcactttgtgttccctttacaatagttacttcatacataagctataagtatatcgaacggccaataggtagtttatctaaggttatgctcaggaaaagaacaccagcggtcgcctgagatcataaagaggcagttcgcagtgaactgcctctttatgccatgatgctttcaatggcgaattgtcagtaatcccatttaattccggttaacgaagcgtgggtaattccctcgggtaatgatccgtcctttgtcctcacggtatccatgatagagcatgggaaagatacaagcttccccgatacaatacccatcattgtcctcctgacgggaaaagagggccggagagataatggaagcgaaaccattgcggcagaagtacctgaagatataaaacctttaactacggccctgtatcccttaaggcaaaactcaaagttttcatttccttcgctttgcacccaccctcctgtcagcgccggagccgagccgccgagggtagcagtatcaaattttgggccagtgagggctgagtatttctcatcacccacataaattttaccaagttgcgtcatataataaaggttgcctacagaccacgcatccagaacatcaatatttacacacgcatgatcaagactacgaataactgcgccagtgatgtttactgcatacagcgaagttatgtgagtctgctgggggttcatctcgggagtagcaatataaaccgcatgtgcgcaattactgacattcattgagccgatattaattctggatgctgtagttgaaccttccactatataagagtattcgcccactattgtaccatcgagtcccatgccatctgtagatatactggcaatttgcacatcttttaatgggactagtcccccaatatgcacatgccacctggcaccggatgcgccagtaaagcctatgaatatgggaccagtgaatggctttgcgttcgtatcaagatcgataccgtgaagtgccaccgcagggataaaccagggcgaagttccgcgcggcttttgcctgcaataatggtcgatgactttcacattgccacaatcggagaaattatctgctttaataatcaaaccattctggctttgcgaataagtataaataccggtagcggtaacatcgcaggccttgatgataatgccatgatacccaccaatccctgtaatattatcaagtcgtccacctgtatatccttcagtaagaactgcgtgtccgcgtgcttcactgttataaagtaaacctgtcacattttgtaaaataaaattgcgcttttgtgcagtgcctttatgtggggcagcaaatgcaaaagcatcccagtcacccccgtcgggatgagaagatgtagtgatatcggctccggggtatttttcatcgatataatctttgccgttatcaaatccgacatttaaggcattaaaattgtttgcataaactttgaatcttccacatagcactgaaccgcctgttaaacgactgagagtgttattccagacaggagctcgttcaccaagaatacgaacattatctgtccccatgtaatcggttgtggtattccagcttccggattcccaacggccagccggaacgtagactgttccgccatttgttaaagccgcaatagccgctttaagggaaggataattcgctatattaacagtgggtagcctgccgtaaaggtcattaagagcagtccctaccgttttcggtccataggatagttcagagctgtagccgaataaacccgcaccgctgtcactgctcagttcagatcgcagcgatgcgtcactaacttgatcccaggcttcattatgtatgcccccatccctttcatgtgctggaacggggcgaacaactttggggaactggttgttccacctgggagattctctgttgaattcgcagagcgagcgctggtcagcagggccaacggcgctgccattttcagaaggatccttcgggatatagccatatttcagtattaccgggatgtcatttatcttaattcccgaaattttactgactatgtacccatttttcccttatccaggtcaaggtaatcatggctatatgaaacaaatttcagttaaggcgctatccagagtgccagcaacagtcgaactgaagaagtaaatactttgatgagtaaccgtttaatccgcccactccggcttattcaaaatatgatcctgccagtcattcacttctgactctttaaccgcaatgtgacgcacggagatacgttcggcgtgcattgcggctttggagccggtacgcagcggatgccagaccggcaggctcttcccttcagcgaggagtcgataggcgcagctcggcggcagccattcgaaggttggcagattatcgcgggtcagcttgatgcagtccggttcaaattcgaaacggcgctcatagttgcggcactgacaggttttgatattcagttggcgacaggcgacgttggtgaaatagatttcatccgtgtcttcatccatcagtttgtgcaggcagcattgcccgcagccatcacacagcgattcccactcggcgtcggtcatctgctcaagtgttttgctttgccagaaaggagtgtcagtcataagcggatccgccagtaggaaatcaagctgcaccttataaccagtcaggctcgttgatgcaagctttgccgcccttgcggacggcatttcgcatttaaagtacgcgggtattgatggttaacccgttgaggctcacttccagcgcatcgccgctgtgcagcgggccgacgccttccggcgtgccggtgaggataatatccccggcgcgtaaggtgaaaaaccggctcatgtaggcgatgagcggcacgattttgtggatcatgtcggccgtcgttccctgctggcgcacgtcaccgtttactttcaggctgagcggggtgttttgcggatcgccctggaattctgccgccgggataaaaccggaaatcgggcaggaattatcaaagcctttcgctttttcccacggctgccccgctttcttcatctgcccctgaatatcacgcaatgtcagatcgagcgccacgccgtacccggcgatcgcctgttcgacgtgcgcttcgctcgcctgacgcagcgtggcgccaatcagcactgccagttcaacttcatgatgcaccgatcccagtccctgcggcagcgccagcggctggcgcagatcgcaaagcgcggtttccggtttgataaacaacaccggctccgtcggggtggcgctgcccatctcctggatgtgctttgcgtaattgctgccgacgcagacaactttactgaccggcatttccagcagtgcgccctgccagtgatgatgttgatacatgagttccccctgagtaacaccctgaacgcgtaagaaattaaccttttccgttgctcgccagatgttgtttcagcaaatcttccggcggcggtggcaactgcaaataatagccctgcgtcttcagcgcttctttcactttttccagatcggcgttgaccagttttttacgcccgtcgaggggtaagagcatcgccagttgcggtttaccgaacccctgcatcagggcttcaggcacgcgggaaaaatcgtcttttttttcaacgtaaaggtaggtctgttcacgccgtgggcttttgtagatcacacaaaacattcttttgctcttatttgtcgggaggtcacttgcctcaatataatcctgactataacatgccttctggtcttcggaatattacccgctgtacgggtgataatagcaaattgagtaaggtcaggatgtcaaacacgcccatcgagctaaaaggcagtagcttcaccttatcagtggttcatttgcatgatgcaaagcccgaggttattcgtcaggcgttgaaagacaaaatcgctcaggctcccgcgtttttacaacatgcgccggttgtaattaacgtcgctgatgtggaaggcaatatttcctgggccacgctgcaaaaggtgatcgccagtaccggtttgcgcgtggtggggatcagcggctgcaaagatgccgccctgaaagccgaaatcgaacaagcaggcctgccgttactgacggaaggcaaggagcaggcggtacgtcaggcccctgcccccgttgcagtggtggaagaacctgctgttgcgccccacaccatttcacggttgatagatacgccggtgcgttccgggcaacgtatttatgcacctaactctgatttgattgttaccagtcatgtcagcgcaggtgcagaactgattgccgatggcaatattcatatctacggcatgatgcgtggacgcgcgctggcaggcgccagcggcgatcgtgaggcacaaattttctgtacccatctcaccgcggaactggtttctatcgcgggggaatactggctgagcgagaacatcccggccgaattttatggcaaagcggcgcgtctgttgattgcagataacgctttgactgttcaaccattgaactaagccctttttaacaaggaactcctatggcacgcattattgttgttacttcgggtaaagggggcgtcggcaagaccacctccagcgcggccatcgcgacaggtttagcccagaagggaaagaaaaccgtcgttatcgattttgatatcggcctgcgtaaccttgatctgatcatgggttgcgaacgccgcgttgtatacgatttcgttaacgttattcagggcgatgcgacgttaaatcaggcacttatcaaagataagcgtactgaaaacctgttcatcctgccggcatcgcagacgcgtgataaagacgcgctgacccgtgaaggcgtggaaaaagtgctcgacgatctgcagaaaatggacttcgattttatcgtctgtgattcaccggcaggtatcgaaaccggcgcgctgatggcgctttatttcgctgatgaagccattatcaccaccaacccggaagtctcttccgtgcgcgactctgaccgtattctgggcattctggcgtcaaaatcgcgccgtgcggaacagggcaaggagccaatcaaggagcatttgttgctgacccgctacaatccgggccgcgtcagcaaaggcgatatgttgagcatggaagacgtgctggaaattctgcgtatcaagctggttggcgtgatcccggaagaccagtcggtgctgcgcgcctccaaccagggcgagccggtgatcctggatgccgcgtcagacgcgggcaaggcctatgcagatacggtggaacgtctgttgggagaagatcgtcctttccgcttcatagaagaagagaagaaaggtttcctcaaacgcctgttcggaggataaattatggctttactcgacttttttctctcacgaaagaaaagtaccgccaacatcgcgaaagaacgtttacagattatcgttgccgagcgtcgccgtagcgatgctgaacctcactacttaccgcagctgagaaaggacattctcgaagtcatttgccgctatgtgcagatcgatccggaaatggtctcggtgcaactggaacagcgtgatggcgatatttctattctggagctgaacgtgacgctaccggaaacagaagacagtaaataaatctctcttactggttaaaatatcagagataaaaaaggcagccttaacgctgcctttttatttatctgccaaaaaaccctgtaattaattacaggggtaatgaaagatcaccgcggatattcttttagcagcacgttaagttttggcgccattaaatcgccgcgccagccggaaattaattcaggctgcacgctttgcggttttaactgccagtgccagttgagcagctgattaatctggcgacgggaagccagcagttcggcgctgacgccgctttccgtactgacctcctgtaccagcgctttgatggctttaaacgccttgcggtagcccggcatatccaccagattcaccagcggctcaggtagcgcctcctccggcaattcctgcgctttcgccaccagcgccagcagggttttaccgtggaagcggatctcgctgcctgacaagccaatgctgtccagctcgcccatgctaccgggcatataacgcgccacggcccacaggtgctcttcacgtaccacgaagtttaccgccagatcgcgctcacgcgctttacgcagacgccagtccgccagcagacgcagacaggccagttgacgggtgcgcagctgccaggcgttgctgatgtcgcgccatgcctcctcaggggccagcacttcctggcggcgctgctgcatcaggcggcactcgtccagcgcggcgggcagccagcctgcggtttcggcttccgccatcagtttgtgggcgatgggtaacaggtaccagacatccgccgccgcatagatgcactgacgctccgttaacggacgcgccagccagtcagtgcgggattcgcttttatccagcgccgtgccggtatactcctctaccatcgcggcaaagccccatgacatcgggcgtccgctgaaggcagcgaggatctgcgtgtcgatcagcggttccggcagttcgccaaagacgttgaggaacacttccagatcttcgctacccgcatgcaggaatttggtgatgctgcgatcctgtaacagcgcgcggaacggcgtccagtcggtgatggtcagcggatcgatcagcgatacctgctcgccgtcaaacatttggatcaggccaagctgcggatagtaggtacgggtacggacaaattcggtatcaagggcgatagcgggaaacgcacgcgcggcgtcgctcatggcggccagcgcgtcgttggtggtaatcatctggtaattcaaatcaggttctctcaggtttgcgcccataaaaaacgccggctaaccggcgtcgggcgacttactcaaagctcagactttattgtccactttggcgcgggcttcgtcacgcaattctcgtcgcaaaatcttgccaacgttggatttcggcagttcatcgcggaattccaccagttttggcactttgtagccggtaagctgacgacggcagaaggttatcagcgcctcaccggtgagcgccggatctttcctgaccacaaagagtttgaccgtttcaccgctgttgccggagggtactcccaccgccgccacttccagcacgccgggatgctgcatgaccacgtcttcaatttcgttagggtaaacgttgaagccggagaccaggatcatatcttttttacgatcgacaatacgcaggaagccttcgtcgtccatcaccgcaatgtcgccggtgagtaaccagccgtctttgaggatctgatcggtatcggcaggacgctgccagtaaccaagcatcacctgcgggcctttaatgcacagctcgccaggctgaccgtgctcgacttcgttgccttcatcgtcgatcagtttggcttcggtggacggcaccggcagaccaatgctgccgctgtgataatcaatgtcgtgcgggttgacgctcaccagcggcgagcactcggtcagcccgtagccttccagcaggtattgtccggtcagcttcacccagcgctcggccaccgcctgttgtaccggcatgccgccgcccgcggagagatgcagagaggagaagtccagctgctggaactctttgttattgagcagcgcgttaaacagcgtattgacgccggtcatcgcggtgaagggatatttcgccagctctttcaccagccccggaatatcgcgcgggttggtgatcagcaggttctggccgcccagctcgataaacagcaggcagttcatggtcagcgcaaagatgtggtacagcggcagcgccgttacgaccagctctttaccgcgatgcagcagcgggccgtaggtggcattcacctgttcgaggttggcgagcatattgcggtgcgtcagcatcgcgcctttcgccacgccggtggtgccgccggtgtactgtaaaaacgccagatcgtcagtcaccacttccggcttgatgtactgcatccggtagccgttgtgcagcgcctggcgaaacgaaatcgcatccggcaggtgatatttcggcaccagctttttgatgtatttgaccacgaaattcaccagcgtgcccttcgccggggagagctgatcgcccatacgcgtcaggatgacgtgctggacctgggttttttccaccactttttccagcgtgtgagcaaagttggagacgataacaatcgccgccgcgccgctgtcattaagctgatgctccagctcgcgcggggtgtacagcgggttgacgttcaccaccaccataccggcgcgcagaatgccgaacagcgccaccggatattgcagcaggttaggcatcatcagcgccacgcgatcgcccttcttcagccccagcccctgctggagataagcggcaaacgcccggctacgctcttcgagtttgcggaaggtcatcacctcccccatattcacgaaggcaggttgatcggcataacgcgccgtggagtgttcaaacagctctaccagtgactggtagcggtcggggttgatctctgctggcacatcggcgggataacggttaagccaaaccttcttcaatgcatcacctctgaaatgagtatttgtcgtcatcgcaaccccggataataaacaagtcgttaacattatattaactcagcgtaccagtttaataattaaacggatttaaggttgcgaagcgcgtcactatttatttttcttatgatcctgaaaacgcagaaacagcggaccggccgctgtttcttttgttgcattaacaggagtttactcggttactatggtctgaacctgcgccgggccgggattgtaccagccgccataaccgtagcgccacgggtgaggccccggtccccagaaccacgggtcgatgggctgcggcggcatcatcacctgctgggtaatacgccagcgtttatagccgttcgcctgcatcaccatgtatttatatggcgtgtcgccgactttgccttcggcggtgccggtaatcggcccgacaacggtgaccagctgaccgcggaagtcgaccggatcgaggaagccgctgacatcggcataaatacgtccgcgggacggctcgcccagcaccggacgggcagcgctgtccagcggcacggcggcgatctcaaggcgggttttgccctgctcgtttttcacgtcgatcactttgccgccaaaacgcgcttcctgacccacatagagctgcggcgcgttcatcacccgcaccagatcctgctgcggcgtcgggctggtgcccttaatggcatccggtacgctgacgcaaccgctcagggcgacggccaccagcgcggcgactgcgccgtttacaactcgtttattcagtgccatgttgcgactcccgttatgaacatcctgtatctaagattcactcgcgaccaggaagtttcttccatgccacttcgtttcgcaaataaacaggttcggcggtatcggcggtcacggtgttgcccgccgccagcagctggcaggccagcggcagcatatcttccgctgcggggagcagaatgtcgccgtccgtcagcgtgagatcgcagccttgcgccagatccggccaggcgggccagccggtgcccacggtagcccaggcgccgtccagctgcgccagacgcgcgcgcacggcttccggtttcaggacggcttccgtctcttcgccgtgccagacaccctgcgcatcgcgctcgtactgcgcccagtagacttcgcccatgcgggcgtcgatggcggccagcacgcgggtggcgccggttttacggtaagcgccctgcgccatggtggcgagggttgagacgccgatcatcggcagctctgcgcccagcgccagcccctgggcaatgccgatgccgatacgcacgccggtaaaacttccagggccgcggccaaaggccagcgcgtcaagatcgcgcagcgccacgccgccttcgttcaggatctgctgaaccagcggcagaatgcgctgcgtgtgctcacgcgggcagagttcaaaatgggaatggatggtgtcgttttgcagtagcgcaactgaacaggcttcagttgcggtatcgatagccagaattcgcatgggtcttcgcgcgctctctttaataaatggcgcgcataatatcacagactgcgattactgtgtcggcgggacggcgagaaagcgcacggcgcgggagatgtcgcgggtgcgcggcgtcggcggcaggctggcgaggaaggtcgcgccatagggccgcatcaccagccggttatcgcagatcaccagcacgccgcgatcgtcaatatcgcggatcaggcggccgacgccctgtttcagggtgatcaccgcatccggcagctggacttcatcgaagggatcgccgccgcgcagacggcagtcttccatgcgcgctttcagcagcggatcgtccggggaagtaaacggcagtttgtcgatgatcaccagcgacagcgtgtcgccacgcacgtccaccccttcccagaaactgctggtcgccaccagcagcgcattaccggcggtgacgaactgctgcaacagctgccctttgctggtttcgccctgcaacagcaccggcagcgtcagggtggcgcggaactgttccgccagatcgcgcatcatggcgtgggaggtgcagagcataaaacagcggccattgttggcttcgatcaatggacgcagcatcgccgccagttgccgcgccgcgcccggttgattggtctgcggcagattgcgcggcacgcacaacagcgcctgacgggcatagtcaaacggactcggcagcagcagcgagtgcgcctcttcaatgcccagccgggcggtgaagtggtgcagatcatcattcaccgacagggtggcggaggtaaagacccagctgcccggcttctgcgccatcacttctttgaatttatcggctaccgacagcggcgtcagcgcgagggtgaagtgccgcgaggtgcattcgtaccagtagctgtagccgggctggttgatctctttcaggcgttttaagcgtgcgcggtacagggtggcgcgttcaaaggcggcatccagcagggctgaacgcccgagggagagttttgccacgtcgtagcacagctcaagggtgtcatcgagcagcaaaaaagcgcgctgaatgtggctgtccgccagcagttcgcgcagattcccgcgatagcccggctcgccgagctgcaaccgaaaatcctgggcgctctgcgccagccggtcggcgcatttttgcagctgctgggtgtcgcgcagttcggtgcgataggcgatggtgaaatcttttgccaggtcgagcaactgacggctggaaagcgactgaccaaaatactggctggcgatatccggcaactgatgcgcttcgtcgaaaatcatcacctcggcttcggggatcagttcgccaaagccgctgtctttcaccaccatatccgccaggaacaggtgatggttaaccaccaccacgtcggcatccatggcttttttacgcgccttcaccacaaaacagtctttgtactgcgggcagtcgctgccgaggcagttatcgttggtgctggtgaccagcggccaggcgggagagtcttccgccacgctggcgcaggtgctgatatcgccgtcgacggtctggtttgaccatgagcgcagcagaataacgtcgctcagggtctgcacgggtagatcgccccccgccagcgcctgctgttccagacgttcgatgcacagatagttggagcggcctttcagcagcgccagtttcccgctgtactccagcgcgcgggagacggtgggcagatcgcggctgtaaagttgatcctgaagcgctttcgatccggttgagataatgacttttttcccggcgcgcagtgcaggtgcaagataggcgtatgttttcccggtgccggttcccgcttccactaccagcggctgcgttttcgcgatggcctcagccacagcctgcgccatctgccgctgcggttcacgcgggttaaatcccggtatcgcttttgctaactgaccgtcgatcgcaaaatcgtccgtctcactgtttttcgccacactaccccctggttaaatcgccagtgattatgtcaggggcgatggcttttagccagccgaagtcgtgacagggtaaaaactctgtggcagtcttggcgcgccaatggaaattaaggagatggtcatgacaatcgtgcgtattgatgccgcagcccgctggtctgatgcggtgatccacaatcagacgttgtattacaccggcgtgccggagaatttgcaggcggatgcctttgaacaaaccgccaacacgctggcgcagattgatgcgatgctgataagccagggcagcgacaaatcacgcattctggatgccaccatttttctggcggacagcaaggattttgccgcgatgaataaagcgtgggatgcatgggtggttgcgggtcatgcgccggtgcgctgtacagtgcaggccacgctgatgaacccgcaatataaagtggaaattaaaattatcgccgccgtttaaaggcgattattcttcctcgtcttcttcgtcaaagcgtgccagaacccgttcgcctttatggctggcgcgcagttccgcagcaaccagggcaatggcttcgccgctgctcatgccttcagccatcaacgcatgaatgcgatcgacggcctcttgttgttgctcgtgcgtaagggaaggtaaacctgcaaacatagtgaactcctgctaaattgttcgcgctgatcaaacatgctaccccataagccggttaccggatagcaaagagtctggattaatgaagacgttatcacccgccgttatttcgctgccgtggcgccccgacgccgccagccactggtttaccccactcaacacgcagccatgggccatgctgttgcattccggccatgcggagcatgcccataaccgttttgatattctggtggcgcagccctgttgcacgctggtaacgcacggcgacaataccaccgtgacccgcgagggtgtccgtacagcgtccacagcggatccgctggcgctgttacagtgtgaactggacgccatgcagcttgccccgccctgcgatcctgatttgccgtttaccggcggcgcgctgggtctgtttggttatgacctgggtcgccgctttgaaacgctgccatcgcaggccgaacaggatcttcccctgccggatatggccgtcgggctgtacgactgggcgctgattgtcgatcatcatcagcaaaaagtcaccctgcttagctatggcgatatagcgcaacgtctggcctggctggaagcgcaacgggccgaagagacgcaatcgtttagcttaacctcgccctggcgttcaaatataacccgcgagcagtatggcgagaagtttcgcgcggtgcaggcgtttttacacagcggcgactgctatcaggttaaccttgcccagcgctttcaggcacattaccgcggcgatgagtggcaggcgtttatgcagctgaaccgcgccaaccgtgcgccgttcagtgcgtttctgcgtctgccgcagggggtggtgctcagcctgtcgccggagcgctttattcagctgaataacgggaccattcagacccgccccattaaaggtacgctgccgcggttaagcgatgcgcaggcggatgctcatcaggccgcgcggctggcgcagtcgcccaaagatcgcgccgaaaacctgatgattgtcgatctgatgcgcaacgatctgggccgcgtcgccgaaccgggatccgtacgcgtgccggagctgttcgtcgtcgaaccgttcccggcggtgcatcatctggtgagcaccatcaccgcccggcttcctgcctcgcgtaccgcctgcgacgtattacgcgccgcttttccggggggatcgatcactggcgcgccgaaagtgcgggcgatggaaattatcgatgcgctggagccgcaccgccgtaacgcctggtgcggcagcatcggctatatcagtctgtgcggcaatatggacaccagcatcactatccgcaccctgagcgcctgtaacgggcagctatactgttcggcgggcggcggcatcgtcgccgacagcgaggagcaggcggaatatcaggaaacctttgataaggttaatcgtattctgcatcaactggagagctgattttggatttacaggcgctgacactggatgattttttatcgcgatttcaacttttacgtccgcaggcgagccgcgcgtcgctgaacgccagacaggcggcggtgctgatcccggtggttcgccgtgaacagcccggtctgttgctgacccagcgttcggcgcagttgcgtaaacatgccggtcaggtggccttccccggcggcgcggtggacagcagcgatgcgtcgctcatcgccgccgccctgcgtgaggcgcaggaagaagtggcgatcccgccggagacggtggaggtgatcggcgtgctgccgccggtggacagcgtgacgggatttcaggtgacgccggtggtcggcattatcccccctgacctgcactatcacgccagtgaagatgaagtggcggcggtttttgagatgccgctggcggaagctctgcgtctggggcgctatcatcctttagacatccatcgtcgcggcaacgatcaccgcgtatggctgtcgtggtatgagcactatttcgtctgggggatgacggcgggtatcattcgtgaactggcgttgcagattggcatcaaaccctgaatattctttatgcaataacccttctgccaggagtgggatccgcgtctcgccattagaaaattaatgttcacgcattaatttaattcatgcgaatactccagccgatcccgcagttccctcatacactatgcgcaattattacatcgttatcggaaagtccggtaaccctgtcaggagtgttaatgtgattagtctattcgacatgtttaaggtggggattggtccctcatcttcccacactgtaggcccgatgaaggccggcaaacagttcgtcgatgacctggtcgaaaagggattgcttgagagcgtaacccgcgtggcggttgacgtgtacggttcgctgtcactgaccggtaaaggtcaccatacggacatcgccattattatgggtctggcgggcaatgcgccggccaccgtcgatattgacgccattccggcgtttatccgcgacgttgaaacccgcggtcgtctgctgctggcgcagggtcgtcatgaggtggatttcccgaaagataacggcatgcgcttccagagtaataacctgccgctgcatgaaaacgccatgcagatccatgcttacaacggcgacaccaccgtttacagcaaaacttactattccatcggcggcggttttatcgtcgacgaagagcatttcggcaaagaagccagcaatgaagtgagcgtgccttatccgttcacctcggcaaaagagatgcttgattactgccatgaaaccggcctgtcgttatccggtatggtgatgcagaacgaactggcgctgcacagcaagcaggagatcgaagattacttcgctgatgtctggcagaccatgcgcgcctgtatcgatcgcggtatgaacactgaaggcgtgctgcctggcccgctgcgcgtgccgcgtcgcgcctcggcgctgcgccgcctgctggtggccagcgataagctgtccagcgatccgatgaacgttatcgactgggtgaatatgtttgccctggcggtaaacgaagaaaacgccgccggtggccgcgtggtcaccgcgcccactaacggcgcatgcggtatcgttccggcggtgctggcctactacgatcactttattgagccggtgacgccggatatttatatccgctactttatggcgtccggcgctattggcgcgctgtacaagatgaacgcctctatttccggcgcggaagtgggctgtcagggcgaagtgggcgtggcctgttcaatggcggcggccggtctggcggaactgctgggcgcaagcccggagcaggtgtgcgtggcggccgaaatcggcatggagcataacctgggtctgacctgcgatccggtggccggacaggtacaggtgccgtgcattgagcgtaacgccatcgcctcggtgaaagcgatcaacgcctcacgcatggcgatgcgccgtaccagcgcgccgcgcgtgtcgctggataaggttattgaaaccatgtacgaaaccggtaaagacatgaacgccaaataccgcgaaacctcccgcggtggtctggcaatcaaggtgcagtgcgactaatacttctcatagcccttctgcgacagaagggctaaatctcctccaattctcgtccgattattttttccacactacacttgctgtggtgccgttgccttttgcgatcaacggtatacttaccggacgatgacttcatgcagactgcgcaacggatcattagcgactaccggcgaaaacgcattatcgtctgcgtgcttgcggccgtttccatgctgctgttgaccctcggcgcgcgatttatttcggagcggaatttaaatcagcagcgtctgttatctttcacttctcatgctgtttcctcactggaaaaagtactctccgcccttgaacgcgggcgtcccctgctgttgccgctggtaggtaaaccctgcgacgacgtgcatctggcgctgcgtattgaagcggcttctttgcagactatccgctccattggcctggtggagaacgggatgctgtactgttcaagcatttttggttttcgcaatgtgcaggtgcgtcaacttcagcctttgctgcccgccagcgaagcacagctgatcctgtccaccgataaatcgttactcaaaggcagcccgatactgatccaatggtttccttctgcgcaaggggatgacagcggggtgatgaccattgtcaatattacgctgctgaccgacctgatgctggagccgcaaaaaccgctgatcaccggcgccagtctgtcggtcaataaccggcatctactgtatggcggtggggtggcggacgccctgcccgcgctgacggatgaaaaacgcttttcgcaaacgtcacagcgctacccttttacggttaacgtccgcgggccgggcgcaacggagctggcgctgcggcatctgccctcccagtttccgctggcgctgctgctcagcctgctggtgggttatatcgcgtgggtggcgaccgccagccgcatgagctttgcgtgggagatccatatggggctggcggaaaatgagtttgagctgttttgtcagccgttgctggacgcacaatcccagcagtgcgtgggagtggaaattctgctgcgctggaataatcgccgtcagggctggatctcgccggatgtgtttattcctatagccgaaaaccagggtttgatcgccccgctgacgcgctacgtgctgacggaaacccatcgccagctcgccctcttcccgccctcgccgcactttcatatcggcattaacgtcgccgccagccatttcggccacggagagctgattgccgatctgaaccagcactggtttaacatccgtccggtgcagcaactggtgatagaactcaccgagcgggacagcctgagcgaggcggatttccgcatggtgcgtgaactgcatcgtatgggcgtgaaagtggcgattgatgattttggcaccggcaacacgtccctctcgtggctggaaaagcttagcccggacattcttaagatcgacaaatcctatattgcggccattggtacggatgcggtgaattcgacggtgacggacatgatcattgcgctgggcaaacgtcttgcgctggaaatggtggcagagggggtggaaaccccgctgcaggcggcacatctgcgccagcgcggggtgcatgtgttacaggggtttctctatgcgaagccgatgccgctgaaagatttccccggctggctggcgggaagtaccccgccgccagcccggcataacgggcggatgatgccgtcaatgccgttacagtagccttactcttcttcgtcgtgctccggacgctctttaacaacccgaaccagatcgacccggtagtcgttggcttccagcacggtaatggtcagcggcgccagttgcagcacgtcacccgcgcgtgggatctgaccgttaatggcaatcaccagaccggcaacggtcgcgatatcttcgctgtcgttaaccaggttatccagccccagcgcatgttgcagggcatgcagatcggtggtgccttttaccagccagccatcggcatcggcgatgatttccggcgtttcgtcggcatccgggaattcaccggcaatggcttccagcacgtcgagcggcgtcaccaggccctgcaccacaccaaattcattggtgacgataacaaagctgccgcgggcgcggcgcagcacgccaagcagtttgatcggatccagggtttccggcaccacaatcgccggggacgcagacgctatcgccgccacatcgccgccctcttccagcgctaccagcatctctttggcgcgcacgataccgatcacttcatccagctcgccacggcagaccgggaacaggctgtgcggcgacgagagcaattgctggcggatagtgtccttatccaggctggcatccacccaactgatgtcgccgcgcggcgtcataatgctgcgcagcgagcgcgacgccagcgtcagtacgccgttgatcatataacgctcttcatcggcgaaggccccttccggcacctgcaccggcgcttcgctgtccggctcatgctgttgattatctttgcggcgaccgcccatcagacgcagaatggcgtccgcggtacgggcacgcagcggcagcgttgactgatggcgaataaagttgcggcgagcaatctggttaaagaactcaataatgattgagaaaccaatcgcggcatacaggtagcctttcggaatatgaaagccgaagccttccgccaccagactcagaccaatcatcaacaggaagctcagacagagcaccaccaccgtcggatgctgattgacgaatcgcgtcaacggttttgaagccagcagcatcaccgccatggcgatcactaccgccgccatcatgaccggcagatggttcaccataccgaccgccgtgatcaccgcatcgagtgagaagaccgcatcaaggatgacgatctgtaccaccacgacccagaagctggcatagcctttcgtctgtccggtgtcatgttcacggttttcaagtcgctcgtgtaattctgttgtcgctttgaacagcaagaatagtcccccgagcagcatgattaagtcacggccggagaagcttaaatccatcacggtaaacagcggctttgtcagcgttaccatccacgagatcaccgacagcaggccgagtcgcatgatcagcgccagtgacaggccgatcaggcgggctttatcacgctgtttaggcgggagtttatccgcaaggatggcaatgaacaccaggttgtcgataccgagaacgatttcaagaacaacaagcgtcaacaaccccacccagatcgaggggtccattaagaattccatgacaggctcctgtttacggaatggcaaaacggtgcgttaagcacaggcgtgatgacagcagatgaaaatgaaaggtggcggaaaacgccggattgcgaggcacgaaacggccaatgggttaactgacgtcggtgacggtccatacacggggctactgccctatactccttgataattaaacggatggtaaacatagcagagagaattaatgttttgcaaagatttaccggaatttgcaattggaattttgtggttatttcgcgggccgaaatttctgatcgacgaaagctaaattacggatgcgcatcacaaaaattattttttcgatgtctaaaataattcacggaagttttaacttttctttcaaacccttatctgaatcgattcgctggtaaagattgattcacaacacatctgttacagaggtgttaacgataataacggaggtagcaagtgaccattgctattgtaataggcacacatggctgggctgcagaacaattgctcaaaacagccgaaatgctgttgggtgagcaggaaaacgtcggctggatcgatttcgttcccggcgagaacgccgaaacgctcatcgaaaaatacaacgcccggctggcaaatctcgacaccagtcaaggggtgctgtttctcgtcgatacatggggcggcagtccgtttaacgccgccagtcgaattgtcgtcgataaagagcattatgaagtggttgccggggtcaacattcctatgctggttgaaacgctcatggggcgtgatgacgatccgagttttgacgatctggttgccgtggcggttgaggcgggacgtgagggggtgaaagccctgaaggcaaaagcgccggaagcggtaacgcctgcgcctgctgctgtggcaaaacccgccgcaccggttaagcccatgggcgcggatgattacatggtgatcggtcttgcgcgtatcgatgaccgtttgatccacggccaggtggcaacacgctggaccaaagaaaccaacgtgcagcgcattatcgtggtcagtgacgaagtggccgctgataccgtgcgtaagaccttgctgacgcaggttgcgccgcctggcgtgacggcgcacgtagtggatgtcgcgaagatgatccgcgtttataacaacccgaaatacgcgggtgaacgcatcatgctgctgtttaccaaccctaccgatgttgaacgtctggtggaggccggggtgaagatcacctccgtcaatatcggcggtatggcttatcgtcagggcaaaacccaggtaaacaacgccgtttcggtggatgaacaggatattgaggccttcaaaaaactcaatgcccgcggtattgagctggaagtccgtaaagtctcaaacgatccgaaactgaaaatgatggacttgatcggcaaagtggcgaagtagccggcacgagctgatttactcagttttcacaactacgtcttagttataggagaagtacaatggagatcacccttcttcagattgtgctggtgtttgtcgttgcctgtatcgccggtatggagtcggtactggatgaatttcagttccaccgtccgctggtggcctgtacgttaattggcatggtgctgggtgatatgcaaaaaggcatcatcatcggcggtaccctggaaatgatcgccctcggctggatgaacatcggggccgccgtggcgccggatgccgcgctggcgtcgatcatctccaccgtgctggtcattgccgggggccagagcatcggcgccgggattgcgctggctattccgctggcggcggcaggccaggtgttaaccatcatcgttcgtaccattaccgtggcattccagcacgcggcggataaggcggccgacaacggcaaccttacggcgctgtcctggatccacgtttcttccctgttcctgcaggcgatgcgtatcgcgatcccggccgtcatcgttgcggtttctgtgggcaccagcgaagtgcagaatatgcttaacgccattcctgaagtggtaaccagcggtctgaacatcgccgggggcatgatcgtggtagtgggttatgcgatggtcatcaacatgatgcgcgcgggctacctgatgccgttcttctacctgggcttcgtcactgccgccttcaccaacttcaacctggtggcgctgggcgtgattggcgcggtaatggccatcctttatatccagctgagcccgaaatacaaccgttcagcaggtggcccggtaccggccgcgggtgcaaacgatcttgataacgaactggactagcaggtgagcgacatggttgatatgacaaaaactaccgcagtgaaaaaactcactccgggtgatattcgtggcgtgttcattcgttcaaacctgttccaggggtcgtggaacttcgaacgtatgcaggcgctgggtttctgcttctcaatggtgccggcgatcaaacgcctctatccggaaaacaacgaagcgcgccgtcaggccatcaagcgccatctggagttcttcaatacccatccttacgtggcggctccagtactgggcgtgacgctggcgatggaagagcagcgtgctaacggtgcggagatcgacgacggcgccatcaacgggatcaaggttggtctgatggggccgctggcaggcgtgggtgacccgattttctggggtacggtgcgtccggtgtttgccgcgctgggtgccgggatcgcgatgagcggttctctgctcgggccgctgctgttcttcatcctgtttaacgccgtgcgcctggcaacccgttattacggtgtggcctacggttaccgtaaaggcgtggacatcgtaaaagacatgggtggcggcttcctgcaaaaactgaccgagggggcgtcaattctcggcctgtttgtcatgggggcgctggttaacaagtggacgcacgtgaatatcccgctggtggtgtcggaaattaccgaccagaccgggaaaaccaacgtcaccaccgtacagaccatcctcgatcagctgatgccggggctggtgccgctgctgctgaccttcgcctgtatgtggctgctgcgtaagaaagtgaacccgctgtggatcatcgtcggcttctttgttatcggtattgccggttacgccgtcggcctgctgggtctgtaaagggtagttattgcgccggggcctttgccccggctttttttcgggaggatgaatgacgatcacggatatcgtgttgattttgtttgttgctgcactgctggcttacgcactttatgatgaattcatcatgccccgccgccatggacaaacgctgctcagcgtacccctgttgcgccgcagccgggtcgacggcttcatttttgccgggttgctggtgatccttatttataacaacgtgaccaataatggtgcggttttaaccacatggttattatgcgcactggcgctgatggctatttatctgttctgggttcgcgcgccgaaaatcatcttcaaacaggatggttttttcttcgccaatgtctggattgcttataaccgcattaaagagatgaatttatctgaagatggtgtgctggtaatgcaattagagcagcgccgcctgcttatccgggtgcgcaatatcgatgacctggaaaagatctacaaagttatggttaaaactcaatgagttaaaatatagcgaaggctatatttctgcacataaaatcaccgcagttatagccactgctatattattttctacggaataacttatattttttaacctgattattaccaataaagacaaatgcaaatcgttatcagcctgacaaaaaagtaatgaatttctgtgattgttctcaccttgcgaaatatggtaaggttgcgcccgtcgttggggagtagccgatttccattcaccccggaaatgtgcgcgtcaacatactcgttgaaaaacgtggcgcgtacgaatcaaaccgcatagccgtttgatttggcgagaccattgacacatcaactgctgattactgggggcagtgatgtgttatatggataccccggtcaggacgctcttatgaatttatctgccactctcctgctcgcttttggcatgtcgatggatgccttcgccgcttccatcgggaaaggcgctaccctgcacaaacccagattctccgaggccctgcgcaccggtctgatctttggcgcgattgaaaccctgacgccgctgataggctggggactgggcatgctcgccagccagttcgtactggagtggaatcactggatcgcctttttgctgctggtttttctgggcggacgcatggtgctggaaggggtacggggaaatgatgatgaagatacgcccctgcagcgtcacggcttctggctactggtaacaaccgcgattgccaccagcctggatgccatggcggttggcgtcgggctggccttcctgcaggtcaatattatcaccaccgcgctcaccattggctgcgcgaccctggtgatgtcgacgctcgggatcatgattggccgctttattggcccgctgttaggaaaacgggctgaaattctcggcgggatcgtgctgatcggtattggttcgcagatcctctggagccacttcgccggttaaggattacgctgccagcactggatgctgaaatccgtctgacagctgaactgttccatatccgccagcgcttcccataccgccggtttcgcccgccacgcgaagggcgtcatctgcaacagcgccaccgcttccgccccgctcagggtcatgcggtaccccagcgcatgctgctctgccagcgtaaaaccttcgatctgctcactttgcggcgcgtgaagctgaacttcatcgtagatcagccctttcagctcctgtaagtgatgcgggccgggagcggcggtgatcacccagccaccggctttcactacccttgccagctcctgcgctttacagggcgcgtagatacgtacaatcgcatccagcgtactggcttcaaacggcagccggtggcttgacgccacacagaacatcacctgcggataacgctttgccgcggcgcgtattgcgggctttgacacatccagcccgaaagtctgcgccccgtgctgcgcggcgatctgcgcgaacgcatcggtgtaataaccctcgccgcagccaatatccagcagcgcactggcctgcgccggtaagcgtgcgtccagttgctcgctgatggcatcccgcaacggctgatagtgccccgcatccagaaaggcgcggcgcgcctgcatcatctctgcgctgtcccccggctcgcgggagcgtttatgctgaacgggcagcaaattgacgtagccctctttcgccagatcaaactgatgccgttgcgggcagacgaggctattttcctgacggcgcaacggcgcatggcaaagggggcaactgaaggacatatcaactccgggcgataataaagggcgaaagtgtaacgccaatcgcccctgcgggaaatgatttagcgcgttgccgccacgccggaagaagaattgagcaccagcagatgatcgtcgccggggcgcaaaccgtcgggttcgatattttcgacacgcagtacacgggtcatgatctcgctgaataccggcgccgacacggcaccgccgtaataggcaccgtttttgggatcgtcgatcaccaccaccagcgcatattgcggatgactggctggcgcgacgcctgccgtgtaggcgacgtatttatcgacatatttcccgtcatcgccgattttcttcgccgtgccggttttgaccgccacccggtaatcgcgtaccgccgctttggtgccgccgccgcccggtagcgcgacgctctccatcatatgctccacctgatgaacaatgtcagcgggcatcacctgcgtacccatcaccggcggatcgacacgggtaatagaaagcggccgcgccagaccaaaactgccgatagtggcgtagacatgcgccagctgtagcggcgtgaccatcaggccatagccaaatgagaaggtggcgcgatctaactgcccccagtaacggcgcaccggcaggctgccacggctttcgccggtcagacccagcccggtggggataccaaagccaaagcttttataagtatccaatagcttctggatgggcatcgccagcgacagtctggacacgccggtatcgctcgatttctgcagaatgccggtcagcgtgagttccgggtaatagcccacgtcgcgaatacggtgtccgtcaatgacatacgggtgggtatccaccacgctgtcaggtttgactatcccctgctgtagcgcagtcatcagcaccatcggcttaacggtcgagccgggttcaaaggtatcgctgatggcgcggttacggaaatcatccagggtcgcgccgctgcgattattgggattaaaatcgggataattggccatcgccagaatttcaccggtgtctatttttatcagcaccgccgcgcctgactccgccttattccaggtaacggcgttattcagcgcatcttccgccagggtttgcagccgtttatcgatgctcagcgccagggtttgtgccggtaccgcgggcgtttcggtgatattttcaatcacgtgcccatagcgatctttacgcacctcgcgcagaccgggcttgccggtcagctgcgcgttaaagcttttctcaacgccttcgatcccctgcccgtcgatattagtaaaaccgatcagattggcggcaacatgcccgccgggataaaagcgccgtgattccgtttgcagattaatgcccggcagattgaggcgatctatccactgcgcctgttggggatcaagctgccgcgccagatagacaaagcgcgacgatgcatgttgccggagcatggcggccagatcgctcagcggcattcccagcgctttcgtcagcgcctgccagcgtccgttatccaccgggccgcccttttcacggataaccttcggatcggcccagacagcatcaacgggcacgctgaccgccagcggtgatccattgcgatcgacaatcatgccgcgcggcgacgacactttcacttcgcgcaaagaacgcctgtcctcctgcctgaccagtttgtccggggcaataatctgcagccaggcggtgcggcccagcagtatgcccagcgagaaaagaatggcgatgcaaagcagggtaaaacgcagaggggtaaaattgagggtaaggctgttctttttcaccgtggctcctgtaatgaattaacccgctgatttaacgggaaacaggcgcagaaagggaaaaaactgtgctaataacggtatggctttgctacaaaaggataatgaggaagcaggaggtaacactttgaaatgaaggcattaaaaagccccgcaccgggcgaggctttatgctgacattgaccgcctgtggcgttcaagtcggtggcagaaatcagatagcggtaacgttaactgctgccgggcctttctggccgtcctgaatttcgaactcaacgttctggccttcagccagagttttgaagccgttaccctggattgcagagaagtgtacgaacacatctttgctgccgtcagcaggagtaatgaagccaaaacctttagactcgttgaaccacttaacttgacctttaatctttgccatttgcaaaattccttagagtgttttcttagcccgcaggcattaactgagataaaactgagacattactgcttgaggcactaatataaggttcggcagagaagcggtattcaacgacaacgtgtttactcaggacttctttactgaaaatgccacacataaacagaactgtacctcgttcgactcacgacgtgttatcacatacaacatgaaatatggcaagccatttttaaacatgtctggatccgccgcacaaattctgcaaatgccttcactacccgccttcgataagacctgacgttgcagatcagggcgctttaacggtagttatgggcacgtgcggatcctgtgaaaaacacgactttataaccatagcttaatatgatggattgatccagcctaagctaagcgattgatataatataaaatatatccttataactttttcttctggcttataaagttaacaaaagaaccatcaataaagcgtaattttacctggttatacaaaggtgctgagtgagtgaataaaagttgcacaaataataatgtgcctgcaccaaaataatgaaagtttaatgacattgcatcatcgtaaagcaataaaaacgtttcgctggtgcaaaaaataatagcatttgctgttaatgcgggaataaggaaaagcttatgcgaataatttcgctggaaaggataaatactgaccgattttcaggatgcgaaagttatcacgccgccctcccgcttcgtttaattcctgcaccagttcccggacaggttcatcgagcccttcatccgccagctcaaacacgccccagtgcaccggaaaagccagcggttccccggcctgctgccagagtcgcaccgcctgctgaggatccatatgatgtgaggccataaaccagcgtggtgcataagcgccagccggcagcgccaccatatcgaatggccccagacgctgcgggatgtcggccagcgtcggcgtgtagcctgtatcgccggtaaaccagaaacgctggtgcggggatgtcactacccagccacaccaaagcgaccgattgcgatcccacagggtgcgcatactccagtgctgggcgggaacggcagttatcgtcaacccatggaagctgcggtgatcccaccagtcgagctcaacgatatgctgtacaccgcgacggcgacaccagtcgcccagaccgagcggtacgaagagggtgacataaggaaaacgctttagcagcgcacgcagggtacgcttatcaagatgatcataatggttgtgggaaatcaggatggcgtcgagggcgggcagatcgttgatgttcagcgccaggggcgttttgcgccgcggcccgctgaaactcaccggtgaggcgcgatctgaaaataccgggtcaatcagcagatgcttgccgtcaagtcgcaacagcatactggtatgaccgagccaccagacgcgatcgtcttccccggaaataacggcgcgttgccaccatttgtcgataaaagcgtcataaccaccctgtggtgctaaaggtaacccggcggcacgacgttctttacgccagcgctccacgtcgccaggtttatgtccggtttcagacaggttacgaaaaccttcaggggaatgatgcggcagatcaggattataccagggatttttccatgccatgctgcaccctcccctgacgatcagcgctcggcgaccagacgaataaaatcgtcgccatcggcctgaacgttcaccgctttctcgggcgcttctttttcaggttcgtttgcttcgcacaggcggcgcagcaaggccgtctgccgcttttgctgatcgagcagcgcttcaagcagttcgatctgttcacgggtacgtgagctcagacgattgacaaaaaaccacaggatcagacctgcgaccagcaccaccagcgatacgatcaaagacgcaagattaaacacgcctgaattcagtacttcgttcatttcaccacctcaatgttaacgcgctatcttaccactggcattaaggaaggaaatcattcactgaaaaaatgccgtcaccagggaataaatttattgataacgcagataccgctgaaaaactgcacatcctgatcgcacataacattcagcatctgggtccacatcaacaggcagacaaccagcgcggcgatcacgataagccaccgaaattttctcactacactctccgaattaataccctgtctcaaggttatcacgcgcttgttaaaccgcggctaactgtagcgctatccggcctttttaggaatgcgtgacttgtttcattgcgtaaaaaccgccaggattttacgcacaggataataaaaggagtttatatgcgcatgacagttcgcacgattatgatcatcgctctgctgtggattggcgtattactgagtggttacggcgtactggttggcagcaaagaaaatgccgccggactcggtttgcagtgtcgctatctgacggcgcagggcttcagcacagcgcaatatattcataccgacagtggaattattggttttacgaattgcccggtactgcgcaaaagcaatacggtaattgattaagtgattgcccggtcagcagcggctaccgggcaacgatttctattcagaacgggtagtcgttgtagcccatctgctcagagattttacgcgcggcagtgtgcagcatggccacgtaatcgtgcaaatgctcctcagagaaacgcagcgtagggaacgaaatactcagacccgcaatcaccacgccaaaacggtcaaataccggtacgccaatgcagcgcaggccttcttcctgttcttcgttatcttcgccgtagccctgctcacgtacgatatccagcatcggcagcagatcttgagttgtggtaatggtgcgatcggtactgcgcttatactcaacgccttccaggatctgcttcacttcttcacgatcgcgccacgccagcagcactttgccaatcgccgtgctgtacagcggattgcgacgcccgatacgggaatacatgcgcaggttgtacatggaatcgattttgtgaatgtagacgatactgtcttcatccagcgcgcccaggtggatcgtctctttggtcagacgggacagttcgcgcatctgaatatccgcgctgcggatcagatccacattctgtagcgcacgcgcgccaagttcaaaaagcttcagcgtcagcgaatacttttctgactcaccttcctgcgccacataacccagcgatttcatggtctgcaaaaagcgataaacagtgctttttgacatcatgacccgctgcgacagttcggtgataccaatttcacgctcttcgccgagcgcctgcaggatgccaaaaactttcagaactgaagagacagaatctggctgcttatccaaatctgcgattgccattaatcacctcatcgccagtgttttataaaaattagaaccggtttttattataaattcgcggcgggctgcccgcaatgcgcgtttggcatcttctttacaaatctgcgacataaaaccgaatatcctgccggacggcataaaaaaagcgcgccgggtggcgcgcctgatgtatcaaatgacggcttatttcagataagcgccgctacgcaacgcttcaatgcgtttatccagcggcgggtgagtcataaacagctcgctgagcgatttggacttaccgttgatgcaaaaggccatcatgctgctggcttcctgcggctcatagctggttttcagacgctggagcgccgcgatcattttctcacgcccgaccagacgcgcagaaccggcgtcggcgtggaattcacggtggcgggagaaccacatggtaataatgctggccaggataccgaacaccagttccagcaccatcgccaccacgaaatagatcatcgggttgccgttgctctcttcgccctcttcgcggttaccgccaaggaagcccgccgccagctgcgccaggatacgggagatgaagataacgaaggtgttcaccaccccctgcaccagcgtcatggtaaccatgtcaccgttggcaacgtggctgatttcatgggcgataaccgcttccgcttcgtcgcggctcatgttctgcaacagcccggtgctcaccgccaccagcgaagcgttacggctggcgcccgtggcgaaggcgttaatatccggcgcgtggtaaatagcgacctgcggcatggcgatcccggcctggcgggactgctgctcgacggtctgcatcagccagcgttccatatcgttacgcggctgctcaatgacttcgccacccacggatttcagcgccatccatttcgacatcatcagtgaaatgatggatccgccaaaaccgaaaagcagcgccatgattaacaagccctgaatactgctggactgaatgcctgtcaggctgagcaccagcccgaaaaccaccatcacggccaggttggtcagcaggaaaagcgctatccgcatcataattttcttttaaccccagtttaacaaaacgcactatgcgattacccacatcgtatgggtatacgcggcattttcaaggatccaggcttcgtaagtcaccagaaagacacaactttacattgagaatgacattgctgacgtgaatacgcgtttgttaaaaaaaacaggcacaatttcttgtgcctgtggtttttattttgcaggagcgggcttcgccgccggttgatcttttgtgagatgggcaagatcaagggcgatatgcaccgtttcatccagatacggatccggctccttgtaatcttttggcaggtcatccagcttcttgagtaacggcttgccttcgcgcttaaagcgatcgttcagacgcgccagacgaatggcatcgtcttcggcgttctctttctcgcgctgcgcctcattcagcgacacgatgtcccgtttttccttcatggcgttgaaacgggcaatgtccttcatgatgtactggaactcaggatcttttgcgatacgctcgttatgatctttcagcaactgcggcccgtgcggcgttaaatcgccatacttcacaaaggtcgcggcgttgatgctgtcccacggcagggcgttatcctcgaacttctcgccggtttccgtctcttcattacctgtcggcatgatgatgtccggcgtgacgcctttacgctgcgtactgccgccgttaacgcggtaaaatttctggatggtgtactgcaccgagcccagcgctggccattccggacgcagcatctgatcgtaaatacggttcagcgagcgatactgctgcacggtacctttaccgaaggttggttccccgacaatcagcgcacggccataatcctgcatggcggcggcgaaaatctccgatgccgaggcgctgaagcggtcaaccagtaccaccagcgggcctttgtagtacacaatgccgtcgttatcgctgtcttcgcgcactttaccgttgttatcacgcacctgcaccatcgggccggacgggataaacagacccgagagcgataccgcttcggtcagcgcgccgccgccgttggtacgcagatcgataatcacgctgctgacgttctgtttttccagcttctgcagctgcaccttgacgtcatccgtcaggccaacgtagaagcccggaatatccagcacgccgactttttctttgcccacggttttcacggacattttcaccgcgcgatcttccaggcgaatgcgttcacgggtcagggtaacaatgcgcgttttggtgcccttacctgccggcaggatctccagacgcactttgctgcccttcggccctttaatcagcgcgacgacgtcgtccagacgccagccgatcacgtccaccatgttctgcccggtctgaccaacgccaacaatgcgatcgccaacggtaatggctttgcttttcgccgccggaccgcctgccaccatcgaattaatgacggtgtagtcatcgtccatttgcagcacggcgccgatcccctcaagggagaggctcatttccgtgttgaactgttcggtgttacgcggcgagagataattggtgtgcggatcgatttcgtgcgcgaacgcggtcatcgccagtgagaaaacatcttcactgttggtctgcaccagacgacggatcgcaaacttatagcgacgcgtcagggtctcgcggatctctttttcgtttttaccggtcagcttcaggctcagttcgtcaaacttaaccttgccatcccacagggcgttcagctcggcttcgtctttcggccacggcgctttgctgcgatcgacgttgaaggagtcgttgccggtaaagtccatcggacgctccagcactttcagcgcgtattgataacgctcaaagcgacgcttctgcgccagattgtacagatcgtagaaaacgtcgagtttaccggtgcgtaactcatcgccgatcacgccctttttctgggcaaactgggcgacatcgctggctaacagcacgttgtggctgtaatccagcaggttcaggtagcgatcgaaaattttggcggaaaacgcctgatccagatcgaactggcggtagtgggagcgagtgaagcgcgaagtcacgcgttcactcactgtggcatgctgcgtctcttcctttaacaccggaatttgatcagcacgcgtaatatcttcgacggcgaaagcctgccctgtgatcaggagcaggccagccaacgcggtgcgcttaaacaaagtgttcatgccaggcctggcctccgtttcagaacaacaggtgttctgcgcgtacaatcatcgacataccagaagtcagctgcacacgaacgccatctttggtgatttccgttacagtggcatccatggcattgttgcccgctttcaccttgaggttctgccccacactcagcgcagtgatatctgacactggagtatgctgcggctcttcacgcggtgcgcgctgtggcttagcggctggcttatcggcacgcggtttacgctcgccgccttctttgcgacgaggcgtcgccgggcgcggtttacgttcacgacgcggtgcgtcttctgccggctccccggcggcggcggcagcttcgcgctttttcgcctgctgctcggcacgttgtgcctgcacgcgggctttggcttcttccagctgcttacgggcgtgctctacgtgctgctcgtccagcacaccgcaagggttgccgtcgagatcgacgcgcgctgcgcccgctttgataccgtacaggtagcgccagctggaggtgtaaagacgcaatgcagagcgcagttgggttttgctgagattcatctcaccatcaacacgctcgacgagatcctgaaaaataccaattttcagggggcgcgcttcgccttcagcactgaaacagagcggaaaacgttcggccaaaaatgcgataacttctttactactgttcaacttaggttgattttccatgaaatttcctgattacaacggacgtagccaactagccgcaggcatgaacaggcgtcattataatgacgctatcagtaaatgctacgttatccgttgattatcctgcgacggctgcaaagaatttacggtaatcggtcgccgccagaacggtttcaagctgcgaaaccagctggcgcaggccctcttcgtcctcagcagtgaagcgggaaaagaccgtactgtcgatgtcgagcacgccaataatctgatcgttcactaccagcggcagaacaatttcagcattactggcggaatcgcaggcgatgtggccatcaaaggcatgcacatcatccacccgctgcacacggttttgcgccaccgcggtgccacacacgccgcgaccgacaggaatacgtacacaggcgattttgccctggaacggccctaacaccagcgtctcgccttccagcaggtaaaagcctgcccagttaaccccgtccagacgctcaaacagcagcgcgctggtattggcaagggtggctaagaaactgctttcgcctgtcatcaacgcctgaaaatcgcggttcaaatccgcatagaaatctgctttgttcattatttaatcacttggttgtcttacaaaattcctgcacagcctaataaaataagcattaaatgcgttcttgctcaagatgattccattcatgagttaatatagatgcattccaacactggctattgaaaccatggctttaaaaatctcgcaggtaacaccagacaaaaaaatcaccgtacattcggttggtgatgctttgcctcgtgcacattatcagcgttgcccgcagtgcgatacgctttttgcgttaccggtgatgaaatcgcaccagagcgcctggtgtccgcggtgtgacgccaaaattcgcgatggacgcgactggtcgctgacgcgcctggcggcgatggccgtcaccatgctgttgctgatgccctttgcctggagcgaacccttgctgcgcttctatttgctgggcacgcgcatcgacgccaacctgttgatgggcatctggcagatgaccgcccagggcgatccattgaccgcagcaatggttttgttctgtaccgtcggcgcgccgctggtgctggtcgccgccattgcctatctgtggttcggtaatattctcggcatgaacctgcgcccggtgctgctgatgatcgagcggctgaaagagtgggtgatgctggatatttatctggtcggtattggcgtcgcctccatcaaggtgcaggattacgcctacctgcaaccgggcgtcgggctgctggcgtttatcgcgctggtgatcctcagcatcctgaccattatccacctcaacgtggaacagctgtgggagcgtttttatccccagcggccggcgacccgcccgcatgataacctgcgcgtctgcctcggctgccatttcaccggtttgcccgatgcccgcggtcgctgtccgcgctgccatattccgttacgttttcgccgtcggcagagcattcagaaatgctgggcggcgctgctggcgtccatggtctttctgttacctgcgaatctgttgcccatctcggtggtttacattaatggcgcgcgccaggaagacaccattatgtcggggattatttcactggggagcagcaatatcgccgtcgccgccatcgtatttatcgccagtattctggtgcccttcaccaaggttctggtcatgctgacgctgcttgtcagcattcattttaaatgtgagcaaggattacggactcgtgtattgttattgcggctggtgacctggatcgggcgctggtcgatgctggatttgtttgtaatttcactcaccatgtctttgattaatcgcgatcaattgctcgcgtttaccatggggccagctgcgttttatttcggcgcagcggtaattttgactattcttgctgtggaatggctggacagccgcttactttgggatgcacatgagtcaggaaacccccgcttcaccgactgaagcgcgcattaaaactaaacgtcgtatttcacctttctggctgctgccggtcatcgcgctgatgatcgcaggctggcttgtctggagcagtttcgaagatcgcggtaataccattaccatcgacttcgtttctgccgatggcattgtggcgggacgcacgccggtccgttatcagggggtggaagtcggcacggtgcaggacattcgcctgagcgaaaaactcaataaaattgaggtgcgggcgagtataaaagccgacatgaaagatgcgctgcgtagcgatacccagttctggctggtgacgcccaaggcatcgctggccggtatttcaggtctggatgcgctggtgggaggtaactatatcggcatgatgccgggcaaaggcgaacctcaggatcattttaccgcgctggatacgcagccaaaataccgtcttaacaacggtgagctgatgatccatctccatgcggcggatctgggctccctgagcagcggctcgctggtctacttccgtaaaatcccggtgggccgcgtctatgactacgccatcaacaaagacaaacagggcgtcaccatcgacgtgctgattgagcgccgtttcactaacctggtgaaaaaaggcagccgcttctggaacgtctccggcgtgaaggcggacgtgggcctgagcggtgcgaaggtggagctggaaagcctcgcctcgctggtgaatggcgccatcgcttttgactcgccggacagctccaaacccgcagagccggacgatgaatttggtctgtacgaagatttagcccacagccagcgcggcgtgctgatcaaactcgatttgccgggcggccaggggctgaaagagaactctacgccgctgatgtatcaggggctggaagtgggcgagctgaccaaaattaaccttaatccaggcggcggcgtcaccggcgaaatgacggtggatccgagcgtggtcaatctgctgcgtgacaatacgcgcattgagatgcgcagcccgaaaatttccctgaacgataccagtctcagttcgctgttaaccggcaatacgctggagctggtgccgggcgaaggcgagccgcgggatcactttgtggtattgcccgccgataaaaccctgttgcaggagccgggcgtgatcaccaccaccctgaccgcgccggaaagttacggcatcgatgccggtcagccggtgatcctgcacggtgtgcaggtgggtcaggtactggagcgtaatctgacggcgaaaggcgtgaccttcgcggtggcgctggatccgcagtatcgcgatctgctgcatggcgacagcaaatttgtggtcaacagccgggtggacgtgaagctcggtctggacggcgtggagtttctcgccgccagcgccagcgagtggatcagcggcgggatccgcatcctgccgggcaataaaggcgagatgaaatccacctatccgctgtttgctaacctcgacaaggcgctggaaaacagcctcggcgatctgcccaccaccacgctgacgctctccgccgaaaccctgccggacgtacaggcgggatcggtggtgctgtatcgtaagtttgaggtgggtgaagtcatcaccgtgacgccgcgcgccaatgccttcgacatttcgctgcatattaagccggaataccgctcgctgttgaccagcaacagcgtgttctgggcggaaggcggcgcgaaagtacagctcaacggcagcggactgacggtacaggcctcgccgctgtcccgcgcgctgaaaggcgccatcagcttcgataacctgccgggcgctggcgcgtctacgcgtaaaggcgacaagcgggtactcttcccgtcagaaaccgccgcccgcgccgtcggtgggcagatcaccctgcacgcgtttgatgccggaaaactgtccgccgggatgccgatcaaatacctcggcattgatattggccaggtgcaggatctgaagctcatcaccgaacgcaacgaagtgcaggcaaaagcggtgctttatccggaatatgtgcagacctttgcccgcaccgggacacgcttctcggtgatcacgccgcagatttccgcggcgggcgtggagcatcttgataccattctgcagccttatatcaacgtcgagccgggacgcggcaacgcacgccgcgacttcgagttacaggaagcgactatcgccgactcccgttatctggacgggctgagtatcgtggtggaagtgccggaagcaggcgggctgaatatcggtacgccggtgctgttccgtggcatggaagtgggtacggtcaccggcctgacgctgggcacgctgtcagatcgcgtgatggtcggcctgcggatcagtaagcgctatgaacatctggtgcggaataactcggtattctggctggcttccggctattcactggactttggcctgaccggtggcgtggtgaaaaccggcaccttcaaccagtttattcgcggtggtattgccttcgccaccccgccgggcacgccgctggcaccgaaagcgcaggtcggtaaacacttcctgttacaggacagtgaaccgaaagagtggcgtcagtggggcaccgccctgccgcgttaaccaaccggggctccggcgtgtctgcgccggggcctttatgctacactgcgcgcctgtttttttgctggtgatacgcgagtggcacacaattctgtttatcttcccgatgcttttcttacgcaaatgcgccaggccatgccgtcgcatctctcctttgacgactttattgccgcctgccagcgcccgttgcgccgcagcattcgcgtcaacaccctgaagatcagcgtggaagattttctcacgctggtggcgccctatgactggcatctgacgccggtgccctggtgtggcgaaggtttctggatcgagcgtgaagatgaagataccgtgccgctcggcagtaccgccgagcacctgagcggcctgttttatattcaggaagccagttccatgctgccggtcgccgcgctctttgccggggatgaacagccgttacgggtaatggatgtggccgccgccccgggatccaaaaccacgcaaatcgccgcccgtatgcagaatcgcggggcgatcctcgccaatgaattttctgccagccgcgtaaaagtgctgcacgccaatatcagccgctgcggtattcataacgtcgccctcacccatttcgacggacgggtgtttggcgcagcgctgccggaagcctttgacgccattctgctggacgctccctgctccggcgaaggcgtggtgcgtaaagatcccgatgcgctgaaaaactggtcggtggcgagcaatctggaaatcgctgccacccagcgcgaacttattgacagcgcttttcacgccttgcggcccggcgggacgctggtctattccacctgcacgcttaacctggacgagaacgaagccatctgccactggctgcaggcgcaatatcctgacgccgtggaatttgaatcgctgacaagtctgtttccggatgccggcgccgcgcttaccgcagagggtttcctgcatgttttcccgcagatttacgactgcgaaggctttttcgtcgcgcgactgcgtaaaaccgcctccgtggcccctttaccggccccgacctacaaagtgggtaattttcccttcgcgccgatgaaaacccgtgaaagcgcaaacgtgatacatgcggcggccagtgtcgggctgcgctgggacgagcagttgcggctgtggcaacgggacaaagaaatctggttattcccggcggccatcgaaccaatgatcggtaaagtgcgcttctcccgtctgggcatcaaatttgccgaggtgcataacaaaggtttccgctggcagcacgaagccattatcgcgctggccggcactgcaaatccgctggcctttgagctgacccatcaggaagccgaagagtggtatcgcgggcgtgacgtttatccgcaaaccacgcccccgcaggacgacgtgattgtcactttccaggggcaaccattggggctggcgaaaaaaatcggctcgcggctgaaaaacagttatccacgtgaactggtgcgggacgggcgtttatttgcggccagagactgacggcttaaaaaaataagcacattctgactggcgtattccgcttaagtgaaccaggctaaaaaatgggtgactttactggtcgtaccactatagcaacttaacggagagcattatgacgaaaaccagcgtgcgtattggcacctttgaaatcgatgatgctgagctgcaaggcgaacagcagggtgaacgaacattgcgtattccatgcagttccgatccggatttatgtatgcaactggatgcctgggatgcggataccagcattccggcgctgcttaatggtgagcactcagtgttgtaccgcgaacattatgatgagcagtctgatacctggattatgcgtcttgcctgatccgaagaacccgtcttccggacgggttatttactccacgaatttcccccgctctgtttcatcccctacacttaccctacgttagcccgatctgaggatggaatgttcgcactggtattatttgtttgttacctggatggtgggtgtgatgacattgtgattgatgtctataacactgaacaacagtgcctggtggccatggatgagcaacgtttgcggcacggcggctgctacccggtagaagattttatcgatggcttctggcgtccggctcaggagtacagtgatttctgatgacctttgtcatatattgcgctgcgggtgctccgcagacgcaataataccctcgcccgcgtccctgtttattgcccttccggtctttttatttaaatcagattaacctcaatcaatcctaaacaaagcggaaataaaactcccgcagccattaacatatttttgtcaggcctccagaatagtcggaaattagagaggtcattattgtgacaaacactaccctgcaaattgatgcgccctcatcgccgcatccacaccttatttccgacctgatccatggccgtctgacgcccggaccgatctggcaaaagcgcgattatcgcgttaaatttctcctgcgctcgctgctcttctggccgtcgaccgttaaaatgctgaacagcctgtccagccgtccgggtttcgaccgcctgctcagcgcccaaatcacgctgcccagtaaatcgcaccgccagtatttgatgcgggggctgcgtgccggacagcgcgccgacgctatcatcagccactatgactttatcgacagtcttacctcagcaccgcttgcggaggcgctgaccgctgccgcgccggtacctctactggaatttaccggcaaagacgatgcgccttttaccgtctacgcctcctgcgccagcaaagccgagcgtgaaggtgaaagcaccctgtggctgtatggcgcagataatacgctgctggcaagcgccactttcagcgtggtgacggaaaagggagcgcgcgcgctgatggtgggaggattacagggaccgcgccgctcggtttctcacgacgtcattaaacagtccacccgcgcctgctacggtatctttccgaaacgtatgctgatggaaatattctggcaactggcggcgcttaccggcattacggcggtctatggcgtcagcgataaaggccatgtgttccgtgccctgcgctatcgtttcagtaagggccggcattttcatgccagctacgatgaattctgggcctccgtggatggcacgcctgacaatgcctggcgctggaagttgccgttacagcttgagcgtaaatcccttgaaagcattgccagcaagaaacgcgctgagtatcgccgccgctttgcgctgatggatgatgttcaggcccgtctgcgggcgctgtttgattaatcatcacccgccgggcagcgtctggcggggtggcgggctctctgttattgtcttaaggccaggaacacttaagacaaggtagcggtatgcaaaagtttgatgaattgtggaatgccatagccacgcgggtgcgtgaaaacaacgacattccctttgcggaaatggaaaacgaagagagtcccctggggaatgccacccgacagcgtatcgcgcaaatatttattctggaagtgctgctcgccaggcatcgtgataaatacgccagcatgtttgttccgctatccggcgaagaagcgctttatcacctgattttcaagcgcaccggctggaagcctttcgagattaagcagctttccttcaatgatgccatgtttgtgatggctgaattattccgtgaagaaaacctgcccgtcgaggcgcgtgaaatgctgctcgcccagggtgtgcgtgacaccgctttcccggtttttgatttctcagaaaaagactggtcgccgcgcgaaaacgccctctttctgcaacgctgatattccccttcccgcggtgccgcggggagtggtagtttttttaaacctcgattttttgcattattttttcgcgatcaacataaatacagcgattacgaccggtttccttgccgtggtataacgccttgtcggttctttccagcacttcgcgtaatacttcatcttcatcgatacgggttaacccggcggtaaaggtgatcttaatttcatgcccggccacaagcattaatgttctggcaatcaggttgcggatccgttcggcagcaatgcaggcttctttttttgtggcggcatgcaacacaataataaactcctcaccgccatagcgatatacggtctcacactttctgacattatcttccagcgtcagcgccagacagcgtaataccccatctcccaccagatgcccgtagttatcatttatttttttgaagtgatcgatgtccaccagtaataaatacaatccctgttgactgtattgatcgaccatcccgctaaaagaatcatccagcgtgcgtcgtaaaggtaaaccggtgagcgtgtcgtaactgctgcgcaactgtaaaagatgggttttatagtcggtcaccgaggcattgaaggcaatgagcgcattttcaaagctatcaaaacgcgcgtcgctcacttcacccttgcgcaccgcctccaccagcgcccggcaggtgatatgaatgtcgtggtgcctgcggtggatgtcctgaagaaaactgccgtcattgcgctcttctgtcagccgctcgtcgatccactgaccaaattcgcaaattttatgggcgtcgtcataagtcagctcaggcatcagcgccgatttattcgcgataaaatggagtacttttaccagccatttaaaatgggcttcggatgaattattgagcccaagaatagttgaatcaatataactgtgttttttgttcatacatataaccttcgtgaatattttagcgcaaaataaatatttaaatagcctaatacgatactacactttaattagttttatttaaccttcacgtgcccgctaatatcagcatgagggcgaacccacaaagtgcggacaaaaagcgtcgaaaaggggttggatacactccaaaaaacgtttaccttgtaacctgagtcaggcaaaaggcgcgggatcggcacctgctggctaagttgttgatggaaaacagaataaaaaaagaccgaatacgattcctgtattcggtccagggaaatggctcttgggagagagccgtgcgctaaaagttggcattaatgcaggcaaactacgcctggcactttaagaatagatgacagcgccagcttttccagtctgccgcaggagtggtctggaaaatccggttaaggtcgcagccgaaaagcaaaaaaccgcagcacttcagtatgagggctgcggtttttttattggaaatcagaaagatatttttggtatttagcagagcttttcagcacgctcgataaacggagcgaggctcattttttcaccgcttttgtgcggattatcgacctggatcacactgatggacgtaccctgcgcctgaccgctgtcgacctgcttttgtgccgcctcgttcagcggatactgcaccagcgtcgacggattaatcgcaaagagcgcatgtcccggacggcaggttaacatcacctcctcgcggttaaaggcccagttatcttttccgacttcaaaacggcttaccgtgatcactttcggggctgccagcgcggcggcggaacaggtaagtaacagcagggagagaatacttttcttcattgtcttcgccagttattcagaaaggttcaagcgttgcgaacaggctaaccagggccagcaccagtgtacccaggatcacttcggcctgcgtcatgcgaataaagtgtgtttgcgcctgacgaccatgggtgcgaaagcgcggcaccagaacataacgattcacgaccgcaattaccagcatcagcagcaccagcgcacatttgcacaaaagcaggcgaccataatcgctctgccagggtagcgcaacgccctggatcaacagcgcattaataatacccgtcaggaataccagcgccaccgccagatgcgtggcgcgggaaaaacgcatcagcgtagtgattgccgcttcgcgcctgtgacctccggcttgtcgggtgcaaaaaatcaccggcaggagaccgccaaaccatgcggttgcgcagatcagatgcagggcgtgattcaggcgctgcaacaggccgggcagcccgtcatgcatcgccgcatgaccgaccatggcctgtaacatgagctgcgcgaggagcaacgcaaacaggcgcccctgacagcgtggctgcaccatcaccataaccagcgtgatgagcgccagcagcatctgccacagccagacgctgccaaattgcgtctgcgccaccgccagccagatatcagggtgaagcgtatctgcaaagccattgcccatcattccgccctgtacggcaaacatcagcagcgcgctgccagcgcacagggtcaggcagaggcgctgtatacgtttaaagcggcggatgatcaccggttgcatatctgccggcgccagcacggcgctgaaccaggcgctacctgtcgccagtatcagggtggcgaaatggataaaccgcaacgtgatatagagaaaggccagcatcggttatctgacgctgaagtgataattacctgtggttttgtgtccatcgaccgacacaacgtgccagtctacggtatactctcccggcgtcagcgcctgctcaatgggcacaatcaactgcgttttgtcgttctcattacgtttcaccgggccggttttcacgtcctgctgtttgctgccggtaattttcacgccgctgaattttggctcaatcccttccgagaaattgagcgtcagcgcctggggtgctgcatcgaccttcgcatctgctgccggatactgatgtttcagatgggcatgcgcaaaaacagcaggcgttgcgagcattccgcctgcaagcagcaaggcagaacagagacgggataccatgaaagtcatttattccattcctttttgttatatctcagtaatgagaataaccccgatgaatgtatgagtcgagtctgccggcagtcgggcttgcctttccggggcaggcttagtaagttttgcgccgaacactcaggagaagtttatgaacaaaaatctcgctacccttcctcaggatgagatggacaaagtgaatgtcgatctggcggcggctggtgtagcctttaaggagcgctataacatgccggtgatcgcggaagccgtagagcgtgagcagcccgcgcatctgcgtgactggttcagggagcgcctgattgcccatcgtctggcctcggtgtcgctctcgcgcctgccgtatgagccgaaaatgaaataaatttgcaccacctgctaagggaaacccacatgttacgcgtgatagacaccgaaacctgcgatttgcagggcggcatcgtagaaattgcttccgtcgatattattgacggccagatagtgaatccgatgagccatctggtgcgcccggatcgccctatcagtccgcaggcaatggctatccaccgtatcacggaagcgatggtggcggatcagccatggatcgaagaggttattccccattatatgggcagtgaatggtatgtcgcccacaacgccagctttgaccggcgcgtgctgccggaaatgcccggcgagtggatctgcaccatgaagctggcgcgtcggctgtggcctgggatcaaatacagcaatatggcgctgtataaatcccgtaaactgaatgtccagaccccggccgggctgcatcatcaccgggcgctgtatgactgctacattaccgccgcgctgctgattgatattatgaatacttcaggctggacgccggaccagatggcgaccattaccggccgccctgccctgatgaccacttttaccttcggcaaatatcgcggtaaagcggtgtcggaagtggccgaacgcgatccgggctacctgcgctggctgtttaataacctggatcgtatgagtccggagctgcgcctgacccttaagcactaccttaacgattagtagcctgacgtcccggtaacgtgccctgcgcaaggccaatgagaaacgcatattccagcgccaccccttcataggatttgaagcggcccgatttcccgccgtgcccggaatccatatcggtgcacagtaacagcaggttgtcgtcggttttcatttcacgcagcctggcgacccatttcgccggctcccagtactgcacctgtgaatcgtgcagcccggtggtcaccagcagatgcggataggcctgccgctggatattgtcgtaggggctgtagctcttcatataagcgtaatattccggatcctgcgggttgccccactcctcaaactcaccggtggtgagcggaatggattcgtccagcatggtggtcaccacatccacaaagggtacctgggctatcacaccgtggaacagatccggccgctggttaatcgccacccccattaacatgccgcccgcgctgccgcccatgccatagcaatagtgcggcgagccgtagccctgcgcgataagcgcgtcgcagacgtcgatataatcgttgaaggtgtttttcttgcgcaggaatttgccgtcctcataccaggactgtcccagttcgccgccgccgcgcacatgggcgatggcgtaaacaaagccgcgatccagcaagctgatacggctgctgctgaaatcggcatccatactggatccgtaggagccgtaaccataaatcaggatcgggttttcccctttacggaaatgtttgcggtggtataccagcgataccggcacttccacgccatcccgtgctttgatccacagatgttcactgcggtagtcgctggcctcgaaaccctgcacttccgtctgcttaagcacgcggcgctcgccggtatccatatccagttcaaacagcgtatcgggcgtggtcagcgacgaatagccatagcgcaggcgcgacgtttccggctcaggattatacgcaagccaggtgacataggcgggatcgtcaaaggcaatgccggtgacttcacgggttttgcggttgatctgtcgcagactggtcaatccgcgctggcgctcttccaccaccagccagtcggtaaagagcgtaaagccttccagcataatggcgtcccgcggcgggatcagcacttcccatttcgcctcgctgcgcactttggtgcggtaaaggccaaagtttttgccttcgcggttagagcgcaggtaaaaggtatgctgataatgatcaagattgtactcatgatctttacgcctgggcaaaaagcgcagcggctgggcgtccggcagctctgcatccagcagtaacgactcgctggtggtggcgctggaaagcgaaatcaccacgtagtgctgtgaagtggttttgtgcaggctgacgtaaaaggtctcgtcctgctcttcataaaccagttcatcctgacagacaggcgagccgacggtatgacgccagacctgatacggcagcaacgtcgtcgcgtgtttgcgcacgtagtacagcgtttcagagtcattaacccacacaaagtccggcgtgacgttggccagcatctccggataccagttgccggtttgcagattacgaaagcgaataccgtactggcgacgcgacagataatcttccgccagcgccataatattattgtccggcgagatcgccagtccgccaagggtgtagaactcgctgtgcgcggcgcgtttgttggcatcaagcagcacctgccactcatcccattcggaactgagcaccgactggcgctgatagatagcgtattcacagcccggctcatagatatgccggtaacggtagccgttgcgggtataaggcgcagatacttcgcgctgggggatacgcccaacgatttcagccagcagacgctcttccagcgcctgctgcgatgccatgacctcgcggccatagtcattttcctgatgcaggtaatccagcacttccggctgcgagcgcgagtcgtcccgcagccagtagtagtcgtcgatgcgtgtgtcgccatgcgtggtgatggcgtgaggaatttttctggcttttggtggcatagcgtctgtcttttgcagtttacaccctataagggtggcaaaagacacgcatgttgcaagcgcagcgtgccaccagggcgcagatgattagccgggaagcgccagcttttgctgtttgagatcctgttcaataccctcgcgtacatcctgcgggatcttcagggcatcccccagtgcattcagatagctgcgctccataaagtggtcgacatcaatggccgcacagctcaggaaataaatttccagcgcttcttcttcgtttttgatgccgcgcgccagacgttcaggatccagcggctgttcgatggcctgggtgaccagcgctctgccctgctcttcgacgcccgcttcgcgcatctgggcgtcgatggcggcacgttctttgtcgtcgatatgtccgtcgcttttagcagcgaagaccagcgcaaggatcagacgttcagtacgcacgtccagcggtgagctttgcacgccatactgcggctcatcctgatgggcggcgcgcaccttgtctttgtatttgttccacagcacgctaccggcgacggcaccgccgcccaccagcagcgcgctggtaccgtatttggttaacagcttgcgggacgatttgctggcaaccagcagccccgccagaccgcccagcgcgccaggcagcattttgctgaaaccctgatcgcccgacgacgttgccgatgcgcctttttgcttcagcagcgactgtaattgatccatccagttagccatgattcccctcaaatagctgatgacagttgccacagcgtaagcgaggggatgtcaggaaacgtctgtatcagcaaaagatgcgcaaattcacgggcgttactgcgcctgataatccgcccgcccggctttgcagtcgaccttcacccgatagtggatatcggtatttttaccgcgcacggtcaggggcacgttccagttatcgtccttaccggaaatctctttgacgttaatccacgccaccggatccgcctgaccgagtatttcctgatcgtccgcccagcgtgctatgcgattttgcagataatcacgcttcaccgcggcggcgatgccgtcttctttcagcccttcgcaacccggaaacttcaccgacttttcattggctgcctgcgccgccatgctgcccgccagcaacaccagaccaaatactacccctgctgttttcatgcttttctcctgtgagctaacccactcaaagcatggtacaaattgccggcagcgcaaggacggatcaggcggctttggtgcgcttcggcgtcggaatatcggtcacgttgacgtcagacggcgcgtcgtcggtttgtaacttaccggatttgatgatggtattgagcgtatctttctgctccgccatccacatcgccatttgctcgcgctgtgcctcatccagggctaccggcccctgcgccagccagctctccagcacttccgccagatcgagcattttgtcataagcatcggcttcctttttgctggcaaaagacattttttcctcaccttcacgaatgactacgtatttaacttcaaccgccatgatgcagcctcacattactggttatttatacagtatatgataactgaacgcccggcttaaggcaagccgggacggaaggaaaggtcagaacaggatcgtcaggccagggtggcgttatcaatcacaaagcggtaatgcacatcacctttaagcatgcgctcgtaggcctcgttgatctcttcggcgcggatcatttccacatcggcgacaatcccgtgttccgcacagaaatcgagcatctcctgggtttccggaatgccgccaatcatcgatccggcaatggcccggcgcttcgtgatgaggttgaacacttccggcggagcgtgcggcgtggcgggcgcgcccaccagcgtcatggtgccgtcgcgtttgagcagcgtgataaatgcgtcgaggttgtgcggtgccgccacggtattaaggataaagtcgaagcttttaagatgcgcttccatttcgctggcgttacgtgacaccactacttcatcggcgcccagcgattttgccgcctcgcgcttggattcggaggtggtaaaggccaccacatgcgcgcccatcgcgtgggccagttttatgcccatatgtcccaggccgccgatgcccacgacgccaacctttttaccggggcccgcctgccagtgacgcaacggcgaatacgtggtgatcccggcgcacagcagcggcgccaccgcagccagttgatcttccggatgggtgatgcgcaggacgtagcgctcatgcaccacaatctgctgagagtaaccgcccagcgtgtggcccggcgcgtcctgggttggtccgttgtaggtgccgaccatgccgtcgcagtagttctccagcccctcctcgcaatcttcgcactgcttacagctgtcgacaatacagccgacgcccaccagatcccccgctttaaaagcagagacatgctcgcccacggcggtcacacgcccgacaatttcatgccccggcacgcagggatattgcgtccctgcccattcggagcgcacctggtgaatatcggagtggcagacgccgcaaaaagcgatatcgattttaacgtcatgggcgccaggctgacggcgggtaatttccattggttcaagaggctgcgtgccggtatgggcaccataagctttgacagtcatggtagaactccaggttataaagggctcaggcagagggttctgcacgtgaggtcaggaaaatcggtcaaataaactctcctgattgtagatgcgagtgtgtcagatagcaggttaattgcctgtgtactgctcgtcgctgaccttttccatccactccacaaccttgccgtcttccgcttcggcaatcgcgatgtgggacatactgttttccggcgcggccccatgccagtgcttcacccctgccgggatccagacaatatcgccgctacgtatctcacgctgcggaccgccccactcctgcacccgtccggcaccggcgataacaatcagcgtctgtccgagaggatgagtatgccatgctgtgcgggctgaaggttcaaaggtcactgtggcaccgcctgatttcgcaggctcagtgccctgaaacggcgcatcaatacgaacgttgccggtgaaatactcggccgggccttttacggagggactggtagtcggggttaagatcgtgatcatggtgttctccttaaaataacggggagtgaaaagtgtaagttgcctgcgattgattgataagatatgcaaatcagaatgctcatgtgcatggtatgcaacaatgtcgacagaaaatctcaacgatctgcgcgcgtttgcgcgggtggctcaggagaaaagctttacccgggcggcggcgcagctgggtatgtcgcgctcaggactgagccacgcgataaccgcgctggaagaacggctgggggtccggttacttatgcgcaccacacgtagcgtgtcgctgacggaagcaggccagcggcttatcaatacgcttgggccaatgcttgatgatcttgaacaggaacttaaagccctgcgctcattcagcatcagtcccgctggtacggttcgcatcaccgcccacgatcacgccattgcatctgctatctggccacgtttaacgccgttgctggtgaagaatcctgagattaccctggagctaagcgtggattatgggctgacggacattgttgcccagcagtttgacgccggggtccgggtgggcaatatcgtggataaagacatgattgcggttcgtatcggaccggatttccggatggcggtggtggcggcccccgcattccttcagggcaaaacgttgccgctcactcccggggaattaacatcctacgcgtgcatcaatcttcgcctgccgacacacggggggctgtatgcctgggactttgaaaaagcaggcaaatccctgtcagtacgcgtcacaggacaggcagtcttcaataatacctacctgatgttgcagggtgccattgacgggctgggtttcgcctatgtcccccgtgatcttgcccttccgcatatcgaggagcaacggctgatcccggtactggaagactggtgtcctcttttaccgggttatcatctctactacaccagccgccgtcaggtggcacccgccctgcagtgcgttatcaatgcgctacgctaccagtcttaacagacgcaaacgttttcgtttatactgctgccaacttttttcaagggcaggttgttatgactttattaggtactgcgctgcgtcccgcagccacacgcgtgatgttattaggctccggtgaactgggtaaagaggtggcaatcgagtgccagcggctgggtgtggaagtgatcgccgttgatcgctatgccgacgcgcctgccatgcacgtcgctcatcgcgcccacgtgatcaatatgctggatggcgaggcgttgaaagcgctggtcgcgcaggaacaaccgcactttatcgtgccggaaatcgaagccatcgccacggatatgctggtggcgctggaagcccaggggcagcgcgtggtgccctgcgcccgcgccgcgcagttaaccatggatcgcgaaggcattcgtcggctggcggccgaggaattaaagctgccgacctcccgctaccgctttgccgataacgaagcggcgttcagggaggcggtgaatgagatcggtctgccgtgcatcattaaaccggtgatgagttcatccggcaaaggccagagcctgatccgccatgccgatcagctggccgatgcctggcgttatgcgcagctgggcggccgtgccggcgcgggccgggtgattgtcgaaggggtggtgaattttgattttgaaattaccctgctgaccatcagcgccgttgacggcgtacatttttgcgcgccgattggccatcgtcaggaagacggcgattatcgcgaatcctggcagccgcagcagatgagcgcactggcgcagcagcgtgccgaagcggtggcccgcgaggtggtgctggcgctgggtggccacgggctgtttggcgttgagctgtttgtgtgtggcgatgaggtgattttcagtgaggtgtcgccgcgtccgcacgataccggtatggtgacgctgatttcgcaggatctttccgagttcgccctgcatgtgcgcgcgtttcttggtttaccggtcggcggtattcgtcagtatggcccgtcagcgtccgctgttattctccccacacttaccagccagaatgtgacctttgataacgtcgatgccgccactggcgctgggctacaggtgcgtttatttggcaaaccggaaattgacggttcgcgtcgtctgggtgtggtattagcgacggcagaaaatgttgatgatgcggtggcgcgtgccaggacagcagcagccagtgtgatggtaaaaggataaagcgcccacatgcccggcagcttgcgccgccgggcatgacgtcagattactgcttcgcgccttcaacggcttcgcgggccagtctggtgatacggtcgtaatcaccggcttccagcgcatcggccggcaccagccaggatccaccgatgcagagcacgcttttcagcgccaggtagtcacggtagttagctggtgagataccgccggtcgggcagaaacgcacctgcgagaacggacctgcaatggcctgcagcgctttggtgccgccgttggcttccgccgggaagaatttgaactctttcagtccatagtccatacccagcatcagttcggaaacggtgctgatgccagggatcagcggaatggtgccttcggttgccgctttcagcagcggctccgtcagacccgggctgatggcaaactgggcgcccgcttcagtgacttccgccagctgtgccggattcagtacggtgcctgcgccgatgatagcgtccggcacttcttttgcgatggcgcggatagcatccatggcgcactcggtgcgcagggtgacttccagcacgcgtacgccgccagccaccagggctttcgccataggtacagcgtgttccagtttgttaatcacgatcaccggcacaaccgggccagttttcaggattgcttctgcactcgttttccagtttttcatcagagttttttctctcgccagatctacaatttttaagtcttagaaagtgatacaggtcgcgccctgctccgcaccggagagattctcgcgcaatgcgctgaacatctcgcgccctgttcccacgcgcgacgcgctgaggtcaggaatgtgtggctgacgtgcggccagttcggtttcatccaccagcagggttaattcccctgtctgtccattcacgcggatgatgtcgccatcacgtacttttgccagcaatccgccatcgtaggcttccggggtgacatgaattgctgacggcactttacctgatgcaccagagagccgtccatcagtaactaatgcaattttgaaacggcggtccaataatacaccaagtggcggcatcagtttatgtaattctggcatcccgttcgcttttggcccctgatgacggacaacaaccacgcagtcacgatccagaagacccgcgtcaaaggcaggtaagacgtcgtgctggctttcaaataccacggccggggcttcgatgatctggttttccaccggcacggcggacgtcttcatcaccgcgcgtccaaggttgccgctcagcactttggtgccgccatggtgagagaaaggtttgtcgatggtggcgatcacattctcatccagtgagctgtcagccccgtcgcgccagtccagctcgccattgttcagccatggctccagggtgtaacgggaaagcccgaaaccggcgacggtgttcacgtcttcatgcagcagaccgcctttcagcaattcacgcatcagcagcggcacgccgcccgccgcctggaagtggttaatatccgccgggccattcgggtagagacgggtcatcagcggcacgatgtcagagagatcggagaagtcatcccagttgatgataatgccggccgcccgcgccatcgccaccagatgcatggtgtggttggtggagccgccggttgccagtaacgcaataatgccgttgacgacgactttctcgtcgagcattttgccgagcggcatccattcgttgccgttgccggtcagacgcgtcacctgacgcgccgcagcggcggtcagggcttcacgcagcggcgcgtccgggtgcacgaacgaggagccgggcagttgcatacccataaattccaccaccatctgattggtgttggcagtgccgtaaaaggtacaggtacctggcgcatggtaggacgcggcttcggactccagcagcgccatgcgatccactttgccttccgcatacagctggcggatgcgaaccttttctttatttggcaggccgctggccatcgggcctgagggcacaaagattgccggaagatggccgaacgacagcgccgccatgacaaggccggggacgatcttatcgcacacgcccaggtagagcgcgccatcaaacatattatgcgacagccccaccgccgccgacatggcgatcacttcgcggctcagcagcgacagttccatgccgtcctgcccctgggtgacaccgtcacacatggccgggacaccgcccgccacctggccgacggcgtttgcctcatgcagcgctttacgaataatgtccggatatttttcataaggctgatgggcggacagcatgtcgttataggaggtaataatcgcgatgttattgcgcagcatgcttttcagcgacgctttgtcatccggctggcaggcggcaaaaccgtgcgccaggttgccacaggccagtgatgaacggtgcaccgtttcgcttttcgccttctcaatacgggcaaggtagtcagcgcgcgtctcgcgggaacgttcgataattcgttctgttacccgtaacatttttgcattcatagaagctcctgaaattatctgtcatgggcgggggtaaacattcgacatgttccggcattaaacctgcggtacgccgtcgcccggtggcaaaatcgcttcagccagtgtaataaaaaaagccccgtgggtgaatccacacggggcttaaaagctgaaatattactcaggagtctgagtcagatcatgttaccggtaaaataagagccttccggttactcaaactcattccatgaacgaccatcacgggtgatcatcgcaactgaagccaccggcccccaggtgcctgcctgatacggcttaggcgcatcgttgtccatcgcccaggcttcagtgatggagtccacccacttccaggcttcttccacttcatcacgacgcacgaacagcgcctggatgccacgcatggtttccagcagcagacgttcgtaggcatcggcaagatgcgtctggttaaaggtttcggagtagctcagatcaagtttggtggtttgcagattatgcttgtgatccagacccggcactttgttgaggatctgaatatccacaccttcgtccggttgcagacgaatggtcagcttgttctgcggcagatcctgccaggagtctttaaacaggttcagttgtggcgtggtgaaatagaccaccacttcagagcacttcgccggcaaacgcttaccggtgcgcaggtagaacggcacgcccgcccagcgccagtcgtcgatatccacgcggatcgccacgaaggtttcggtgttactggatttgttcgcgccctcttcttccagatagcccggcacttttttgccctgagcgaaaccggcggtgtactggccgcgcacggttttttcacgcacgttggagcgatcgatacggcgcagggatttcagcactttcacttttgcgtcgcggatgctgtccgcagacagatcagacggcggagacatggcgatcatgcagagaatttgcagcaggtggttctggatcatgtcgcgcatctgaccggcctgatcgaagtaaccccagcggccttcgatacccacttcctcggccacggtaatttccacgtgatcgatggtgcggttatcccagttgttcacaaacagcgagttggcaaaacgcagcgccagcaggttaagcaccgtctctttaccaaggtagtggtcgatacggtatacctggcactcttcaaaatactcgcccacctggtcattgatttcgcgggaggtttccagcgacgtacccagcggtttttccattaccacgcgcgccggtttggcgttcagcttcgcttcaccaaggcctttgcaaatcgcgccgaaggtgcttggcggcatagcgaaatagttgatggtaacgcggttttcctgatccagcatctcgccgagacgcttaaaggatttagtgtcattgacatccagattgcagaaatcgaggcgtccgctcagcgtgtcccacaaactttcatcgatcttctctttcatgaaagtttccagcgcttcgcgcaccactttggtgtacgccgctttgtcccagtcggcacgcccgacgcccaggatccgcgtttcaggatggatctgacccgctttttccagttgatacagggaaggcagcaatttccggcgtgcgaggtcgcctttcgcgccgaaaatgaccaggtcacatgcctgggctgtttgcgttaccgccatgtcattctcctcagttagctatcctggtgcttctgccaggccttagttgtaattttattacagtgcactgtactgcttttacgtgattaccgaaaccgttaacgttttgccgcttgtgcgctaaagacatcagggcgtacgtacaggccaattgccctgaaatatcagggtttttgcacggggtcggtgtcactaaaatccgaccctgatcatgtaatgaaaaaaaacaacaacttttcgggttgttatttacccataatcacgtcacaagagtaatatcgagttacacgcaccgcggtttcatccatttctggaatcgattttacccaagagcgccctgttaaacatgaatatgctggaaaagatccagtctcaactggaacaccttagcaaatccgaacgcaaagtggcggaagtgatcctcgcctcccccgatcaggctatccattccagtatcgctgcccttgcccagcaggcctccgtcagcgaacctaccgttaaccggttctgccgtagcctggatacccgcggctttcccgattttaagctacatctggcacaaagtctggcaaatggtacaccttatgtgaaccgtaatgtggacgaagacgacagcgtggaagcctataccggtaagattttcgaatcggcgatggcgacgctggatcatgtgcggcagtcccttgatatggcggcggttaaccgggcggtggatttgctcacccaggcgaaaaaaatcgccttcttcggccttggctcgtccgctgccgtagcccatgacgcgatgaataagttttttcgcttcaatgtgccggtggtgtataccgacgatatcgttttgcaacgcatgagctgtatgaattgtagtgaagacgatgtggtggtgctcatctcccacaccgggcgcaccaaaagtctggtggagctggcacagttagcgcgcgaaaacgacgccatggtcattgccattacttctgccggtacgccgctggcgcgggaagccacgctctccattacgcttgacgtgccggaagataccgatatttacatgccgatggtgtcgcggctggcgcagctgacggtcattgatgtgctggcaacgggctttaccctgcgtcgtggggcaaaattcagagataacttgaagcgagtcaaggaagcgctgaaagaatcgcgctttgataaggaactcctcgtcagaggggaaaacattaaaagttgataacaaagttgtaacttattacgccattcggttaagttcatagcggcccacagaggcgcacgatgtcaccgaatttttaattcacgcaacaccggttgtttcagtcaacggagtaatacatgtccagaaggcttcgcagaaccaaaatcgttaccaccctgggtccggccaccgatcgcgataataaccttgagaaaattatcgccgcgggcgccaacgtggtgcgcatgaacttctcacacggcacggcagaagatcataaattgcgtgccgataaagtgcgcgagattgcggcaaaactgggacgtcatgttgctattcttggcgatttgcagggtccaaaaatccgtgtttccaccttcaaagaaggcaaagttttcctcaacatcggcgataagtttctgcttgacgccaacctcggcaaaggcgaaggcgataaagagcgcgtcggtatcgactataaaggcttacccgctgatgtggtgccgggcgacattctgctgctcgacgacggtcgcgtgcagttaaaagtgctcgaagttcagggcatgaaagtgttcaccgaagtgaccgtgggcggaccgctgtcgaacaataaaggcatcaataaactgggcggcggcttgtctgcggaagccctgaccgacaaagataaagccgacatcctgaccgccgcgcaaatcggcgtcgactacctggccgtctccttcccgcgctgcggcgaagatctgaactatgcccgtcgcctcgcccgtgacgcgggctgcgacgccaaaatcgtcgccaaagtggaacgtgccgaagcggtatgcagccaggacgcgatggatgatgtgatcctggcctccgacgtggtgatggttgcccgtggcgatctgggcgttgaaatcggcgacccggaactggtaggcattcagaaagcgttgatccgtcgcgcccgtcagctgaaccgcgcggtgatcaccgccacccagatgatggaatcgatgatcaccaacccgatgccgacccgtgcggaagtgatggacgtggcgaacgccgttctggatggtacggatgcggtgatgctgtcagcggaaacggcggccggtcagtatccggcggaaaccgtggcggcgatggcccgcgtgtgcctgggggcggagaagatcccaagcattaacgtttccaagcatcgcctggatattcagtttgataacgttgaagaagcgattgccatgtcggcgatgtacgccgcgaaccacctgaaaggcgtgacggctatcatttccatgaccgaatcgggccgtacggcgttaatgacgtcacgtatatcttccgggctgccgatcttcgctatgtcccgtcatgagcgtacgctgaacctgaccgccctgtaccgtggcgtgacgccggtgtacttcgacagcagcgccgacggcgtggtggcggcgaatgaagccgtgaccctgctgcgcgataaaggctatctggtgtccggcgatctggtgattgtgacgcagggcgatgtgatgggtactgtgggtactaccaataccacccgtattctgaccgtcgaataagtagttgtgcccggcggcgctttgcttgccgggcctacccgcttcgtaggcccgtgcaagcgcagcgccgccgggcatttaaaacggctacttcttcggaaaaagctctttacgcttgtacggctctttttcccctggcctgcgcgttttcaacagcttaaggatccaggtgtactgctccgggtgcggacgtacaaaaacttccacctcttcgttcatacgccgggcaatggtcgtatcgtctgcggtcatcaaatcgtccatcggcggacgcacctgaatggtcagccggtgcgtggcgctgtcatacaccgggaacaatggtacaacgcgcgcacggcatactttcatcaaccgcccaatggcgggcagcgtcgctttataggtggcgaagaaatcgacgaattcgctgtgctctgcgccatgatcctgatcgggcagatagtagccccagtaaccctgacgtactgactggataaagggcttgatgccatcgttacgtgcatgcagccgtccgccaaagcgacgacgcacggtgttccagacgtaatcaaagaccttattcccctgattatggaacatagcggccataggctgcccggttgccgccatcagcatcgccggaatgtccacgccccagccatgcggcacaaggaaaatcactttttcgttgttgcggtgcatctcatcaatgatttcgcggccctgccagtcaatacgcggcaggattttttccggcccgcgcatggcaagctcggccatcagcaccatcgattgcggcgcggtggcgaacatctcatcaataatgtcttcgcgctgcgcgtcgctcagttcaggaaagcagtacagaagattgatctgcgcgcggcggcgggcgcttttgcccatccgtccacccaaacgccccagttttgccagcaagggatcgcgcactgacggcgggatcatcgccacaccggcgaaagccattaccccaagccaggcgccccagtagcgcggatgtaaaaattccctttcgaattcagggaggtattcactgttattttttttcgtttccatgcatcttccagggtctgcggactcgggtaagaaaaagataatgcgtaagtgtagcgaggctgacttatccgcacaaaagaaaaagccgggtatgcactatcacccggcttatttcgtacgttacttaatcgaaccgaagctgcggtataacctctttgacctgcgcgaggtaatcgcgacgatccgaaccagtcagcccttcggtgcgcggcagtttcgccgtcagtgggtttaccgcctgctggttgatccacacttcataatgcagatgcgggccagtggagcggccagtgttgccggagagcgcaatgcggtcgccgcgtttcactttctgcccctctttgaccagcagtttgcgtaaatgcatatagcgggtggtataggtgcgaccgtgacggatggccacgtaatagcctgccgccccgctgcgtttcgccactaccacttcgccgtcgcccacggagagtaccggcgtgccctgcggcatggcgaagtcgacgcctttatgtggcgctacgcgcccggtaaccgggtttaagcgacgcggattgaagtttgaagagacgcggaactgtctcgaggtcgggaaacgcaggaagcccttcgccagcccggtaccgttacggtcatagaatttaccgtcttcagcacgaatggcgtaataatctttcccttctgaacgcaaacgcacgccgagcaactggctctgttcacgcttgccgtccagcatttcgcgggacatgaataccgagaattcatcgcctttcttcagcttacggaaatccatctgccactgcatggctttgatcaccgcgctgatttccgcgctggtcaggccggcatttttggcgctgctgacgaagctgccgcccacggtgccgttaagcgttgagttaacccagtcgcccttctgaatttcggcgctcattttaaagccgttatcagcgcgatcgtaagtacgggtttcgcggcgcgacatttcccaggtcatgcgctgcagttcaccggcatcatttagcgtccaggagatctgctgaccaattttcaggttacgcagatccttatccgccgaggctaactggctgatatcgcccatatcgatgccgtactgattgaggatgctgctcagggtgtcgccggtggaaacgacatattcatgtacgcccgtttcgttcgccgttttatcgtccagctcatcctgcggaatggcttccacttcatccggcatggtctgatcgataggttcactggcttcagggagcaaagaacgtatttcgcttttttccagttcgatggtttttacaatgggtgcggactgggattgggggtgatagacatagggtcgccagacggcgaccgctaatgtgagaacagtaagagaccccagcataacgcgatgggggcgtggcagattattaaacgccaggctgaccgcgcgggctatctgttgcacgtattcacttcctcgttattctcctttcaggcagcccgagtactggttggcgagttgagtcaggaactggggatagctcgctttactcaatttgatactggttccaagcggatccagggtccccatgcgaactgaggtacctctcgcaacagcttcaataacggctggcctgaactgtggctcagcaaaaacgcaggttgctttttgctcaaccaactgtgttctgatttcatgtaaacgctgagcaccaggctgaatttcagggttaacggtgaaatgaccaagagacgtcagaccataatgtttttcaaagtagccgtaggcgtcatgaaaaacgaagtaccctttacctttcagcggtgccagctctttacccacctgctcatcggtttgggctaattgtgcctcaaaatccttcaggttggcgtcaagtttggctcgactttgcggcataacttccactaatttttgatggattgcaaccgctgccagccgcgctacgtctggcgaaagccaaatatgcatgttgtattcgccatgatggtgatggtggtcaccattttcatcatgatcgtggccgccttcatgttcgtgctcgtcttcctcagcgcctttcatcagcaaaggtttcacgccgggcagctcggccatcaccacttgtttcgcctgcgggattttttgcgtggtcttttgcatgaaggcttccatgtccggccccacccagacaactaagtccgcgctctgtaagcgttttacatcggacgggcgcagcgcataatcatgctcagacgcgccatccggcagtaagacttctgtgttagtgacgccatcagcaatagccgacgcaatgaatccgattggcttaagtgaggttactacggctgcatttgcgcctgtactcaggccagcccataaagcagcggaaaccgctgcgcaaagaagcgtatttttatgtaacataatgcgacttatcatcgtaatgaattggtggaatgtgatattataacattctgtcacttgtgcaagtctttaaacgctatgactaatttagtttcacttgaaaaagtctctgtctctttcggtcaacgccgcgtcttgtctgacatttcgctggaactgaaaccggggaaaattttaaccttactggggccaaacggcgccgggaaatcgacgctcgtgcgggtggtattgggcctggtagcagcggatgcgggcgtgatcaagcgcgataagcagctgcgcattggctatgtgccgcagaaattgcatctcgacgccacgctgccgttaaccgtcagccgttttttgcgtctgcgtccggcaacccgtaaagcggacattttgcctgcgcttaaacgcgtgcaggcggggcatctcattgacgcgccgatgcagaaactctccggcggggaaacccagcgggtgctgctggcgcgcgcgctgcttaaccgcccgcagctgctggtgctggatgaacccacccagggcgtggacgttaacggtcaggtggcgctttatgatctgatagaccagttacgccgcgaactggattgcgccgtgctgatggtgtcccacgatctgcatctcgtgatggcgaaaaccgatgaagtactgtgcctgaatcatcacatctgctgttccggcacgccggaagtggtttccatgcatccggaatttatttcaatgtttggcccgcgcggcgctgaacagctcggtatctatcgccataaccataatcatcgtcacgatttgcagggacgcattgtactgcgtcggggaaatggacactcatgatcgaattattactccccggctggctggccggaattatgctggcctgtgccgccggtccgcttggttcttttgttgtctggcgtcggatgtcttattttggcgatacgctggcgcatgcctcactgcttggcgtggcctttggcctgatgctggacgtcaatccgttctatgcggtgatcgccgttacgctgttgcttgcagccggtctggtgtggctggaaaaacgtcctcaccttgccattgataccctgctgggcattatggcgcacagtgcgctgtcgctgggtctggtggtagtcagcctgatgtcaaacatccgcgtcgacctgatggcctacctgtttggcgatctgctggcggtgacgccggaagatttgctgtctatcgccatcggcgtgacggtggtgatcggcattctgctcagccagtggcgcaatctgcttgccatgaccatcagcccggatctggcctttgtggacggcgtaaaactgcaacgggtgaaattactgctgatgctggtgaccgccctgacgattggggtggcgatgaaatttgtcggcgcgctgattatcacgtcgctgctgatcattcctgccgcgacggcgcggcgcttcgcccgtacgccggaacagatggcgggcgtggccgtgggtattggcgttgtcgcggtgaccggcggtttaaccttctctgctttttacgacacccctgccggtccgtcggtggtgctgtgcgccgcagcgctgtttattctgagtatgctgaagaaacaggcagcgtaatgcaggccgcctgccctctccgcaccggagagggcaaaagcgcggttacggcatggcgggcggcgtgatgccgaagtgatcccaggccctgatcgtcgccatacggccgcgcggggtgcgctgtaaaaagccctgctggatgagaaatggctccagcacgtcctcaatagtttcccgctcttcgccaatggccgcggcgaggttatccagcccaacggggccgccaaagaatttatcgatcaccgccagcagcagcttgcggtccatatagtcaaagccttccgcatccacattaagcatatccagcgcctgtgccgcgatttccagcgaaatggtgccgtcgtgtttgacttccgcaaagtcacgcacgcggcgcaacaggcggttggcgatacgcggcgtgccgcgggagcgtttagccacttcccaggcaccctcttcgctcagctccagccccataaagcgcgcgctgcgcccgacgatatgctggagatcggccacctggtaaaactcaaggcgctgcacaataccgaaacggtcgcgcagcggcgacgtcagggaaccggcgcgagtggttgcaccgatcaacgtaaagggcggcaaatcgattttaatcgagcgggccgccgggccttcgccgatcataatatccagctggtaatcttccatcgccggatagagcacttcttccactaccggcgataaacggtggatctcatcgataaagagcacatcatgaggttcaaggttggtcagcatggcggccagatcgccggccttttccagtaccgggccggatgtggtgcgcaggttaacgcccatttcgttggcgacaatattcgccagcgtggttttcccaagccctggcgggccgaaaatcagcagatgatccagcgcatcgccgcgcagcttcgccgcctgaataaaaatctccatctgcgagcgtacctgcggctgaccgatgtattcgtcgagcagtttagggcggatcgcccgatccaccgcttcttctggcgtcaggtttacggccgacacgagacggtctgcttcaatcatcctttactacctcacattgcagcgcggagcgcttcacggataagattttcactgctcgcacccggctgagcaattttactcaccatgcggctggcttcctgaggtttatatcccagcgccaccagcgcagcaactgcttcctgctcggcatcatcttccgcaggaccggccggcgatgccagcaccagatcgctggcgggggtgaagagatcgccatgcaggcctttgaagcggtctttcatttcgacaatcaagcgttctgccgttttcttaccgatacctggtaatttggtcagcgccacgggatcttcgcgctccacggcatttacgaactgttgagcggacataccggagagaatagccagcgccagcttcggcccgacgccgttggttttgatcagctcgcgaaacagcgtgcgctcctgcttattgttaaaaccgtacagcagctgcgcgtcttcgcgtaccacaaactgcgtaaagacgatggcttcctgcccggcatcgggcagttcataaaaacaggtcattggcatatgcacttcatagcctacgccacccgtctcaagcagtaccagcgggggttgtttttcgagaataatgcctctgagtctgcctatcacatcgcgctcctgcgttaatggcaaagttattgggggctatcatataaaaaaggctggataaatatccagcctgatttgcaattatcgcaaccgcccgcgcgccagattgagccggctgtcgctgatttgcaccgcattctgactgacatgacagtgcgtaatggcgatggccagcgcatcggcggcatcggcctgcggattggcgggcagtttcagcagcgtgcgtaccatgtgctgcacctggcttttctccgcgctgccggtacccaccaccgtctgtttaacctgccgtgcggcatattcaaacacaggaagatcctggttgacggcggcgacaatcgccacgccacgcgcctgccccagcttcagcgccgagtcggcgtttttcgccataaacacctgttcaatggcgaaataatccggccggaactgggtgatgatttccgtcacgcccgcgtaaatgagcttcaggcgggacggtaaatcatcgactttggtgcgaatacagccgctgccgaggtaggtcaactgtctgccaacctgacggataacgccataaccggtgatgcgtgagccggggtcaataccgagaataatcgacatcacgcgcctccgtcgttaaggcctgcctggcacgtcattctaacgtagccgcaacctcatcagagatctcgccgttatggtaaacttcctgcacgtcatcgcagtcttccagcatgtcgatcaggcgcagcagtttcggcgcggtttcggcatccatatcggctttggtggacgggatcatggagacttctgccgcgtcggctttcaggcccgccgcttccagcgcatctttcaccgcacccatctcttcccaggcggtataaacgtcgatggcgccgtcatcgtaggtcatcacgtcttccgcaccggcttccagcgctgcttccatgatggtgtcttcatcgcccttttcaaaagagatgacgccttttttgctgaacagataggccacagagccgtcagtgccaaggttgccgccgcatttgttaaacgcgtgacgcacttccgccaccgtacggttgcggttatcagagaggcattcaaccattaccgccgtgccgccaggaccgtaaccttcataaatgatggtttccatctgcgcatcgtcgtcaccgcccacaccgcgcgcgatggcacggtttaaggtgtcgcgtgtcatgttgttagacagcgctttatccactgccgcacgcaggcgcgggttagagccgacgtcagcgccgcccagacgggcagccgtgaccagctcacggataattttggtaaagatcttaccgcgtttggcatcctgtgccgctttgcggtgtttggtgttggcccatttactatgacctgccataaaaatatctccaaaagcctcgccctttcaggcggcgttaattacaaattcttcaatcgcctgccggttgctccatgatttggttaatgcagccgcagcgggcgcatccagccagcggtaggtcagatgttccgtaaacacaatctgccgctcatggggcagcgcaagacagaaccaggattccgtattgcgctcaatacccggcgcgtagcgatgacgcaaatgagtaaagatctcaaactccaccgtgcgctgacagtcgactaaggtcagttgctcttgcacaacgtcgataacgacctcttcctttacttcacgcagggcggcctgcgacgcggtttccccctcctccaggctgccggttaccgactgccagaaatcaggatcgtcgcgtcgctgcaacatcagcacccgtttcgtgtcctgcgcataaatcaccaccagcacggaaacgggacgcttatattgcatattatttattctccggggactcttttttgatcacctgaatacccagttcggtcagggacgcgtcgttagcaaaacttggcgcttccgtcatcagacaggcggctgcggtggttttcgggaacgcgatcacatcacgaatgttgtcggtgccggtaagcagcatggtcaggcgatccagaccaaaagcgaggcccgcatgcggcggcgtaccgtatttcagggcgtccagcaggaagccgaatttctcgcgctgttcctgttcggtgatgccgagaatgccgaacacggtctgctgcatttcagtgcggtgaatacgcacggaaccgccgcccacttcgtaaccgttgatcaccatgtcgtaggcgttggcgatagccgtttccggcgctgctttcagctcttccggcgtcatgttgctcggcgcggtgaacgggtggtgcatcgcggtcaggccgccttcgccgtcgtcttcgaacatcgggaagtcgataacccacagcggcgcccatttggactcgtcggtcaggttcagatctttacccagcttcagacgcagcgcgcccagcgcatcggcaaccactttcttgttgtcggcgccgaagaaaatcatatcgccatcctgcgcgtcagtgcgggcaaggatcgcttccacaatctcagcgttaaggaatttcgccaccgggctggtgatgccttccagacctttcgcgcgctcggtcactttaatataggccaggcctttcgcgccgtagatcttaatgaagttgccgtagtcgtcgatctgtttacggcttaacgccgcgccacctggcacacgcagggccgccacgcggcctttggggtcgttcgccgggcctgcgaagaccgcaaactccacgtctttcagcagatcggcgacgtccaccagctccatcgggttacgcagatccggtttatcggaaccgtaacgacgctcggcttccgcgaaggtcatctgcgggaactcgccgagatccacgcctttaatgtccagccacagctggcggatcagcgcttccatcacttcacgcacctgcggcgcagtcatgaaagaggtttccacgtcgatctgggtaaattctggctgacggtcagcacgtaaatcttcgtcgcggaagcatttaacgatctgatagtagcggtcaaaaccggacatcatcagcagctgtttgaaaagctgcggcgactgcggcagcgcgtagaatttacctttgtgcacacgtgaaggcactaaatagtcgcgcgcgccttccggcgtagctttggtcagcatcggggtttcgatgtcgaggaagccgtgatcgtccataaagcggcgcacgaagctggtgattttggcgcgcgttttcaggcgggtcgccatttccgggcgacgcagatccaggtaacggaatttcagacgcgcttcttcggtgttgacgtgattggagtccagcggcagcgattctgaacggttgatgatctccagatcggtggccagcacttcgatttcgccggtcgccatgtcgctgttgatgtttttctcgtcacggcggcgtacggtgccggtgactttaatgcagaactcattacgcagttcggaggccagctttaatgcgtccgcgcgatccggatcgaaaaacacctgcacgataccttcgcggtcgcgcatatcgataaagatcaggctgccgagatcacggcgacggttgacccaaccacacagagtcacctgctgcccctcgtgggacagtcgaagctgtccgcaatattctgtacgcatgagatatcccttaactttgccgcaggccgattgtcgcctgccgtgcaggccacgttgtcgcagcgttagcctaatgtcacaactggatgaaaaaagggggttattatactggaaattctggcggacgataagtgccacgccgtgcggacgcgcgattgctgcgcgcttattgcgtaatctcacaaaaattaacaatatttgtcagccgcgctacccttttatacaggtaaggtaaacgcgatgtcattcaataaacgggagttattatgctggaactgaacgccgccaccaccgcactggtcgttatcgatttgcaggaggggatcctgccctttgccggtggcccgcacagcgccggggatgtggtggcccgcgccgcgcggctggcggaacaatgtcgccttaaaggcgcgccggtggtgatggtgcgcgtcggctggtctgcggattttgccgaagcgctgaaacagcccgtagatgccgcgatcccggcccactcgctgccggacaactggtgggattaccctcttgcgctgggtaaaaaagagagcgatctggaagtaaccaaacgtcagtggggcgcgttttacggcaccgatctggaaatgcagctgcgtcgccgtggcatcgacaccattattctctgcgggatctccaccaatatcggcgtcgagtccaccgcccgtaacgcctgggaaatgggctttaagcttgtggtggtggaagacgcctgtagcgccgccagcagcgagcagcatctcggcagcatgaccaacatcttcccgcgcatcggccgcgtacgcagcaccgaagaggtgctggcagccttatgatctacatcgggctgccgcaatggtcgcacccgaaatgggcgcggcttggtattcagggacttgaagactacgcccgacacttcaactgcgtggagcggggaatttaaaaatcactaaagaacgcccaagagcatgtgtattctttgtgtattcataacgttataaacatagctcatatgaaattcgctaaagttcatatgagcacaaatgccccatacgtgccccagaacattttagtttgccccatacatgccccattagattaccgggcattcgtcatccaccccgttctgcgtatcgacgacgaaatgggtgacgacgccgatcacctgcaactcattcaggcactctccctctatcggatcaccatcatgcgtgatgaacgccttccccataaacttcccgaaataggtacgaccatccaggctggcgaacagcacgtcgccttgccgcgctattaaccccctgtcgaccacagccgcgccggttgatgtctcaatgaccaggctgttagccgttaaattgcatatgatgtcagcgcacatcgttgtttcaatgtaatcagccgctggagacgggaagcccattattgaacgtaccccatactgcgtagcatccacagccggttttcgctggtatctggtgtcttgtccacgaatcctgtctggtatcgctctatccacttattggcatcagccagagtgtaatgccagttgcgattgcgcagttcacgcacgaaatccgccgtccgcaagcattgatagcccttggggtttttgtgtattgccgcaacgaacgcgccgctaatgtctgatctgcgtgccatagtctccctccatttatactgtatatataaacagtatttcaaaggggagatttggtcaataccaaaaagaaagccctcacatggagggctgtgtttgtaggtcagtaatcccactcaagtccggacagcgatacgaactgagttcctgctggaagcgtcccatcctgaacgcggatgtgatctgttactgagatatgagaatttacaaagcctgtcgaaccaagcatcaatgcagtatagcgaccgccgggagagacaggctgcaacgcagctggcagcgatactatatttgctgtcgcgccggaacctacctgcataaatccacgcactgatgcacgatagtttttcagggaaaattcatactgctcattctcagatgatgccgaattccatcctaaggtaagagacgggccggtgctgcctccgtccatttgaaatttagatttagtaatgatgctgtaacgctcgctaccaacataaatttttgcataggtggtcatgaaataaaggcttccaaccgtggtcccttccacctgatcgatgaagatacgtgcaaatgccaaagctgtaatcattgcattggtgatgtttacaccctcgcaccggccaatagagagctgagctgagggattttcagtaggctgatttaggtaaattccacgcttacagtttgaggctctgacatgatcgattctgatgcgtgatgaactattatttccgtcaataatgaaagcatactcaccaacgatagcattgttatcagcaagaccatctgcaacaatattaacaatatgcacatcagctaatggcattaatccggcaccgtgcactccccatactgccccgcttgtatgtacactaccaatataaacaggaccgttgaaagtcctggcatttgggtcaatatccacgccatgtttagcgtatgctggttcaaaccatgggctagtgtttctcggtttataggcgtaagtgaagtcgtgaacgaaaacgttaccgcagtttgatgatccatctgctttgataattagtccgttttcactttggcagtatgcaaaaatacccgtagccactacgtcagatgctttaatgattacgccatgtgagccaccgatgccggtgacgttgtctaaccgaccatggctataaccttcggtaagtaccgcgtgacctagcgcctggctgttatacatcaatccaatgatgttacgcagcacaagtccatttttttgttccaatccagtagatggagcgccataaacaaatgcatcccatgtattgccttcaggatgtgaagcagtggttgtgtcagcgccgggatattttgaattgatgtaatctcggccattgtcaaagccgatgttttccactgtcaggttattcgcccaggcgatgaagcgaccagcaataaccgatccgccgataagtcgagtaagtgtagagttccaggttggcgctctttcaccaagtatacggatattatcaacgttcatgctgtctgcattaacgttccatttccctgactcatatcttgctgccgggacgtataccgtcccccccgaaggaatagctgctatcgcttctttaagtgaggaatagttagcaatattgaccgtaggcaacattgcataagatgcgttgagatatgcgccaaccgagccgtaaggataatccatacccggctgatagccgacaagcccagcgccctcttcctttttcagatcagctcgcaaagaggcatcgccaactccaacccatgcgcctttttgcactccccctgtgctatctggcgttgagccagggggtactactttggggaagttgccgtcccaccggtagtattccccgttgctcttccagcgcaggcactcgttagcagtgctaagggtgctgccatcttcaaaagaatccttcgtgatatagccataattcagaattgcctgattagcatttttctcaataccataccatgttttgcgaggcctcccaagacggtctggccatgtctcgttcgccatatcgttggttaaatgatcgagattctcggcgttatcgtataaatctttagcagcagcggaccccagcggattgccggtgttataagtcgtcatatgggcctcagtaacgaaaaaacccgccggagcaggttcatgagaagtggatttacttaagcaacattgccgggatagttggcgttgtcgtactggtaatagagtggcgaatactgcgcggcgttgagctggcaggttccgtctgaagacggatcgacacttgtaaccgtggcgtcatacccaacccttctggatgagcagaaaatcaggcgcagcggctcgatgtacgggctgttcatctcccactcgctgaggcgcagtgcatcgctctccggaaccgtcagtgtgtatgcatctacgcgttctggtaccagcagcggcgttgcgctaccgtcctgcaggcgcagcaagcaacgggggttttcaaatgaccagtccagcggctcactgactttcatggttaccagtgcgccgtcgtggatcatatccgtgaccaggcagctgatggtgtcactccccgggatgtcatcggtcagcaccaagcgatcgccatactggtagcaaagcgcgtccagctccgtggaagtggagtgcgccagccgctgatacagatgcttcatcagacgtcgcatcccgatccgccaggcccgatccgggtctgtaaccccgtaaagcttgtagtcctcgaccttacgcggcgtgccgctgccctgcctgcaatgtatggtttcctctgcccaggtcaggctgctgacgaaagtgacgtccactgcgtcgaagtcatcctctgtcggtgctgtgaacgacgtctggagctcctcggtggtttcctgcgggctgatgacgccaacccagtttttaaccccttcacgtcccacgctggccagtccgtcggaaagcaggaaatagctcatgccggcgttgcagatcgtctgcaggatatcgagtgctgatttgccggactcactggccatgtagtcgaacgtttccccccgcggcgtccagtatgccgactcgagcgcggcgatcgccgcggcgtcagcttccataccaattgattcaagaatatgccacagtgcaccgctgatgctgcgcgccgggtaaccattgtcatagatacgcggcgacgtcacgctgacgcggcgatcggactgcgcggccaggcgggagcccgtcctgacggttagcccgataatggtcacgccctcatagcgcgcaggacgacgcggcaaccgcgagcgaagtgcctgccagtaaacctgatcgcgcgtgctgctgcccgccggcggctcggtacggcgcatgcgtacttcatactgtccgggtgtaacgtcgatcacctcagtgaaccctatctggtcttcagtctggcgctcataccccagcgcgacctgctgccagtcactggtgctaccggcggcacggtactgaatgattatcccaactctggcggatctccgctttcctttgctgttgtagcgcaccagtccgttctggaaattcaggtttatctccatacggtcggtggtctcgccgtcaggacagcacaggaaaggccccagccagtcatagttatcgttaacgccggtaaccgacgcatccagtaatgtacgtgcggtaaaacctgtccagcgcggatccactgttgttgccgtgttcccggccaggtctttggtaaccgttacgcgcgctacggtgatcgtcagcgcattaatggccgttatctggtactgatacccggagggggtcaggctaaatcgctgctgaccggcaggcagaccggcgaacggcgcacccgacgggtaagacaagcgcagactcgccagccgggcagcggtaccaccgctggatgccaggcccgcgacggatacaggagcgctgccgaataagaccaccggcaatgagctgaaggttatggacccaccagcgaacgggctagactcctcgcttataataatgcgcccagatttatcgttggcaactagcccggatccgttcagctgactggtaatcgctgacaccaggccggacatagtcacgtagtttgcggtcagcgacacaggcaaggcgcggtttttccaagtaatactgaacgtctgctggctaccgctgaagtcgtaggtctggggcgcggcgctggcggtgacagtagcgctactgccacccacgccgggaacagccgcaaccgccggggaatactctgcgacaaccagatcaaactggtcattgttgatttcaagagtcagcggcatacccaccaaaggggcgagttcatccaccgatccggcgatctcgctatacccggcggtactggttaccctgtacgtgtccggagcatcaatgttaatcagcgtgccctccacccagccggacgggatctccgtgtcactgtccccggatgacacagagccaatcagcgtcaccgtattgccggatacgagtacagcatcagcgtcaacggtgacggcggccgggccgctggtaccgagatccagaccagagccaccagcggatgtaccacccacttccgtggagttgtaccagttctcagagcggggatcggcagaaacatctgcgcccggcgggtatacggtgtaagagacatcatcgccaaagctgctgacaggcgttgccccgatgcgcagatcctcttttttgatatctccactgccgacgccccagcacacaaacatgctggttaccatgtcacgttcgttgacgaaccggctgacaggctgcacaacataatccggatagacgcggtagagaccaaacacctcacgaatgggatcgcccaagcgggcggcgttagcttttgccggatcaagcgatatctggtcgccctgcccctgcccactgagccctcccttatccatggtggtcatcatgtagatggaatacgctgctgatgctaccgctaccgcaacagccgtccataccagccaggcgggcgcagctggtccgtacgggatagggtagattcgcacatcgctgtcaggccgaagatggcagagcggccattcctcaggcgggatgggggcgccgttgacttcggccgcaacgggctgctgccggtcattctggtaaccggtaacgttttctgcaaaccactgatggagtgtaagggagtcgtgttcgtgcgtctccagcggttcacccggcagccgggacggataaatgcgtatggtcactcgtaatactccacggatgaataaagcctctcaaagcgggccagcggcaggatagtcacgttacggtgtgggtttgattcgagaacatgcagcgttccttcgatattgaccaccacgcccaggtgatcgataacccccccggaataacacgcagccactgccccttctttcgcttccacgcgtcggacgttggccgagaacgccacgcacgcccgtgccatcgtatccccttcgcggatcacgccctcaaatgcaggccattccggaagcccgagatcccggcgtacctcatgcacaacgccgtagcagtcaagtaccggccagacgcgcccgcccatctgccaggtgacagagcggtatttgtcgatattaaacattgaaacctcagaggtagcgaaggcccggaaaagaaggcagcgtgtagcggtagcgtggccacgccatatccagcacattcatatagcccgcggtgatctgcacttcggttgaagtccatgacccggttttaatggacaatgtgtacgggcgcgctgcgggtgcgttcaggctggttgagatgtacaggcggtaggtcagcgttgcgccctgaatattctccagggctttacggatcgtgctggatacctcaccggtaatattactgatggcaaatttaagatcctgcgtaccgtcattgttgcgggctggcagcgcaatatcaatgccacagccctgaaaggttagtagctcgccattctcagttgtcacctcgatgtcgtcccagccacgggtgaggtaataaacgtcattgccgatgttgatctgtagggtctcgatcaacacttcgtcaccgcttgatgcataaagccggttcagtaccgtcatgcgtttggccactccctgttaacagcgagatcgataatgtcagcgccggtaataaagcccgggaatacaccccagcctggagccagtaacggacgttcataaagctcaagctgtgccgagtaacgccagaaattcccgccttccagacttggcccctcgtaaatgtcggtgaaccggcaaacctttggggcttcgcctccgggcgtgcgcaggttcatgttgaaccagtccgcgccgtccgtcagcacgtcgcgaaaccatgcctcgaatgcctgcgcctgctggtctgtcaataaccatgatatgctggccactgtcggtgtcgagatgtagcggcggcgctgccgtgcacgtccgctggtcatctgcgttctgactatcgggctgacaggctgaaagccgtatccctcctgaagaggtacgggtagtgcatcatgtggatagttaatattggttgtaatggccatcagcgctttttcctcccaaccgcccagccgttgttaagggcttttgatgcctgccctgaaccgccagccagatcgttagccgtcatctggtagcccagcgtcgcgccgcgcttcactgcaccctcaatcagagccagagtgcgctgatctggatcaccgtgaacctcgagaggaatggtgatgtttggtgcctgactaccggtagactgttttcctacacgctccagcgtggcatccagtttcgcgctggttttggcggtggtaacgcgttcacctttttgcagcaaccaggtgccggtttccggtaccgagtcgataccgtcatgagcctggcccttgagggctgagctgacgcccagcatcaacacacccgctccggcagcggcagctgtggctgctgaccccgcaagggctggccccacatacggcacaccaatcatgctggtaaatgcctgaagtgcagccatggctacctgagcagctgcatactgaagcagcgccgcgcccatcgactgaataaaggtggcggcgaagtccttaacgttcatcttccctgtttcagcccattcgataatcatatcggtcaggctgctgaatgcctgcgcgccaacctgctgcatattggagtacaggtccatagaggcttctatttgcgtggcaagccccgagacaaaaccagcgttaccgttattgcggagatcgtcaacctgctggtaatagtcctcctgaatctgcaggcgttcggccatcgcgtcgttcagagcctgcgtctcgctgtcatacagcgttttggtgatatcgccagattgatactgtttctggagatcagcctgacgagagaggaaatcggcctgaatctgaaggcgatcatgcatacgctcgcgctcctgcgcgcccagccacccaccagcaacatcgatatcaagcgaggctttctcgttctggttggatgcatgcagcccggcggtgaactcagccagtttgaggttttcttcattcgcccggcgaacagcgttcaggcggtcaatttcggtagctagctgcgacaggcgggttttctgcgtctcgttgagtccggccagctttccgtcagcaatatcaaactgaagccgttgaagctcagttacctcgaccacctttttacctgtggtgtcgatcagcgctatctggcgctggtatgcctgctcggtcgccttaaaggcgttctcaagtttgttggctcctgcatctgccgtgggcttaccgttaacttctccttttccaagcttatatcccgtagtagcggagctgctcgtaactgccgggaatattggtaaagaagtctggaatttatctaaactggcaagtttttcgcgcagttcctttaattctttttgcttggcatcggtatccataccaatacggtttattccagccagaaaacctttatcgctcaggtcagcttcaagatttttaatccgcctttgaatttctacgcttgaagcgttggccgcaactctttgtccgccctgaaagttctctacaaggcgacccaactccgaagctgcgttaccgagccatccgacaagagatgctacaccaccaaccagctccgataatccctgcaaaactgctgggtcggtgaaagtctttttaagatcatccagcccttcctgaagtggtgaaagatcaactttagcgagccctgcagcaatctccatcttcagaccactggcctgtgcttccagatcctgaaatatctgattcacttttaaaaggtcatctatagatttcggatctggtgcaacaccgtagtctttcgccagttgaataaactcgtttaatttttggttattattatcaaatagcggtaatagctttgatagatcattaccgaggctttcaagaatattggtcttttcggcgttggtatttattttccctagcgcgtcaccaatagctatcaattgtttatcagggctaaccttagatagtttttccgcggaaaggcccaaggcattaagcgcgtcgaccgcttcacccgacttattaagtacagcatcaccgattttatcgccgatatctttaaaaatgtcggctatctggtcacctgacactccagccttttcagcggcaaactgccaggccatcagttcctgcgtagatacttgcagagactttgcccacctgtccgtttcagtgatttgttcagaggtggacttcagtaaagctattcctgccgaggatacagcaactgccgcgcccgctgcggctgtacctatggtggcaatggcagagcccgcagcctttacatctgactggacttttttccgccacttctcagacgagcgttctgctttatccatgccagcaacaaaaccacccaccttggcgatcaggtcaatcgtcagggttccgagggatttaccggccatattatctccataaaaaaaccgccaaagcggatatttttacattcagggtttattcggtgattattaccgcctgctgactaattccagtttttcatcgcgtcttccagcgacacgggcggctcgtcaatatgaggcgcgaaatcactgatgcggaacgacggggtgtccttacctttgttgacgttcgccagcacggaggcgatcagcgccgcgccccactctgtccgcatcatcgggttcagtcctccatactggctgcggtaccggagccagagctggaactctctgaggctgagtcgttcttgagcttcggcgatcgttcttccgccgatgccgttgaggacgagctcgcaccaaacctcatcttcggcggtgagttcatctttcccagctcgttcacctcctgaatagcgaccagcagcgccaccgtaagcgccccatcaagcgcgccgcgctccggatcagcttcgccggtgatatctttgggcgtaaaaatcgggttgccggcttcatcacaaaccgccgccgcgatataaccggctacgccatctattttgcctgcgctggcctgaatgccctgggtagcagcatggtaaccggcaggccgaatgaacaccgttgcggtcagctcctcttctccctgtttccaggtgatctctttttcaatcgggcggccggtgaacgccccggcttttttcagattatcgagcgtcagttgcatgatttttcctgctccaaaagttatacggggcatacgccccgcgttgcttaactgccagcttggactttcggcacccataccgccgggccagaacgctgaaccgatgccgacgtggccacaaccgtgttagccgcaaaatcgaacgggaaatcggtcaccttgcctttgaacacaaaccaggtgcggtcttccggaagttggaggccatctacgctaccagctcctgatccgactgtaggcgctgactcaccatcagcccagcccactgcccaagtaagatcgtcctgattgtcggactctgccatgcggtgcagcatcagatggctgagattcgccggatccgcgttaagcgtcaccgtggccgcgccgggggtacgcagaccttttttataagttcgcgtgcttcgctcactgaggcaggtatcttcaatctggtcggcggggttgccgccagggctaaacgcggtgatgcactcaacttcgctgactgcgccgtccgccagaacatagagctgtgtgccctgagtcactacagacatagttatctccggatataaaaaaaccggctcggggccggtgtattgagggttatcgcttcactatccagtcaacgtcgaaggaatagcgatagcgttttgtttcggggtctttctcctgccctccccagcgcgtgatgtgcgcgtgcggctctatggcatcgcgcagtgcagcggcgacggcaatgacctcatccaccgtgtcggcataggcatccacctgaagcgtgaatgcatcagcgtcaggtcgctgcgccaggtagttctccggcgctccggtgacattctgccagaccgcatacggataaacgactgcatcgtcctgcataccgaaggggtaaacgcgcaacgggtcagaccccagcaatgctcttacgcgcgggctgccagcgcaaacggcgaaaatcggagcgatcatggcggaactcctttcttctgtgcgcgcttaatggcccggtcgagcaccttttcgtattcagtggcaaaagtgtttgtcacctcgttaaggttgttctcagctgccggacgcaaaaatggctgagcgcgcatcttctcggtaccgaattcaatgagtcgccagtgcggggtcggggcgttctcgctcaggtcaggatgatttttcagcacagcgccatgaagcacgccgatccgaaatcccaggtcaccggtgcgcctgaacaggcgaccattccagcgctgcgtgacgtttgcggcaatgctgcgcccggtttccggatcatcaatacggctggcgttttctttagctttttcgacaatcacattaccggcgcgccggagcgccgcccggccacctttacgccgcagatcgtcactgacggcatcaagcttacccagcagcgactccagccctgtgatactgaaatcaataccgtcagccatcattaactccccgcgaacacggcagcgtcaggtattcccggccgcttttatcgtcttccagcacgccatgaatgttgtagatgcggccccggtgaacaatgcgatgtttatccgtgatatcatcccgccagcgaatggtgatccgggtagtcacttcactttgcgcggctcgcgcggccacaaaatcgcgggcagataaatcaacaacactggcccacaactctgcgacgtcagcccagccattagtgacggcgcctgtggcagggctttgggttttcaccggcttctggagcatgacgcgcctgtttagctttccggcctgcatgcttaccccctgggtttaccgctgaggtaagtgtgtaccggggagtcgatcgtggtcgtttcaatctcccccaccattgactggtaaatcatcgccgccagggcttcgtttgactccgccagccgcgtcattgcggcggtctgcgctgccatcgctgccagcaggccgtttacctgttgctcgttcataggcaatgtccctccattttttcagccactcccggcggcgtttacatccggcgcaggccatcagtgccaccgccggtggcgtaacagcagcgcttcgacgcccagcggcgtttccgccaggttctgcgccgctgcctcgcggtttgcgtaccagtgaccaatcagcaaaagcattgccgcccagatacccgaagtaaaaagaacctcacggggaggctccttttcttcgtggggaggtgtcagcgattccaccagcgcaccgtcgcagaagtgctcaacgtaatcaacagctgccgaggcataggcagcaatcagatcgtcttcggcgccactgtcaactttcagatgcgtctttatctgcgccatctgctccgcgcttatttccacctttacccccggttttggctttttcagactgcacaggatcggaagctcccaccttttcggtttcaacctcttcggccaggtgcaatttcaccagtgcttcgccgatttctttcttcaccacgcgggtttcaccctgtgacaccgttccgaggtgataatgcgagaacatacggagagctttaattttcatagcgtttacgcggccattgctgaccgcgcccttttgttatgcgccggtaccgacagcaatatcaccggtaacgatggcggcaggacgatagtgcgccagcgccaggcgctcttcgcacaggatggtcagcatgtttttcacgaagttatcgcgatcctggttgctgatttcgatagtggcatccatgcggtcccagacctgagaggcaaggccaaatgcgccgacggtaaacgtaccggccgcctgcgctgtggtggacacgaccggcagcccccagagcaacttcgaggcaaatgcctgagggccgccaaggatgtaattgccgttcgcgtccttcagcagcgcaatgcgatgccagtctgccgggttaagaacgataccgtcggcttcaaattcgctgagtgatacctggtagatagcatgcgccagcacgtcagcccccgtatcacctgaagcattcagcgcggtttcatactcgttggcaaccacgttcagaccctgcaggttgtcgccggtaccatcaccgttcagcatctggttttcttccaccagtgccaggccatacatcatgcgggagttgatataagactccagagccggcgcatcgtccataatctgacgcgatgcctggatccagtgggcgatggtcttcacgttcgccatttctttggtgaaggtgatgttactttccggcttgagggtgccttccgccaccggcgccgcagcgttggtaaacacgttctcgcgaacatattccagtgcgttactggtgatacgcccctgcgccagaagatcacgcacggtcagacggcgcaggcctggcatgagaatgcccggctgctgctgcggcagaaccagcgcaccggcggagttagcacccgagccgatcgccttgtcgaagctggttaccttcgctttggtgcgcgaaccgtcccagcccttcatcaggtcttcggacacacgctctgcaaaagatttcttcgcggtctggtcggggacgttaccagcgagcttctgctcaagatcgaacaggcgcgtaccggtggttttcagttcatcctgcgctttggtcaggtcggcctggagttgtttgttaatttcgccattttcattaatggacttacgttgttcgtcgatcagttgcttcacttctttctgtgaattctcgatcgctttttccagtacagataattcagacatgtgttgctccgttaagcattccgcagattagcggcaaaggaagttatgcgctgtgccagcgcgtcaatgtcgccgctaccggactcgctccggcctgcggacttcacgcgggcaataaatgcctgcgcctcagcgcgcgtcaggccgactgaatccctcagccaggcctccgcgtcacgaatggttttgataccgtcgatacacttcatggcggtcacgcctgccagctcattagccgggaacgtgcagacgctgatttcccgcagataggagatgtttttaaaaataaggccggtgctcccgacgctgtaatcgtcaggaccgacagaaaaccctactgacatgccctcaacagtgccgtgctgcatggcggctttaagatcttctgaaatgctgagtccaggcgtaagctgtccgcggacatacagccctttctcatcttcatgcatcgcatcccatttgccgacagggatggcgcgggtctggtggttgaaaaacatggccactttacgactctggctggcgatcacacccgcaaaagcgccgggcaaaataatgtcgccatcggcgtcggtgttattgaaaaccgaggcgtacccctcaaaggtccccttactgccgtcgccggtaaacttgatttctgtctggtcgaacgccagcgttttttgaatctcaggcatcgtagcccccataaaaattaagcccctccggagaggggcttgttatttgttccgagatcggtgatcggtatgttctgcgactggcgcgttgccacatcgccaccgggcaggggcggcaggttatccagccgtcgtacttcatttacggtacggatcccggtattaaccatgatctgcataaacgaggcccggcttgtagaatcgccgcgcaacagcccgtcgagattatgttcggcgtgaatactgccctgctctgattctttaaccagccagcgctcaatgctgtattcccagcgatcgagataaggtttaagggtgtactggaggaagccgaggttttgctgctcgatgccggatccccatgaggtgcttttatccacatcccctaccagatgcggaggtacaccgtaaaagcgcgccagttcggcgacctgaaattttcgcgctgccagaatttcggagtcctgaggcgaaaccccgatagcctgtgtagtgaaaccgctctccaggatccacaggcgtttcttaaccggaccgccggcaatctctttgaagttttcttccagttgcccgcgctgctctttggtcagtaccttgccgtcagtcatcaggatctgcggtgacttcgcgccgtttgcgaaaaactcacgctggttatcttccatggcaatggcaacaccggcagacttcgcgctgaacgccaggggtgacagtccggtcaggccattaaaaccaaatcccttgagatggaagatttctttctgtgaaaagtcggcatattccgtgtcacggcggtaccggtagataatggttttaccgttatcgctgagccgcacctccatgttggcactcatcagcggaaccatactgataacgtcgccgacgctgtttcgttccacatgcgcgtaggcatttccgtaggcacacagctgcattgtcatggcctcgcgaaactccagcgcggtcatgaaattgttaggccggaagcgcagaagctttgcgagaggatgcgtgcccggtactttgctgcgctgatcatctttggtctggtagacatcaaggggtaacgatgcggtgacggtggagataagcctgatacaggcccacaccgtactgatttgcatattacgctcgtcagtcaccaccgagtcaccgaccacaccgtgcgcagacgttcccgccatctgcgaacctttatccggcgtcaccagtcggccgccggtcaggatggaggccatgcgcgcccagaatggcgatcgcgttcgcaggtcaatgctgtaatcggtatcagccatgtttacacgctcaaaaagttgtaaatgaaatcgttaacgtcaccctgctcttccacctcgtcgctgttctgcgccccgacggacattgccagcgcgaccatgccatcgatgcgcccgctagatttgccttttacgaatttgcggttgcccgcagggtcagtgatgacggtcgcatttttggcgcacatctccaggatcggatgattgccgtgcttcagctgcgcgccgagcagtttggtttccagctcacgcagcgccggcgacatagatacaaagccctgcccgaattccacgaaccgttcgagttcagcttctgtgaatccggcgtcaataaggtgcgggcgaagaaagcgcatgttgtaacggtcaaaggccagcgccctgacgttgcaggtatcgaagatgtcgcgcagctcttttgcgataaaggcgtactcaatggccttgccgggcgttgtgttgaggtaaccctgccgcgcccagatgtcatagggcacgcgatcgttacgggccttatcagccagtccttccgcaggaagccagaacttacagtgcacatcgcctctggcagaattcagcaccagcgccgtcagatccgagacgctggacaggtcaagcccgccccagacggtggcaccggccaggctgtcaggttcttctttattcatatgccagacggtctgactgacgaaggggcttttcgcttccacccgccggttaaggacaaggttttcaaactcagcctggcgcgacggcagacgtttggcgctggcggccatgtccagcacttcctgctggttcatgaacacatcaaatgccgggtttgctgctctgatcgcttcaaccgaaaacggatcaatatcttctggcgcagtctgtaaccggaccaccgtgcgcgggtcggcgccagtcagcccgtcatcaatcagcaggctcaggaggtcgctggcatccggtgcctgggtactgataatcaccgagatcgggttttcctgcgcggcggttgctgtctccagtgcctcgtaaagcggatcacgcgggccacgaacctggcctaactcatcgtgggccacaaagcgcggcgagaatccgtaagcggttgtagcttcggcgctcagcgcccggtaataggagcccagttcagggcaatggatctctttggctgagtctttaatcgccacgtactgcatcagcaccgggttcatccggcacatttttgaggcgaggttaaagaggattgcagcctgatcgcgggaacgcgccgctgaataaagctgggagttgtgcgccgcctccgggccaaccagataaagcagcatcagcatggcagtttccaccgtcttggcgtttttacgccccctgctgatgatcgcgcggcgggtgccgtgcacgttgtcaaaaattgccctgaagtcatccttcatgaaatcggccatcttcagccgctgtccgacaaacttgccctcaggaatgaggatgttctgctcacaccaccggatgtttcgttcagcccgtgtaaggttctttttaaccatcagctactcagccttaatcaatttcccagggcttcttctcccgcgccaggttgttatgcgcccgccctactgttttcgggtcggctgtggcctggcgcgtgatccgcaaacgggtagccagtgaagatgcggaacggacttcacgctcacgcatggtcagcaaccggtcgtaacgcttaaggccatcttcacgggacagccattccagctcgaacgcttccagctgcgtggtgatgatcctggcctgcacgacatggcggcagtacatctccatcatgtcgcgatgggtttcggtgaacgaactggcaggattgtaattgaccagtcggatccagacattgatctccggatcgctgagatgcagcgacggctgtaatctgctttcagccagcgccggcagcgagacagcagacgtcgcagcgagagactttctgcctcgctgtgccatcactttttcctttttttctggacgtttttaataaaaagactgagggcgcggtctttaagattttgccgtcagagttttatccctcccccccacccttccggtctgacaaatgagaatcgctctcacttctcgatgatgcgcaggttatcgcggggctgagggtttggcaccagtcgttcgcgggtaccgatgggaatggtcaatgtaaccgtgggcagcgtctcgcctacctgatggtggaggctgatcgcagtgagtgagctgaagctgatgccatcgatgctcagttcaatcagcttgccttcacggtattcaatcctgaggtcctgcattgcatgctccttttaccagataacccggccttcactgtcgaactctgtcaccgttccgcccttctccatgcgctgcttcacggagtcgtggcagcgtttgcataaactttgtaaattttccgggtcgtgaaagagtgtttcatcacccttatgcggtgtgacgtggtcaacgatggaggctgacactacctgattacgtttaaggtgaaactcgcacagtggctgtttctgcaactggtggtaacgcagacggtaccagcgcttggtgttgtagaggttatgccagggtgaactggaagccatattcactccaataaaaaagccaccagcggataccagtggcttgaatgggttgtggtgtacgtgttggctcgggtgtgccgatctaagtcggatagccatcgtaaaggtgcgctcgccttttcctgcttatttgacgattaacacgcacaccacaattcgtcattatcacaggcactcagtgaatgcctgctgtaatgccttaacagtcgtcatcaggcttggctacagagcgacacgcaaacatgcaagctttctgcatttccgttttcgccatagcaacccagcgcggatctgcgcctgtctctttagctgtatccagtaggtggaggaaatgacgactcacatctttcatccggttcatcacttcaatatcgcccggcgttaacgtgcgataacccttaacggtgctgccgtcctgcggttttgcttcgctcattgttttaccttatgggttaatggtgcgctgcgatgcgctttaaatgacggcgattaacgaacgtcaatatcagggatgatcaccgacggcttgaaggtgacacggtaatggttaacgctggcgttcgtgccgctcaggtcttccataaaccaggtcacgttatccgacaggcccagcatgtgctttttgtaagtgtccggcccggtcttgcagataacgcccagcgttcgctcggtgctggtattgtcctttgagcaaagcccggtaatttccagcatgaactcgccggtaatcccgttataaaaaacaaagcgccgttgcgcctcaaagttatcagcggccttgcttacgttgcggctggctacatcggcatcattgatatcgcaggcagcaagcgccagcaccgccaggcagagaagcgtctttctcatcacgttttaccagagtaattgattgtctcgttgctcagggtgagcagtgggccggagtcgcggcgcttcgcagcgtggctaaccgtgttgttgtgcagcggagagaacatcatcaggcgctctgctgtgaaagcgccttgtgacagtgtctcaggaaaaaacgttgactaaacggcattcattcgtgagccatatatcatttccacagaaatattgctgacactttcaggtgattcgctacgttagaaccgttacacacacagcaaacggagaaaatatgaaccttgatgtactgaattttcttgttcggaatcgtgaagaattaattcgtgattcagcaaatgataatggactaaacgaagataatgtttggggtgtcgctcaaaaagtcgtgggtgaaaatagcatcaccggcttatctgaaaagcaacgttacctgttcgataatgctctacttcccctcatagaggatgtaccttgccaaggatggtatgacgaatttgatggtgacgagggctcgcatttcgactgtccaagcacaattgaagaaggaaggctcattcactgctaccaagaagaaagcatgctctgcgaaagttgcgaagaagaagaatcttttcgcgcttcaaacaaacgcagattcatggaagatgattaattctccttcgcgtggcagttatcctgccacgctttgttatgcgccgcgacgtcggctttggtctgcctgtccatcacggctacgtcatgggcagttacgtaaatcggccgcacccagtcgcaggcggtatctacaacctcaatccttacgctgccagttgtcgagcagctcgcgatcaacatcatcgccagacatatggttaacagcctgttcagcatctgccgccctctttgttgcttcaacgcggcgttctgccgctgctgcactgcctgcggcccgctgttctgcctcacgcgcccgggcgtccgcctcggcagtgtctttgccctgcgatttactgatgcgccaggtgcccaccagcaggagcaccagtgtaattatgccgccgatcaacccttcagcacccattacggtttctccgttacagttggctgtttcaccaggcggccaatgatgccgcataccgccacaaccgcagtgatggtgcccatccagcttgccgggatgtttgctttcacatcatcaggcagttgcgaccagataagcgggatggcgccagctactgccagcgcctgaacgctgaacagccgccaccacttacgccagttttcgataaccatgctcacctcacagtgcgcgacgggcgcgcttataacgttcagcacggtcatcgaggccgttctgcccgccgttgatgatctgcgtcacccgcaccacatcgcccggataccgcatgcaaccgctggtggcaaagaaccatgccgctgatcgggctgcgtggcggtcttccgccagcaattcaggcgtggtgaccagatcgagtttcagggcagcaccgcattttcggtaattttccagaccggtgatctggatcagaccgcgaccgcgatatttccagccatcctgcggacctttgttgccgttgcgtttgttgtaagccagatttgcgagcgcgcgctggcgctccagcggaagtgaaggttcaccggcgcggcggccaagcatattcgcctggtcctgcgtgatacgcccggcgcggatgaaatcggccagacccgccacgctgtagttgaagctctccaccagcgcggtaaagcccgttgattcgtggcctacctgcgcaatgaacatggcctgctgcaccggttcggtgatgccgaattcacgcatcgccgcatcgatatgcggaaaccagcgcgcggctaacccggcgctgagattagccgcccgttgaaattgtgtctggttcattctggcctcagtacctggaacagctgcgccacattaccccgagccctgaacacggcggcgcagatgattaagttgatggtgacggtcgcccagtgggcgtggaaatagaaatcgaacaggaagcggaacggtaccgaggcatacgccaggataatcaggtacgccagccaggacgcccaccagttatgtttgccacccggcttgcggaacatcatcaggcgcagaacgatcgcggtgcatgtcattacgttggtcagcaccagaggatcacttattaccattggttcctcctctccacctttgcaataacgtcagcggatcctgctcactgaaaaaagtgagtgtcttgatagccagcgcggaaagaagtaccgcgcccagcgcatcaagcggcttgtcgttgtagctggtcatgctggcgagccaggagcccaccagcccggaaccatataccccggcaaaataggaaacgatgaagtatgcagatcggcggaaaatcgtcaggtctgctgcggtggccacgtagaaaacggcaccagcgaacgcgccgaacacgacaccataatcagtgccggtcagcagtccataaatgctggcgcccgttaatgcactcgcagctgcaacagacccggataaaggttcggacatttagccccctcgtcattgctgttgatcctctcagatgaggggaaataaaaaggccacctgctggcagcccaatgcactctgtaaaagacgcccggcggacgcctttagaagaatgttattttgttgttttaatcagtggcagaagcaaaacaatcacacccgccaccagcacgccgtccgcaaggatcgacatcaacttgctggtaaagtcgatagcgatcaccaggaacagcagcacaccagcggctacccatcgcagctttgccattacaggtgattttccagacgcaggccgagcgcgttggcgatctcttccagcaccttacgctcttccgattctacttccccgtcagcttcagcaatagccaccgccacgtcgagaacgtcttctgcttcacggggatcgtgcttaacatcttcaatctcacgcagcgctgcccggcgaccaatcttaaagttggtatccagctggccgacgatcgttgcgctgatagcgttgatttcagaggtgaacgccgccagtgatggctggttgcgcagcacctgttcgatcttcgccttttctgacgcttcacactcgccgtcggcgtatgccaccaggtaagcagcgtttaccaccgcctgggccagatcccgcttttcgaacttcttgatgtcgcttactgctttacgtgcttttttaccgaaaccgaacatagtgactttccttttagggggtgagccagcgctcagaaatggtcagcccacagagacggtcacaccgaccatcactctggctcacctctgaaaggctctgtggttgaattgcgccgagcgtagcgcgggtgtgaaaaaggcccgcatatgcgagcctctgtagattctttaccacttcccggagtggccacgctcatgcccttgaggtgctgtcgcttcatcgccgctaataaccggtgcgcgtttggctgtcgcgctgctttaccggagcttgttttgatctatgatcctcacccatcactacacaggttcgccattacgcgactcggggcagcatcatgactgctgctttacctaatagctgcggtctatccgtttagatctgcattttataaccctccagaaacgaaaaaacccgctcatgaaagcgggttcggataacggtagatactaaatgcccatcgttgtaaaaaccctaaccaacttttccgaattttgcaagcattgtgttgcgaaaattacttaaaatgcttctatcgtgtgactttgcgcaaaagtttctcggcgaaagcttcttcctgccagcactttgttaccagcttatcgatgacctcagcataaccgcagtaccactggtgcttcgtcagatccggtaccagccgttccacaaccacacgggccaggctggtgggaacacgactgaagcggtgaccattacagcgaccgcagatcttctgcactggcacgccatgaagtctggtgcgcttctcatcgagcacggtgcctttacctttacagcccctgcaggcagtgctgacctctcctttcccgttacagtgttcgcacagttcctctaccacttcttgttttaccttcgcttcaacgcctctcacaccgggatgctttacgacgtcctgaagggagcggcgaacaccctccccgccacagtgttcacacacagctttgctggcagcagatcgggaataatcagcgtacgcgaaccggaccagacagccgacaatttcatgccgtgctttatcgctaagcttattcagcacagggtttctcagcgccagcgcgtaattaaacagcccttctatagcaggctgtggatcctggatccccattttggctaaaaagagattaaatccgagtgaagcctgagcctgaacaaagccctgggctgccattacatcggtgatcgtcagcgcatccccgccggtggctggcgtcacgtcgttcagcttcggtgatttcggggaataaaatttaggtaatgattcgaggttcatcgcggtctccactccgtttacgccagtacgccgatcgccagcgcgcggtctaatgtcttcagcagcagctcgggctgcgtgccatatttttcttcaaacgccttcatgtcagcgtgcaactcgtcgtgatgcgctctgcacagcgggatcacgaacaggtcatgcgctttggtgcccattccgccctggccgtagccaatgatgtgatgcggatcgtcagcaggactgctacagcagacgcacggctgcgcctttatccacctggtgtatttctcgttctcccagcgcttacgtttcgggcgtcgcataaaggactccggcgattccggatcgatgcgcagcgccagcacctgcttcgccttttcctcaatgatgctggtggccgccggcgccggtatcagctcgctttcgcgatataccgacggaatggttgccaccggcaggcgcaacgcgtggcgcgccagctcttcgggaataacgtcagccagatcgttacgcaccagccaccagcacagctccgggatcgtcagctggtgagtatcatcaaagcccagcgccattcgtacgaactcaatgagccactgcgccaggttcgtccgggcgatgcccgccaggcgctcggtggactggccgcgcagtgtgttatcgcagtgccagcagacgcggatcacgccgggcgcatgatgaaatgccgtcacgttttccatgtgataggtaccgtgcggatactgacattcaccgccgcgcatcagccagttttccaggcctgacatgccgccagcgcgcgcgatcaccttctcgttttcaaacaccggtaccagcaacggatcttctgccagcggctgcgcggcgggcgggatttgcccggacggtaacccggccagacgttccggttcgttctccagcaacatgcgcccgcgactgaaatgcgccagcaagtctgctccaggacggaacatcaccacacccagatcccggacaacgaccggtttgagaagtgccctcatgccgcttttcctttcgccagatgttccgcccacaggccgccgatccacttgatgcctttggcggtaaagcgcgcctggctgaatgcgtggttggtagttgacgaagtgccggtcttaacttcgaaccgaccgagatcgatatgctgatgatgaggtgtcagcgtgcccgccagccggtacatgatgtttttatcgatgaggaacaggcggaactctggctctttggcgccaagcagtttggccacctgacgaaacgacatggatccgcgtgcggtacagtaccggtcgacgaactccaccttcggcgccgcagaggccagctccgccgtcagcttctgcttttgctctgccagatcagcagcgaggcgaagcgcatcaggcagagattgtggcacatggatttgctgcgtctgttcgagctcctgccagcggtcaaccagccgcgcggtaaattctggagacagctgcgccacaacgacgtagctgtcacgcttgttcaccaggtagacggagaccgtctgattgaggtgatttttaacatccgccagtggcggaagttgaataatgcttcgctcagccaggcgttcgattgagcgcttcacatcgtcatggcgtgactccaccagatcggcaatttcgcggctggacattgtcagcgcgctagttacgttgattaactcgttcatgctcttctccacttattcggcgactgcactcgccacggtttcaaatttgctgatcgtgatttctacccttcccttctttatcactggcccccactccaccagcatacgttttacctggctatcgtcctcccagacaccagcgtgcgtcagcgcgtcgaacagcgctttgttgtagttgtcgatgtcccggcgtcgggcgtcaggcgggtacagaatgatttcaaccgcagcggcttccaccgacggcttaggtaagcggcgcaactgctcgatgatcgctgcacaggcatcgctctgatatttgcgcccggcggcgctgatgagatggcgcccggccagcggccccttattcggggcgcgccagtaggtgtttacgcttggaggaaatggcagcgtcagtttcatatggacaccccgcgcatttcgagaaaggtgatcgcttcttcccgtgcatgctgatcgccagccacaagcgagcgcagcagtgatatagcctcatcctctgtgctttggctgtttattgagatgccccggcttacgcccggcaccagggtgatcgcacctttgcgctgaagcgcacgtagcagttcggtcgccgcgttcggagacgccgcgcccatcaggtcggcaacttctttttgcgttggtgggataccgtgctctttctggaaagccacgatcagggataaaacttcttgttggcgggcggtcagatttttcatgctgcatcctccttcagggaggctttgctgctgaaatccttcagcgtgacccgaatagtgcgaatattgcagcgcgccgcgggatccatttctttgatgacatccagaaatgtcgggatcgccatgccatattctttcatcgcttccatacctgcgatattcagccgttcctgcatatcgacttttccctggtcattctcggggtaatttagatccagccattcgctgacagccagctgcaaacttttctcagcgatcagaacttccgccacagcaatgtcacctgcgcttaccatgacaacggtcggctcggaaacattgtcggaagcccatacgtgagcaaattttgactctttgaaggtgtactcttccttgtcgccgaacaccgcccggacacaggcccatgctttgataccgctcttcgcaagaatatctgcataactcagcggcaggatttcttcagaactggttaccggtgatggcagcgcaacttcatcggcctcatccagcgctgatacgctttcggcagcctcatcgcttgcgacaggaatcacttccggaatattttgttgctgcatctgggctaacaggcgcagcgcttcgcggcggatctgcgcaataaatgcatcaccgcgggcttccagatccttgcggtcgatgtagctgatcgccgggccgcgccagtttttgtcgaatacagcaatcgccccggcgaaaaacgctcctgacggaacctgtttttcatctttcggaatgaaccacttcggcagatcaaaaccgattcgcccgcggataaacgatatgtgatcggcatcttccggccaccacacttcgctggtggctgccttgatgagaaatacataccgaccgcctttatcgcgcatcgcgctggcgtgctgcatgatgtaccgcatcccggtgatgtattcgccgtcatgctgagatgcacgactgtaaggcgggttgccataggccgcgccatggagttcttcgagccgggctgaccagtcctgcgccagagcattgtcttcggcagtatagaaatcagggcactttgagttttcaccgtcggtaaacagatcgagcaccagcgggccgaacatggcgttgataccccagaagatgttgtctggtgtgcaccactgatcgccaacatatttgagttcatgcgtgggctggctgcgcagttcggcaagcgcctggcaatatttgttatgcatcatcagttcaccacctgaaagccctgaggccgttgtgagtaatcggtaccggaatagctcgacttaaacatcggatcttcttttgccgcggcggaaggagggattaaccagtcgtcatcatagtggccgtcagggccgaaaaatgttttagcctgtttgacaaactcggtaccgatcttgcctgtttggctgacaaatttggcatagcgtttaacgccttccagcatgacgagaggtgctaccccttcccgaacgcgggcatcccaggctttcagcgcagcacttttcgagttaccacctgcccgcttcggatataacgcccaggcctgatcaaataagttttcattgactggttcattgactggttcagataagtgactgattccgggtgcagctcctgcaccactaaccggtgcagcaggttcaccacctggtgcagcaggttcaccacctggtgcaggagattcaccacctggcgcagcctgtgcaccagagggtgcagcatttgcaccagtacgcagattgagtttgtaaacgtttgtgcggttaagcccgtttgaggacttacgttcttcaaccgaaaccagaccatcctcgaccagctgcttgatatggttttgcacagaccgctctgaaatctcacactgctcggcgatataaggaacggaaggccagcattcgccctggtcgctggcattatcggcaagtttgatcagcacaagcttgcgcagtggatttcccactttagctttcatggctctgaccattaattccatgctcatctggacctaccttaatttccctgaaatcacgcataaagatttggagcgggctgaagcattcgtgtgggtagccagaacgcagatagataacccggtgcgactctggttcccagcggatgacacggacgggtatgccccggcggtctttaaaccacctttcgagttcgcgcataacgctttcgccctccggtaatacacacccacgattgcctgcgcgcggctgtggttacacgccacccagcggtttgatattctgcgttcataccgaaacagcggctgtcccggcaccgggatcatccgcagttgcggtaagcggttatttaccgttaaactgttcatgcgttagtttctccacgttacgacacgccacgacgccaggggctgcacactcgctggcgtcactcttttctggcgcacaaaaaacgcgataaagcagcgttaaatgctcctgccacttagccattacctgatagctgttctcttcgatttgagcgcgttctgcctggtcaataactccgtcggctgtagcctgtcgaacgaagcgcgagtgctcactgatccattcaaaggtttccatgagacgctgattgatgtcggcgttatccacgtcttcgatgtccaccagcggaacattaacgctgttggactggcgtgataccgcatcggcaatgtgcttggtgccgctggcctgctgcagtaccatcgcccagcccattggaaagatctgatcgcccccggtgcgcaggcggttaaacagcgcatcttcggtaacgccaagccattcagccgcttcggcgtaaccacccggcaaactggaaatggtctttttaattgcggtcaccaaccacgcgggctgcttttcgacttgccagtgttgtttatccacggttaactccttgatgctgtggtgtcttttttccacgttcacagttactgtttcgggtagatgtcaggccgcaaatctgatttggttattgcgccggacgtgatttcttcgagctttttggcgagggagaagcctgcctttttgtagccgttgaaaaccaagcgcaggtaaccgcgagtcgatttaacgcttacagctaattcgcactgctgctctttggataaagagtcccaatactctttcataatatgtacctcctgtgtacatattacacgaataatatgaacccacaaggtacttgtacccttaaggtacacaatgtttaattctgggatgaaaacgattcaggaaattaggcggttaaacgccagaaaactgcgtgacggtgtcggcgggaacacttacttcgccaccatgatcgacagagaacctacccagaccagcaggtttatgggggatggagcgtctaaaaatatcggcgatgcgatggcgcgccatattgaaaaatgtttcaatttgcctttaggatggttggatcaggaacaccaaactactaacgttgcaaaaagtcctgacgtatcagacactaatagaaatattacattagttccggttatttcctgggtgcaggcaggagcatggacggaagctggctttgctgaggtggacttgagtagcgttgaaacttatccgtgccctgtgccgtgcggccccatgacatatatcttgcgtgtgattggcgactccatgatcgatgagtatcgacctggagacatgatttttgttgacccagagatcccggcaagtcatggcgatgatgtcatagcgcttatgcacgattccggagaaactaccttcaagagattgattgaagatggttgcagtaaatacctgaaggcattgaatcaaagctggccagagccttacataaagatagatggcaactgctccataatcggaacggtgatcttctcaggcaagccacgacgatacctccataaaaattaattttaacttgtgcccgcgttaagcgggtttttttatgcttgacaatgtacccatgcggtacataatgtacctacaagcaacagcgataggcaggacacccacgaagtagctgccggtggcgtatgaatgaccggatgattcgcacacaacaggaaagagcattggttggaacgcacatagaagcttcgttgtccgggccagtggctggggaagaatccagtacaaaccgaccggcggccagatcggtgccaggttacgcaatgctctttccgttgtgacgtgttcaagcgaactgcagcgccggccgacgcaaagacccgtaatcggctgagtcacaggcactggtgaccaataccaaaacagagcggcgggaagtaagcgggtgtagcgccccggtgtcacaaccaaaattccaataaaacgaacgtgtgtagtctgttggcggcgtctgatcttattttcccgtgagggcgccgcacttttttacccaacacacaagagcatcaccgggcgacgggctcataacccaatccacccgggcggatcccccaaccgcaggtgctcttctgtgttgtgtggagaaactaagccgtagcgcctgtgcagtggcgctcagaggacaacctaatgaataacccgttcttcaaaaacctgctggcttatcgcctcagccgcgatgtgatcatcgtcgacaacaacggcacggcgaagctggcgcagcagcttgaggcgttccgcttcactccctgcggtagccaggacttcgctaaggctggctgggtgtcgccgatgggcgcgctgtcggatcagctgttccacctcactggcggccaacttctgttggtaatccgtcgcgaagaaaaaatattgccgaagccagtgatcaccgaggagctggacaaaaaggtagcgaagctggaaggccagcagaaccgcaagctgaagaagaccgaaaaagactcgctgcgcgatgaagtgctccactccttgctaccgcgcgcctttactcgcagcagcatgatccgcatctggataaacctcaacgactccctggtgctgatcgactctgccagtgctcgacgtgcagaagacgcgctggcgctgctgcgtaaaactctcggctctttgccggtggtgccgctgacgatggagacaccgatagagctgactatgaccgaatgggtgcgctcaggatcagcgcctcagggatttgctctgggagatgaagccgagctcaaagcgatcctggaagatggcggcatcggccgcttcaaaaagcaggagctttccagtgacgagatcacctcccacttggacgctggcaagctggtcaccagactggcgctggactggcagcagcgcgtcgattttgtgctgagcgatgacgcggcaattaagcggctcaggttcgccgatgagctgcgcgaccagaacgacgatattgatcgggaagatgccgctgcgcgctttgacgctgactttgtcctgatgaccggcgagctggcttcccttctcaataacctgactacggcgctcggcggcgaagccaaacgataacccctaagcagtgacctaccccatcgcaatgggttgggttgctgcaaccaaaattcggcgcggtgcagcgcgaaataacacggagaactaacgatgtcctttattcaaaccctgagcggtaagcattttgattacctgaacgcgcaaacagacgatgttgatattgaggacatcgccactgccctgtccaatatttgccgcttcgccggtcacctgccggagttttacagcgtggcgcagcactccgttctgtgcagccagatcgtgccgcaggaatacgcctttgaagcgctgatgcatgacgccgctgaagcctactgccaggacatccccgcgccgctgaaaaggctgctgccggattaccgccggatcgaaacgctcgttgatgacctgatccgctctaagttcgggttgcccctgcatcagtccgacatggtgaaatatgccgatttggtcatgctggcaaccgagcgtcgcgatctggaaatcgacaacggtacgcactggccgattctcgaaggcataccggcatccgacctcatccagatcaatccactccgcccgggtcaggcttatggcctgttcctgaaccgcttcaatgaactgagcgaggcgcgccaatgaaagagcaaatggcaaaaatgaccatcattgagctggtcagaacggcgcataactacgccaccagcattaagcagactggtgtttattccgatttagtgggtgaaatagcttcccggcttgaagcgcttaatttggcgtatatcggattaacgaaaaaaagtaatggaatgcaatcagagcgcgatcagctgtcagcacagcttgcggatgtggtggctgagaatgcggagctgaaggctgcaattcagtcgcacagtgaatccgtccacttctgcgagttatgcggaaaagacgacccttgcagcacagatgacatttgctatgtgctcaaagaaactcccgccacggatcgcttcctggccgagcagcagtcaatcggcattcagaaagcggcggacagtggcttgttcagcaactgggttaatcaatcactcatcagctttgcgattactgttcgtaatggtgacgacttcgccgcccagctgcgcaacgaggtgaaggtatgaggccagatgaagatttagaccgttgtccacgctgtaaagaagacatgtgggtaggtcaaaagctttgccggatatgccagagcgaagaagacctggaggatgctgcatgcggcgacggcaacccctttgatgacgattattacgtcgaggtgaagcatgactgacatcaccgaactgacggcgaagctgaaagcggcggcgctgaaagcaacggcgctcaatcttgacactgcacaagttaagaggggcaacggtgggtatttagaatgcccatgctgcgaaggcgctggctacgtcgaagaagaaaatgacttctgcaacatcgacggcgtggcacttggcgtccaattctacggaataggcccgcatcacggcctggcagaagaatacttacgtgaagccaaccccaccaacatcctggcgctgacagaggcgctggaagccgcacaatctcgcatagctgagtttaaggcacgtgcggaagccgcagagaagcgctacgaaaaccgcacgccgacagagtgggcttacggccaggcatgcgcggccattgagaatcatcgtgctcgcgctgatgcagcggaagccagaatctccgagcttgaggccagaacgctcaccgtgaagctgccacgccgtcgcacatatgaagactatgcggatgccaggttcagcaatgcggatttagcggcaatccacaacgtcacggtttcttcgatgatccgaatatttgaagaaaattgcgccgccgcgggcatcagcctgaagatagagggggagtgagtatgtccagtgttatcaaaatggagtgcgtgtactccgaaaagaccgagtggtttactcctggagaaatttacgactctgaaaagcgcggcccggatacctgcttatgcggtgacaatcttgtttctgaccttaatcctgaagactggtacgaaatgagcttacgcgctgacggattatggttcctgaccggatttcagcagtcaacgctgtttcgtgcaattgaggactaacccatgacactgaccagagaaagactggaagaaatccgcgattacgacacttgcgtaacgctggaggagtcagcagaaatggcccgccgcctgcttgcggtcgaaggtcaggagccggtggcgtatttgtaccgcgataagcttcacgctgatgcgagatttagcctggagccaagatttggtaactggtcaccagaagacatcaacgagtacgaaattacggaaactaagctctacgcctccccgcagccagcaccagtagcgcagccggaattgacagtgtggtatggcgctatgccggagagcaacggcaaaaccaactggacggcaattctgcgtcgtaaagatggtgggtgcagagtgttcacaattgactgctcggaataccctgaccgcgtgcgctatgaagcagatagaatgcgctggatgattggtgaattgccagaagaaccagacattctggcttatgacgagcatctgcacagtggctatgtgccaccagtagcgcagccagtgcaggtgcctgagcctattaaacgtaacgatgcggacggatggtggatgtacaaagggcgtcgagtcggtggcggctgtgctgagtggtacaatcgggcgcttggagactggcgcgccgccatgctcaaagccgaacctgtaagccagccttacaagttgcctgaaggttggaagcttgtgcctgttgagccgacagcggaaatgatttcttccggtatagcggcccactacgaacgcagccaaattcaaatccacgacaggccggcgccggggccaatggagtgcgcttatgttgccatgctcgccgccgccccacaggagccaaccaaatgaaccacttaatgattgacctcgaaaccatgggcaacaagcccaccgctcctatcatctcgatcggcgccgtgctgtttgaaccctctaccggcgagctggggccggaattttatgccgtcgtggatctggagagctctctggtgggcgatgcagtggccgaccccagcaccattctatggtggatgaagcaaagcgcggaagcgcgggcggcgatcaccagcgataaccgcatgcatatcactaatgcgctgggcggtctgagaaggctgattgatgaaaactgcattcttagagacctacaggtctggggtaacggggcgacattcgacaacgtgatcacccgggcctcattcgaacgtcatggtttccactgcccctggcagttttggaacgaccgcgacgtgaggacgattgtcgagctgggtcgcgctgtcggctttaacccacgctacgagatcccctttgagggtgatatgcataacgcgctggcggatgcccggcaccaggcgaagtatgtttcggcaatatggcagcggttaattcctgccaccagcgaataaggttaaacacccgggtgcagccgggcaaagtggaggtaactatgcaagaagtgattcagttagcgcctaacgagtgggtttgcgaaagtgttcttatcacggtgaccgggctgaagccggggaccatcctccgggccagaaaagaatgctggatggttggacgggaatatattcacgtttccccggatggcaatccgaaaccatccagtgagtgtatgtataaccgcaaggcagtagatgcgtgggttgcctcgctcagaaataaacaacctgggtgatttgataccatgaaaaaggtaagctcacatcgctcttgggcgtcgggagggaacgatggttaaagccatatatccgacaggcgtcgaaaaccacggtggctctttgcgcatctggtttacttataaaggtaagcgtgtcagggaaaacctcggtgtccctgacaccataaagaacaggaagatcgccggggaactgaggacatcggtatgtttcgcaatccgcacagggacgttcgactatgcggcacagtttcccgaatcacctcacctcaagacttttggggtaggcaggaaagaaattacagtgaaagaactcgcagaaaagtggctggatctgaaaaagatggagatttctgcgaacgccctcaatcgctatgagtcggtcgtaagaaatatggtgccacggatcggagggggcagactggtagccgcggtgaccaaagaggatctactgtacatcaggaaggatttgcttaccggccatctggcaggactgaaaagcgattcactgaccaaaggcagaagtgttgttaccgtaaattattacatgacaacaatcgcgggaatgttccagtttgctgcagatcatggctacataaagtcgaatccgtttgaaggtattaagccgctgaaaaaagccagggtagaacccgatccgctaactcgtgacgaatttatccgcctgattgaagcatgccggcatcagcagacgaaaaacctgtggtcattagcagtgtacacaggggtgcgtcacggggaactgctctccctggcctgggaagacatcgatcttaaagctgggacaataacaatccgccgtaattatacgaaactgggtgaattcactctaccgaaaactgatgccagtacgaacagagtgatccacctgatagagccagctgttagcgtactgaaaaaccaggctgaaatgacaaggctgggcaagcagcatcagattgatgttcagttgcgcgaatatggccgtgcggagaagcacgactgtacgtttgtctttaatccgcagttggtcaggcgcagcgatcaggtaggttttgtgtataaggtcgattcgataggtgactcctgggacgcggcggttaagcgagcaggaataaggcacaggaaggcttatcagtcacgccacacttacgcgtgctggtcattatcggctggcgcaaaccccagcttcattgccagtcagatgggtcatgcaagcgcccagatggtgttcaatgtgtacggggcctggatggctgacagcagcacagagcagatagcgatgctcaaccaaaagcttggcgactttgccccatcaatgccccatcgcccacaaggcagtagtggagcatttttaaaatcagtaagttagttagtgttgcccgccatgtcaactgcgtggagggtaacaccaccctctacgccctgccgaaagcggagatcgtcacccgctggcgcgagcagactcatgatgattttcgcttctgctttaaatttccggccaccatttcccaccaggcggcgctgcgcaactgcgacgatttaacccaggaattcttcacccgcctgtcccctcttgccgatcgtatggggcagttctggctgcagcttccggcgacttttggcccgcaggcattacctgccctgtgggaatttctggatggcctgccgaaaacctttacctatggcgtggaagtgcggcatggggaatttttcgtcaaaggcgaagcagaaacgcagcttaaccgtggcctgcatatgcgtggcgttaaccgggtgattttagacagccgaccggtgcacagcgcgatcccgagtaaccaggcgattattgacgcccagcgtaaaaagccaaagctgccggtgcacgcggtagtcaccgcgcaggatcccatggtgcgctttatcggcagcgacgacatggcgcaaaaccgcgcgctgttcgacgtctggctgcaaaagctgccgctgtgggagcaaagcagcacgccctggctgtttttacacacgccggatattgcccaggccccggaactggtggataccctctggtcgtctctgcgcacggccataccgtccgtcggcgccgcgccctcaattccacaacaatcctctcttttctgaagcagtcgcgctatcatagaggtgtgccatctttgtacctttaacggagttgttatggttagcgcgctgtatgccgtgctgagcgttttgctgttgatgaagttttccatggatgttgtacggttacgcatgcagtaccgcgtctctttgggtgacggcggttttagcgaactgcaaacggcgatccgtattcatggcaatgcggtggagtacctccccgccgccctgatcctgctgctgtttatggaaatgaacggcgcagaaacctggatggtacatttttgcggcctgctgctggttatcgggcggctgatgcattactacgggttgcaccaccatctgcttttctggcgtcgttctgccatgagcgccacctggtgcgcgctgatcctgctggtgctggctaacctgtggtatatgccctgggagttggttttctccctgcattagcgcacaatacgccacttttgttttctcggatttttacgttatgcctcaccgcgacacgcttttttctgcgccaatcgccagcctgggcgactggacatttgatgaacgggtagccgaagtcttcccggatatgatccagcgctccgttccgggctactcgaatatcatctccatgatcggcatgctggccgggcgtttcgtcacgccggatacccaggtctacgatctgggctgttctctgggcgcggccaccttgtctgtccgccgtaatatcgcccatgagggctgcaaaatcattgccgtggataattcaccggcgatgatcgaacgctgccgccgccatatcgaagccttcaaagcgccaacgccggtagaggttgtggaaggcgacatccgcgcggtgcgtatcgaaaacgcctcaatggtggtgctgaatttcaccctgcaattccttgaacctgctgagcgccaggctttgctggacaacatttatcagggcctcgtcccgggcggcgcgcttgtgctgtcggaaaagttcagctttgaagatgcccaggtcggcgagctgctgttcaatatgcatcacgacttcaagcgtgctaatggctacagcgagctggaaatcagccagaagcgcagcatgctggaaaacgtcatgctgacggactcggtggagacgcacaaagcccgcctgcgcaaagccggttttgaacacagcgagctctggttccagtgctttaactttggttcactggtggcgctgaaagccggggatgcgcaatgatcgacttcggcaatttttatcagcttatcgccaaaaatcacctctcccactggctggaaaccctgcccgcgcagatcgccagctggcagcgcgacgccctgcacggccagttcaagcagtggaataacgccgttgagtttctgccggagatgactccttaccggctggatctgctgcacagcgtcaccgccgaaagcgagacgccgttaagcgacgggcaaatcagacgcatcgaaacgctgctgcgcaatctgatgccgtggcgcaaagggccgttttctctctacggcgtggatatcaataccgaatggcgctccgactggaaatgggatcgcgtactgccccatctgtcggatctgaccggacgcaccattctggacgtcggttgcggcagcggttatcacctgtggcgcatgatcggcgcgggggcgcacctggcggtgggtatcgatccgatgcagctctttttatgccagttcgaagcggtgcgtaaactgctgggcaacgatcagcgcgcgcatttgctgccgctgggcattgagcagctaccggcgctgaacgcctttgacaccgtattctcgatgggcgtgctctatcaccgccgctcgccgctggagcatctgtggcagctgaaagatcagttggtgaaagagggcgagctggtactggaaaccctggtcatcgaaggggatgaaaatgccgtgctggtgccgggggatcgttatgcgcagatgcgtaatgtttactttatcccgtcggcgctggcgctgaaaaactggctggaaaaatgcggctttgtggatgtgcgtatcgccgacgtcagcgtgacctccattgaggagcagcgccgcaccgactggatgatcaccgaatccctggcggaattcctcgatccgcttgatgtcagcaaaacggtggaaggttaccctgccccgcagcgtgcggtgttgattgcccgcaaaccgtgatcttgcggcggacgcccgcccggcggcgcaggcttgccgggcctacacgttaactttacatctttttccaaacgggttcggtttgcaacaaggcggcgacgcagcaaatccccgggagcttacataagtaagtgaccggggtgcacgaggaaagccaacgcagtggcaggccgaaacaggctggaaaaagacaaaaaaaggcccctgttgaaattgcaggggcctggtacaagcaagcatcacattgggcgacatgatgcgcggtaaaaagggttaacgaaggcgatgacgggcgatcatcgctttcatctcagaaaccgcgtcgccatcaacgccataacgggaatactcatccgcgctggcatccgaagacatcgacaatcctgaatgacgataacgcattggtgacggcgtccatcttcccgctgaactgtgaacctccgcgatacccgcgtcgagaaacagttcaaggttggaagggcgaacaccagcaccggccataatgattggaacacgggagtgtgcttttagttccgtaataaatgaaagtccttgctccgccgacgcctgctgacccgacgtaaggacgcgcgccacgcctgaatccgccagcttttcaaaagcttcgatggggttctggcacatatcaaatgcacgatgaaaagttaccgccatctctccggcagcagccattatttgccgcatccgcggcaaatcgacgttgccgtcctcatccagcaccccggtgaccacgcccggatagcccagcgatttgataaaacggatgtcttccagcatggcgctgaattccgcctcgctgtagcaaaaatccccgccgcgcggacgcacaatcggatgcaccggaatagtcacgctttcccgcacgcgttttaacacgccgtacgagacggtcagcccgccctctttcggcgcagcgcacagttcaatacgatccgcgccgtgccgttcggcaacgatcgcgcacgcctcgctgtaacaacagatttccagtaatgccacggttttctccttaaacgctgtgattaatgctcgctggcgacgatctcctcaatcgaccagggatggaatttgatcgtcaccttgccgtcgctgaccgccagcgtcggattcggcagacgctcgcgctccccttttggcgaactggttttcacaacaatgcccggctggctcaggccctcgtccgccagtagcgccagcgcacgggcgttaaggctttgcggatcgccgggcaggacgatttcgatatgctcccagccctcatggggatagcgtttttcgccgggccacggcagctccaccactttaaactgccagtgcgctaccgtcaccggctcgtgcagcttaaacaggcagatggggcgtccgttgatcagcgtttcgctgagtaactcgccgcactgctcaaggcccgtccgccagcgttcggcagtggcgttctgatgacagcgcagggaaatgtgatcggcatcaaggggtgcgatatccagaccgagccgggtggcaagttctgttaacgccagggtgaagcgcggtaaatccgcggaaatatcatgcagttcatcaattgtctgccagtgtgccatcgtcagtgcctttcacgggtcgcaaaaccgctaatttaccctgttgccggtggcttaccaaccgctgatttacagcaggcgcaactgaatgattattcatggatctgccgcgatttatttgcgcattctgcacccggtcgcagggctgacggcaggggccaattgcagtatactcccgcctttgatgatcaacatccgggtgcagccagcccttacgcgctgcgccattaaccaaaggtatcacggtgaatattcaggctcttctctcagaaaaagtcagtcaggcactgattgccgcaggcgcgcctgcggattgcgaaccccaggttcgtcagtcagcaaaagtacagtttggcgactatcaggctaacggcgtgatggcagttgctaaaaaactgggtatgcccccacgacaagttgcagagcaggtgctgactcatctcgatctcagcggcattgccggcaaagtggaaatcgccggacctggctttatcaacattttccttgagcctgcgtttctggcggcccaggtggatcaggcgctggcctccgatcgcctcggcgtttcccgccctgagccgcaaaccgtggtggtcgattactccgcgcctaacgtcgccaaagagatgcacgtcggtcacctgcgttcaaccattatcggcgatgcctcggtgcgcacgctggaattcctcggccataacgtcattcgcgcgaaccacgtcggcgactggggcacccagttcggcatgctgatcgccttcctggagctgaagcagcaggaaaacgccggtgaaatggcgctggcggatctggaagagttctaccgcgcagccaaaacccattatgacgctgacgaagcctttgccgaacgcgcccgtaactacgtggtgaaactgcaaagcggcgacgaatattgccgtgagatgtggcgcaagctggtggacatcaccatgacgcagaatcagatcacctacgagcgtctgaacgtgaccctgacccgcaaagacgtgatgggcgaaagcctgtacaacccgatgctgccgggtatcgtggccgatctgaaagagaaaggtctggcggtggaaagcgaaggcgcaaccgtggtcttccttgacgagtataaaaataaagaaggcgagccgatgggcgtcatcatccagaaaaaggatggcggctacctctacaccaccacggatatcgcctgcgcgaaataccgctatgaaaccctgcatgcggatcgcgtgctctattacatcgactcccgtcagcaccagcacctgatgcaggcgtggaccatcgtgcgtaaagccggttacgtgccggacagcgtgccgctggaacaccatatgttcggcatgatgctcggcaaagacggcaagccgtttaaaacccgcgcgggcggcacggtgaagctggcggatctgctggatgaagcactggagcgcgcgcgtcgtctggtcgcggagaaaaacccggacatgccagcggacgagctggaaaaactggctaacgccgtgggtatcggcgcggtgaaatacgcggatctctccaagagccgtaccaccgactatatcttcgactgggacaatatgctggcgtttgagggcaacaccgcgccctacatgcagtatgcctacacccgcgtgctgtcggtattccgtaaggccggtctggatgaaagcacgctgagcgacgcgccggtgatcctcactgaagaccgcgaagtgcaactggccgcccgtctgatgcagtttgaagagacgctgaccgtggtcgcccgcgaaggtacgccgcacgtgatgtgtacttacctgtacgatctggcgggtctgttctccggcttctatgagcactgcccgatcctgagcgcggaaaacgaaaccacgcgccagagccgcctgaagctggcgctgctgacggccaaaaccctgaagctgggtcttgataccctgggtatcgaaaccgtagagcggatgtaataaaaaaccccggttcgccggggtttaatttttgcaggtctgataagcgaagcgtcatcaggcgttttccctggtggcgcgtggcttaccggggctacaacctcagaagtatttgcgcaaatactccgtcagacataacatcgccatcgcctggccgtacggcatggacgtgcgcggaatattgcggtagaaatccagatccgatcccattccggtaccaaacgacgtctgcaacagctccccttccggcgaaatgttattcacgatacctttaatggccttctccgccacctctgcatattcctggctgatataacgcttacgcaccgccttcagaatgccataggcaaaacctgccgtcgctgacgcctccagataagagtgcggatcgtcgagcagtgtatgccacaggccgctgtcatcctgacatttcgccagcgccgccacctgcgcgttcagcacctgcaccagataacggcgcacggcgttgttttccggcagatccaccagctccaggaaatccgggatgacgatggtcagccagctgttgccccgcgcccagcgcgctttcgcaaagttatggttgccttcgtaattccagccgtggaaccacagcccggtttccctgtccatcaggttctgcacgtgcagcaggaactgatacaccgcctcttccacataggccgggcgatccagcagcttgccgattttcgccagcggcagcacggtcatcatcagcgtgtcatcccacatctgctgatgattttcctctgccagggtgatgtgctgcatgccgccatgttccgtacgcggcatctcgtgcatcgcccactccgcccagctttccagccacggcagatacgccgggttgcggttttcctcatagcggtacgccagcgtcaggaacggcgccatggtgttgacgtttttggtggtcgccccttccgcaaagcggtcggcaaaccaggcatcgataatatcgcgcatcgccagatcgccggtctgctggtagtactgccagatgccgtaaaggccgacaccgtgcgtccactcccagcccgcccagcctttggtatcaatgacgcgcccgtcatctaatcgcagtaagaactcaccggattcatcccgaatgttgaccaggttatgggtcactttctggatcagtgccttcagctcatcccgggcgataaaacgctccggctgacgcagtaaagggctatatttgacaggataaacaatcatttacttcacctcctgagtattgtattcagtcgctgcgcgggctttaagagagcccggggctggcttattgcgattcagatagccaatgttgttattgccccacagggattcgaacggcatacccgccagcatttccacggttgcacgcgcctgcggggtgacggtttccggcatcacgcggcctgtctggcgcattttttcggtttcttcccgcagcacgctatgggttttcagatttagtttgaagcgcagtgagaccaggaagccgcacagcagcaccgccaccgtaccgaagcagaggatcatcagaatggtatggctgacagattccacctgggtcttctgaccagaaacaaagccggacgcctgcatgatgatccccaccagcataatcgcacccgcctgggaggctttacgtgtcagggtcatgatgcccgcgaagataccttcacgacgctgcccggtgatcacttcatccacgtcagcgatgtaggtataggtgttccacggcacgtagttgatgccgccacgtcccagaccagcaatcgcagaaatcagcagcagcagcgaataaatgtcgctcatcccggcgtaataaagcacggcgtatgaaacagagctgagaccgaacagcaccaccaccatgcggtaggacggcgctggtccgaaacggatacacagcgggatcatcatgatgaccgcgatgaactggaagatcgccatggtgcccagcaggttcgacgccattgacgcatcctgcatcagcacgaacaccacatagtaagtaaagacggcgttgaagacgtcctgcgcgatatagccgcccaggtacatgcccaggtgctgacggaaaatcttgatgcgcagggtggagcttaactccgtaaacagacggctcatgctctggccgaaagtaaggtgttttttctcctcttctgcacgcagcgccgcttcggtccagtcttcacgcggccgttcccaggtgaagaaccagacaaaggtaagcatcagcgcgcacagcaccgagaacaccaggctggcataaaagaaagaaaccggattgtctttaccgaaatgggttaacagaatgcccggcaggaaggacgccagaatagcggacatctgcgccataccgatacgcgcgccggagaatttggttttctgtttgaaatcatcggtcatctccggcaccagggtttcataaggcacgaggatcatggtgtagacgatgtcgaaaatcaggtaggtcagcaggtagtaccagaatcccatgtcgccgacccacataatggagtagctaaacacggcgggtataccgagcaggataaagaacttgcgacgaccgaagcgtttacccagccaggtcgaaccaaagttatcggttaaaaagcccatcagcggactgatcaccgcgtccagtacccttgcggtggcaaagataaaggtggcttcgataggcgttaagccgcagaaggtggtgtagaagtacagaagccaggccgcagtcagcgctgtggtgcccgctccaagaaagtcacccgagccgtaggccaggtagtttgccagtccaattttacgtgtcttcattgccgcaaaccctttttgttattgggagctctcaggcaattggcgtagcctgaaaggaacattacacggctaaagtagaattatgttatgagagaaacctttctgtttctgccagggtactgacgcaactggcaaaaatgcaaagagtctcatcatgcgtgtcactgatttataaaacagtgtttctcgcggttcaaaaggcggggccgaaatatgagagccagccaccggattgcggaagaaatcaccagtggcgggttaaaagacgggcatttagcggtagttaacaatcacttcattgcggctgactttcagcgccgggatcagcctgccgccgccgggcacttcccagataaagcgtaacggctcggccgccggaacattggcgaagcccatggtcgtaccgctttcgccgtccagctccacgcagcgcgattgcgaacacaggcgcaccagcaggcccgccggggtcgggccgttaagttcgtagcgccaggccaccagcgtcatcagaccgctggctggctgcggggcggacagcggctgcgatgacgccgcctgcccacggtgactgagcgtgatgccgatactgctggcctgccacgccccctcacccgccgcctgggcgaacagcggcagggcgattaaccaggcaagatgacgcattatttgcctccgatggtggcggtcatgcggatgctgcggttatccgacagctccatgttggacagcaccaccagctgcggcagactgcggcgcaggaagcgcgacagcaacggacgcagggcatggttgaccagcaataccggcggcgcgccaagcatctcctggcgctgcagggcttcctgggtttgcgccagcaggcgatccgccagacccggctccagaccgccaccgccctgcagggcctgcaacagcagacgctcaagcggcgtatccagaccaatgacctgcacttccccgctgccagggaaccactgctgggttatggcgcgacccagcgccacgcgcacgaccgtcgtcagctcatgaggatcgttctgtaccggcgcatgttccgccagggtttccagaatggtgcgcatatcgcggatcggcactttttcttccagcagattttgcagcactttatgcagcgtggtgagcgtgaccacgcccggcaccagatcttccgtcagcttaggcatctcctgggtaacacgatccagcagttgctgcgcttcctgacggccaaacagttcagatgaatattgtccgatcagatggttaaggtgagttgccaccacggtgctggcttccaccacggtataaccctggatctgcgcctgctctttcagggcgctttcgatccagatcgccgccaggccaaaggccggatcgacggtctgctcgcccggcaatgtgcccgccgcagtgccagggttaatcgccagccagcggcccggataggcgtcgccgctgccgatctccacccctttcatcagaatacggtaacgcgcgggcggcagatccatgttgtctcggatatgcaccaccggcggcaggaagcccatatcctgcgcaaatttcttacggatactgcggatacggcctaacagctcgccatcctgctgcatatccaccatcgggatcagacggtagcccacctccatgcccaatggatcttccagctgcacatcgccccaggtggcttccaccgcctgagtattttccggcagcttcacaggcgcggcttccaccggtgcctgctgctggcggccgcgcagccaccaggcgagacccagtaacgcgccggtaaacagcaggaagacaaagttcggcatccccggcaccaggcccagcagacccagcaccgcggcgcttaacaccatcacgctcggattggtgaacagctggcccaccatctgctggcccacatcttcatccgtagccacgcgggtcacgatgacgcccgccgcggtggagatcaccagcgccgggatctgcgccaccaggccatcaccgatggtcagcagcgtataggcttccgccgcatgaccgacatccataccgtgttgcagcacgcccaccagcaggccgccgatgacgttaatcaccatgatcaggatgcccgcgatggcatcgccgcgcacgaatttactcgcaccgtccatcgagccgtaaaaatctgcttcctgggtaacttcagagcggcgttttttcgcctcttcttcgccaatcaacccggcattaagatcggcgtcgatagccatctgtttgcccggcatcccgtccagtacaaagcgcgcgcccacttctgcaatacgcccggcacctttagtgataaccataaagttgatgatcacaaggatgataaacaccacgataccgatggcgaagttaccgcccacgaggaagtgaccgaaggcttcaaccactttacccgccgccgcgccgccggtatgtccgtccatcaggatgatacgggtggaggcgacgttcagcgccaggcgcagcaaggtggtgaacagcaggatggtcgggaaagcagcgaactccagcgtacgctgggtgaacatcgccaccagcagcaccatgatcgacagcgcaatgttgaacgtaaataacaggtcaagaatgaacgccggaagcggcagcaccatcatcgacaaaataagcatgatgaggatcggtccggcaaggatctgccattgaatcgacttcatgttgccaggcaaacgcaattttgccaccagattattcatcagtgtccttctcgttcataaaatccagcgcttcaggcaccggaagatttgcaggtttaacaggtgcagtaccccccgccagacgccagcgtttcagctgccatacccaggccagcacttccgccacggcggcataaagctgccccggaatctgctgaccaatttccgcatggcgatagagcgcacgggccagcggaggggcttcaagggtgggaattcggttttcgttgccaatttcacggatgcgcagggccaccagccctgcccctttggcgatcacttttggcgcgctcattttgttttcgtcatacttcagcgccacggagtagtgcgtcgggttggtgacgatgacgtcagccgtcggcacatcggccatcatgcgacgacgcgcggcggcacgctgcatctgccggatgcgccctttcacatgcgggtcgccttcggtctgtttgtactcatcgcgaatatcctgacgggacatgcgcagtttcttaaagtggctgtagagctggaagcccacgtcaaagccgaccatcggaataatgctcagcaccaccagcagcacgcacatgcccaccagatcgagggcattgttcatcgccgtggtcggcgcttcgctgaccagacgcataatttctggccacttattccacaaatagagtccggcgaccccgcccatcagcactgatttaaggacggctttcagcagctcggccccgacctgcgcggaaaacaggcgtccgataccggtaataggattgagtttggaaaatttaaacgccagggatttggtgctgaaaatcagcccgccgagcagcaccggcgacaccagcgcaatgatcaccaccccggtgatcagcggcagcagcgcataaatcgcctctttcaccagcaaaatcacctgacccaggatcagcttctggtcgttaatgatgccgtggtcaaaccgcaagcctgacgccagtagccccgccagccgtcgggcgatcgactcaccgccaatccacacgatacttacgcccaccactaaaatcagcagtgacgtcagttctttggatcgggggatctgcccttcctcacgcgctttgtccagtcgttggggtgtgggggcttctgttttgtcgtcgctatcttctgacacagccgaagttccggagatataggtttgtagcatgatgccagagagaggccgccgcaatgggcagataaacgcgactaaaaggcggttttttcaggcgataagaaccctgcggcgtgtcacgcagcatcgggataatgcagagagtggagggtaaatccattaaccccactccccgcctgccggagtgcgcaggcggaaagcgggattgtcgatcagaaaccgaggctgtccagcaggtcgtcgacctgatcctggctggccacgacgcctgctttggtggtgtccagttgcggaccgttcagcaggctgtcgttttcacgtttggcgcgtgctgccggttccggcatgttatcgagcagcaccatcagcagctgacgctcgatttcctggatcacgtccatcatgcgcttgatcacctgaccggtcagatcctggaaatcctgcgccatcatgatgtcgagcagctgggcgttggtgaagctggtatgacccggcacgtcgcccagatactgacgtgtatctttcaccagttctttggcatccgtcagctcgataggattctcgaaccactcatcccagcgtttggtcagggatttcgcgccggattccatcgcgtcctggtgcggctgcgaggcttcaacgctgttcagtgcacgttcggcggcctgcgccgtcatctgcacaacatagtcgagacggtcacgcgcatccggaatggcttctgccgcttcggcaatcgcctgatccagacccagctcacgcaggctgtcacgcagcatacgcgtcaggctgccgatgcgggcgataatgtctccggcagcgttttcgtctgccggtttaatctgcgattgatgcatcattatcctgccctcacatgccaagtttctcgaagatcttgccaagtttctcttcgagtgttgcagcggtgaacggtttcaccacgtagccgctggcgcctgcctgcgcggccgcaatgatgttctcttttttcgcttccgccgtgaccatcagcaccggaagcgacgccatgttaccgctggcacgaatggtttttaacagttccagaccgtccatgttcggcatgttccagtcagaaatgacaaaaccgaaaccacccgcctgcagtttattcagcgcgtcaacgccatcttctgcttcttcgacgttgttgaaacccagctctttcagcaggttgcgcacgatgcgacgcatggtggaaaagtcatccacaaccagaaacttgagctctttgtccgccataaaactacactcctctttaaatacgtattgcctgtccggcactgatttttgccagcatctgctggcttacctggctaagatcgaccacttcgctaacgccacccatattgatagcctcgcgcggcatgccgaacaccacacaacttgcttcgttttgtgcaatggtccaggcgcccgcctggtgcatcgctaacataccggccgcgccgtcgttgcccataccggtgaggatcacccccacggcattacgacccgcgaacttcgccgccgaatgaaagagtacgtccaccgacgggcgatggcggttaaccgccgggccgtcgtggatcttgatttgatagtttgccccactgcgcgacagctccatgtgccgatcaccgggcgcaatataggcgtgccctggcaatacacgctcgccgtcctctgcttctttcacggtgatctggcacagcttgttcagacgctcggcaaaagaacgggtaaaacccggcggcatatgctgggtaatgagtaccgccgggctggaaagcggcagcggttgcagcacatgacggatcgcctcggtgccgccggtggatgcgccgatcaccagcagtttttccgaactgagcagcggcccggcttttaaagtggcaggcgctgccgtcggcttatgcgccgccagtttcgcccgggaagcggtacgcactttttcagcgatcatttcgctgtaggccagcatgccttcgcggatccctaactgcggtttggtgacgaaatcaatcgcccccagctccagcgcgcgcagcgtcacttctgaacccttaccggttagtgaggaaaccatcaccaccggcatcggacgcagacgcatcagcttttcaagaaaatccagcccatccatgcgcggcatttcaacatccagcgtcaggacatcggggttaaattttttgattaaatccctcgccaccagcggatccggcgcggttgccaccatctccatatcgctgtgactattgatgatttccgtcattatctggcgcatcagtgcggaatcatcaacggacaataccctgattttactcatgctttttccttactcagcgcataaacagtctgcccacggagggtgaactcacgcgcgaggttgctaaaattctccgagtgcccggcaaagagtaatccgtcgggcttaagcaagggtgcaaaccgacgcagaatgtcctgctgagtcgttttatcaaaataaatcattacgttacgacaaaaaatcgagtcgaacggcccctgcacgttgtactgtttggcgagcaggttaagcggggtgaattcaatgtaattcgccagctcctgacggacgcgcaccagcccttcatgcggtccggtgccgcgcatgaaataacgctgtagttgctgcggcgacagcgttttcagttcgtccacgcggtagatgccgcttttggctttctccagcacttcggtatcgatgtcgctggcgatcactttaaagcgccccggcgccataccgagcgaatccgccagggtgatggcgatggagtacggctcttccccggtggaggccgccgcgcaccatacgcggtactcgccactgcgtttgcgggcgtggtcagccagcaccgggaagtggtgagcttcccggaaaaaagccgtcaggttggtggtcagggagttaataaacgcctgccactcagcattactctgattcgcctccagcatgctgagatagcgaccaaaatcatccaggcccagcgcgcggaggcgacggacgagacggttgtaaaccatgtcacgcttatgatcagccagtacaatccctgcacgctggtaaatcagttcacatatccgacgaaaatgcgtgtcggacaacgccagacgttgtgtcatctgtaacagcagcgatgtttgcccggtgggcgtggatgaggtcatagcgccttcttaattactctcaggttacaacgggcacggcttcagccagtgcaccagcaggtgttgaatggtgttcatcgagcttaaatacggcgaccagcgatgtcagatggtcagcctggttagccagttgttcggtggcggcggccgcttcttctaccagcgcggcgttctgttgtgtcacctgatccatctggctgacagcaagggcgacctgctcgatcccgcggcgttgttcatccgacgcggacgcgatttcgcccatgatgtcgtttacctgggtaacggatcggacaatgtccgtcatggtctgcgcggcggtacccaccagcccggagccttgctggacgcgggagactgattcttcaatcaggcctttgatctcttttgccgcctgcgcgctgcggcttgccagattacggacttctcccgccaccacggcaaagccgcggccctgttcccctgctctcgcggcttcgacggcggcgttcagcgcaaggatattggtctggaaggcaataccatcgatcacgctgatgatgtcgccgattttctgcgagctggcggcaatatcctgcatggtttgcgccacacgggacgtttgctcgccgcctttacgcgcggtttctgccgcgctggacgccagccctgacgcctgacgggcgttgtcggcgttctgcccgacggtggcggtcagctgttccatactggcggcggtttccgccagcgacgcggcctgctgttccgtacgcgccgagagatcgttattaccggcggcgatctccgcgatgccggtgtgcatggcgttgctgccgtgacgcacttcggtcacggtgccgcgcagcgcggtctgcatgtttttcaggctggcaaaaattgccgagatttcgttacggccatacaccatgaccggtcgcgccagatcccctgcggcgatgctgtcgaaatgactgctgatgatcgccagcggttgcacgatcattttgcgtgaccagaacagcgcgctggtggtcagcatcgcggcgatgatcaccacggcgataaagatcgccgccgacatatggtaatttttctgcccggcgacgctcgcggtctccacgaagctgtcgatatgcttctgccaggccataaagttgttatcaaaagccgcctgagaggtctcaaccggcgcggtcataaaatccgacagctggttattttcaagccaggtggcctgatggcttaaatcgtcatgccatgccgcaaacgcagttttggtctgctctttcagcgccctgccatcagctgacagcgtgtcaatcgccaggaaggttttcagctggtcctgcgcctgttgcagactgttatgcgccgtaaccatcagccctttaatatcttccggcggataggccagcgcggtcagcgtgcccgctttgttcagcgcgatacccgcctgtaacatcgtggtgcgcatttgcgccagggtgttacgttgcaaattactcttttcaagctgttccagatgctgatagccatcgcgaaacgcccagaacgacaacccgttactaccgacctgcaaaatgccgcaaacaatcaaaatcagaaaaagtgtggtcgagatacgaatacgattaaacattcacgctcccatcaggtggcattgccacattgctgtcacttaaaaagtttcccagttagcatcttgtccggtgtgggtctgacgcggaactgccgcctgcgggatcgccggcgacggcgcaacgcctggctttgccggtatgccgggtacagtggcaagacggaaagcggatacggccatattcagtcgactggcttgttcttctaatgccgcggcagctgccgcagactcctgtaccagtgacgcattctgctgcgtgacgcgatccatctcggaaatcgccagcgcaacctgatcgatcccgcggctctgttcatcagacgcggaagcaatttcacccatgatgtcggtcacgcgcgttaccgcattgacgatctcgttcatggtttccccggcgctttccaccagcaccgagccggtatccacgcgcgccacggagtcttcaatcagcgctttgatctcttttgccgcctgggcgctgcggctggcgagattacgcacttcacctgccaccacggcaaagccccgcccctgctcaccggcgcgggccgcttcaaccgctgcgttcagggcgagaatattggtctggaaggcgatgccgtcgatcacgctggtgatgtcagcaattttcttcgagctgccggcgatgtccgacatggttttcaccacacgatccaccacctggccgccccgcccggcggtatccgaggcgctgtgcgccagctgcgacgcctgacgggcattgtcggcgttctgcttcacggtggcggtcaactgttccatgctggcggcggtttcttcgagcgccgacgcctgctgttcagtacgggaggagagatcatggttaccgagagcgatttcgctggtgccgctgtagatggcatccgagccctgacgcacacgggtcacggtatcggtcagcgactgctgcatatgattgacgctgtcggcaaggtcagtcatttcgttgcggccttctactgccaggctttgcgtcagatcgccctgggcgatctcgcggatatggcggatcacgcgattgagcggatcgagcaggattttacgaatgccgaaccacaccaccgccagcaccagcactaacgccagcgcgagggtcgccatctgccatttggcaaactggtagtcgctgacgctttgggtaaaggcatcctgatacagcgacgcgctgagcgccgcgtacgctttcatggcatcgcccatgccgttctgcatgccctgggtcggctgcgcgaaataggcatccatgttgccgctctccaggaattggatcagctcattaagcgcggccgcgtaggcgcggtatttctcatccagcgtcaggctggcctgttccatggacggcagcgtcggcagggctttgtaggcgtcgtagtgtttcgccgcgtctgccagcgaggcatgggcgtttttcagcagatccgttttggcgctgctttgttgattattcggatccatcatcatgcgcgccgccgagcggcttaagttgatgcgcgtttgcagcatcagctcccaggcgctggtcagctcggtctgttgcgagcggagatcgttggaaacggcgaagctctgctggttctcttttaaggaagaaaacagcagaccaccggaaaccagctgcaaaagtgcgaagaccaccagcaccatcatcagcatggtgacaacacggatacggttcaacatgcaacaacaccttattgatgacttattaacggtgttatcggcacgccttaagggaactttacatttgcgaaaagtaaaaaatcagcgcagtcctaaaaagcgacgtcaacgatcaccgtatcttcataagtcccgccagggggcgttgcctgggtggtgagcactttggcggtgtaattgaaggtgcgcgtcagggcatcggcgctgatcagtgatgaggcgctgcttgcccagcgctcggtgccggtgctaccccagcggctggtggtgttgcctttatagatctcatagctcaggcggttattgccgctcgccatgttgcgcaccgtgccgttcgcgtacagcccgttgttcagcccgacggtgtaggtactgcctttagtgcaggtgagcgtcacggcctgggagatggtcgggaagttctgcaccagcggcgagctgccaaaattgaccgccggggcggtgatggttgaacagtcattggtgacggtgccgttgacctgcagggtggtggtcagagtaccggtttgcggcgttccgcacagcccgagcgcccccagcgcacagatgttgtagttgatgcttaagttcagcgtgacctgatacggccccgcggagacgttttgcccggcgacggtacgcaaatagatcggcagcgtatagcgctgtgagcccagtaatcccagcagcgccgaggcgttccaggtatagggcgtggcgttgatggtcacttcgctgttgttattgcagccggactgcccgcacacgcgaatggggatgagatcggtcaccgtcaggttatcggtgcgcctcatggccgcgcggttactggcggaggacgaggcggtgggcatgctcacggtgatggagtcgttagtaagcaaacccagcacgcgatcgcactgaacgatcagttgtccggtggtggcctgctcggtactgttgagcgcaaaggacgtcaccgggccgaaggaggccgccacagtgctggcggaacaggccgccagcgcctgtggactgaaggccataaataagatcagtaacagaccagcgcgtagcatcagcgtttctcctgacaggtgagaggcccaaaggtttgcagtttatggccggggttgtcccctacctgcaaagtcgtataacaggttttgttgtccggggtggtgacgcgcaacgggttgacgccgtcgaggttttccagccaggcgatcccgtcgtagccgacgatggcggtcggtttgccgtcgcgccacacctggcttgccagcggcagcgcctggccttgttcatcgtgcagaatgacgctggccacccgctcctgcaccatcgggaactccaccagataaccgctttgacggcgcagggccacccgccgctccgtctctttcagccgcgtatctgcgggtaaattcagcgtattgatgctgtaactggccggataatacgcggacacgccgctgatcagcagatagccgttttcatccgtggtgcccacaggctggttttcatagttgaccggcacgccgccattgccgctggtgctgatcaccacaaaggcatcgttgattttgttggcggcaaacacctggttgtccatcagcaccagcgaccccatcgcctcgccccaccaggtgaacatatcggtttcgccatagccgccgccctgaagttccacatgattattacgccagccgagtgtggcctgttgatagctgtccgcctgcgactgacgggcatacgccatgttccagctgaagccgccgtcggtcggcatcgcatggctgtagttcacccgctgcgagttgccggaatagggccggttttcaatgctgacggcggcgctgtcgcgttcgcccagcggaatttgcagcgacaggccgaaggtccagtcaccctgctgattatcccggctggcggcgaggttaacgctgctgctgccccagaggttgcggctccaggacaggtttaacagttcggttttctcattgtcgaaactgcgcacgccgatccacgccgcgccgacgttgccgaaatccccgaggttaaaggtcagcgaatactgatcggtgttacgactgagcgaggcgaccggctggcgattgttatcatcatacttatagagcgccgtctggtcgtaaagcgccaggttgccaaaaccgcgctcgcgacggctgtgctgagtggcgatgctgaactggctggtgctgtactgatagccccagttaaactggctgccgctgttgccgcgcatccggctctgcgtccaggcggaattgaccacgccgaactgccccagttttaacaccgtccccgccccgccgagcgccagctcctgggcggcttccgtatggccttccagcgtcaggtaatcggtcaggccgtagcgcagcgtgccgcttcccgccgccgggccgtaatcaaaattgtcgataccgtaatcacgtcgcaggctgccgacggagaacgcgccatcgctgagaccgcttttcagcacttcgctggcgacataaaacggcagcgtagtgctgacctggcggccgagcgcatcggtggtgaccagcaccgcgtcccccgcgccattgacgtaaggcagattggtcagggtgaaggggccgggttgcagacgggtgtttccggcgcgatagccgttgataaagacgtccactgaagtgggtaccgccgcctcgccggaaaactgcggcagcggccaggtgaccagatccgggcgcacggagaaatcgcgcccgtagcggatcccgccgaggcgcacgctgttgctccagctcagggaatcggaaatcacatccccgacgttccacacggtggcgtcatcttcattgaccagggttaaggtggtgtcgtagcggatatagccttctttttgctgtaaatcgccggagagattctgccgctgggtgccggtggagctgagtacagcgttttgttcaaagaagcgcagctcatgccagagggcgatctggctgccgatattttccgtctggctggtatagatgtcatagttcagtagcgcaccgcgcccgtacatcggctcgctgcgctcgctgtcgccggtaaaggaggtgctgctatcccctacccattcgcgcggcacaaacagcaacagccgctggccgctgctgtcatagtcaacgcgcacctccggcagggtcgacaggttaacgtctcctggcggtaatttatccgcaggcagtccggcgcgcttaaggttttcgctgtcgataaaaaacgcgttctggcggcggatcaccggcaccacctgattcgtgtcacggtagttcaccaccagcgccaggtggaaggtcgcctcgtcgttcagcgcccgggcatcaggaggcggcggcagggcgtcgtccccgtcggcagcctgcacgctgcctgtactgccgaggctcaacatcgccatggcgatcagcgcgcgggggccgactgccatgtcgtatccctggcgttaatggttgccgtcatggctgaaggggacgtcacgcccgccggcaagggccagctgcgggtgctaccgggcagaacataacccagcagcccctccgcgagggtgcgcctttgcccgccctgctgcactttcacatcgcttaaacgcacatgtacatcgctgcggttagtgacttcaatggccggtttgccgccgtcgcgggtggtgcgccagctcagatcgcgggtttcaaccagggcatgattcgccccttcgcggtaagtggcaaccccctgcccgtacgcaaagagtgggatggaataacgcatctggatcttcaggccgatttgcggagtgttatcaccctgcggctgggggatctcatcgacgataatgcggtaggcctgctcgacacccgcaggtaccgtggtctgtttgatcaaacggatcagctgtttactgcccttctcaatgcgcacgatgggcggactggcgaccacatcctgttgggcctggtagcgctcattaccgccatcctgacgccagcgcacaatacgcacctgcatggtggtcggggtgtcgccctgattctggatccacagttcagtggccggggtatccgccgccagccagggatcgataggccataataaaatggaggccgccgcctgtgcctgcggcgcgctgatggtcagcgcggaggcgaacagcagcgccgccagacgagaatttacgctcatatacttctccctgtctcaccaggtaagggtcacggtgagttgatcgctataagtgcctgcgggactgaatcccgtcagctgcgccgcgccaaacagcgaaagcgcaatgttattactgttgctgtaggtgaccgaaactgactggttctgggcgatctccgtattggcagccagcgtgctgctgctgtacaggcgatacggcacgacctcggtgccaccgctgcggcgcatattacgcacgctggtataattcagcccgccattgatgctcatggtcagcgccacgccgggggtacagggcagcaggaatgaagagttgggcacaaaactggtggatacgcgcccgctctccacaccggtacgggtgccgaaattcagcgtcccgagtacgccgccggtgccgctggtgactgaacagcccggcgttatcgtcgctcccaccctgaatgactggctggtgacagccagggcagttccctgcatcatgagccctgccagcgccagccagaaaattgggcgcagggctccccggcttccccgctgggaagctggcgttccttcagatttcatcgtgaagggcgttagtaaataacgctcacgtttatcgtatcggtataggtacccggcacgaccgtcacgctgttaccgcccccctgaatacgaccatagagggtatagttattgacgccgcccgtagttgaggcgataggcagcggcgcgttgttggccaccacgttactgaagccgctgtcgctgtagaggctgtaggccacgccctgcgcggtattggtggtattcaccagaaagcgcgcgggcgtccctgtggtcccgaccactgttgccggtggggtggagttggtattgccggtgatttgcacggtatagctgtcggtggtgcactgaatgccgaagctgttaccgccgcccacgccggtaagctgggtggtcagcgtagaaaaggttgccgggtgttcaccaaaattcagcgtaccgaaattgataccgttctggttgggagatccgttaatcaggcagccgttggttaacgtgagggttgcgccgatagtaccgttactggttaccgcctgagcatgctgcccggcgaataacaacgcgctacccgcgaggataatacgtaattttctgttcatgttatcgcctccagtaaataagcattccgcttattgcgataatggtttagccgccgtaaacattctcctgctgatgaaataacaggattaacagaaatttagctcagggaaagggaaagaactaccaggcgaggcgcgggtcatcagggtgcctgattgacataaattatcattaattttcaatgcattaaaaaataaatcaagatgtaaataaacgtatcaacgaaggatatattatgttgcgcgtgatctgcatcacaataaatcattagcgttgctgttgtttcatttatttgccgttaaccggagttaaccgcaccttaattattacggtcggggataataatatatttgagctattttattttttgggcagaaatttatttaaaagcgggcggggaaaataaaacgccctcgcgagggagagcgttttttgtttgccgggtggcgctgacgcttacccggcaaggtgaagcatcaggcgacgtgcgtggccgccacgtcgagcagcgccatttcttcgctgttcagcagtttttcgatattcaccaggatcagcatacggtcgccgagcgcgccgaggccggtcaggtattcagtggacagcgtgaccgcgaattccggcgccgggcggatctgatccgctgccagcgacagtacgtcagaaacgccgtcaaccacgatccccaccacacgctgaccgagattcagcacgatcaccacggtgttttcgttgtactccacgtccatctggctgaacttcacgcgcagatcgacgataggcacaatgacgccgcgcaggttcgtcacccctttgatgaactccggggtgttagcgatgcgggtgacctgatcgtaaccacggatttcctgcactttcagaatatcgatcccgtattcttcaccaccgagggtgaaaaccaggaattcctgacctgatggctcgccagccagtttcgttacattactcataccggtcatgtttataccttcttacctaaatcaggcggctgtatgcgccatacgttgttcacggtttaatccctgtaacgccgaaacatccacgatcagcgcgacactgccatcgccgaggatggtcgcagcggatatgcccggcactttgcgatagttgctttcgaggtttttcactaccacctgatgctgaccgatcagctggtcaaccaacagggcgtaacgacgtcccgcgctctgcacgatcaccacgataccggcggtggcttcggttttcgcgcccttgacgtcaaagactttccacagttctaccagcggcaggtactcgccacgcacttccagaacgcgctcgccgccggccagcgggtgcagatcttcttcacgcggttgcagcgattccatcacggcattcagcggcaggataaagacttcttcgctgaccttcacggacatgccgtcgaggatcgccagcgtcagcggcagcaggatacgaatggtcgtgcccgcgccctgtttggatttgatttcgacgtggccgcccatctcctgaatgttacgttttaccacgtccatacccacgccgcggcccgacacatcggtcacctgctcggcggtggagaagcccggcgcgaagatcaacatgccgacttcttcgtcagacatattttcgcttaccgccatgccctgcgatacggctttggcgaggatgcgttcgcggttcagacccgcgccatcgtcggtcacttcaatacagatattgccgccctggtgttcggcggacagcaccagattacccacggcggatttaccggcggcgacgcgcacgtccggcagttcgataccgtggtcgaggctgttacgcaccaggtgcgttaacggatcgataatgcgttcgatcaggctcttgtccagctcggtcgagctgccgaccagcgtcagttcgatctgcttgttcagtttagtggcgagatcgcgcaccagacgcgggaagcggctgaagacatattccatcggcatcatacggatggacatcaccgattcctgcaggtcacgggcgttgcgctgcaactggcccatgctggtgatcagatcgccatgggtgaccggatccagttcgttggaacgctgggccagcatcgactgggtgatcaccagttcgcccaccaggttaatgatctggtctactttttccaccgccacacggatgctggtggattcgctggcgcgcgccggtttttcacgttcctgacggcctgcggcggcctgctctttcggtacggctttcagtaccggggcggcggctactgccggcggctgcggtgcggcctgggctaccacttctgcggccggttcggcttttgccgcggcgggcgcggtttcgaaagcaatctgatccggttcaaccacgaagcagagtacggcaattagatcatcctggctcacgccgccatcgagggtggcgctgagggagtcgctgcctttgaccacgtcacttaaggtggcgaggtttttgagttcatcttccagcaggccgacttcgttctctttcagacgcgaaatcacgatgcgcagcttatcgttgtttgccggggcggcagcaacgtcagcctgttcgtcctgcgcctcgaccaccgtcagttttgcgccgctggttgcaggcaccacttcgcctttcgcttccagcgccagctgacgcagggcattgcagatatattcaaagctggcggcatcgggctcctgagagcttttataggcgtcgagctgttcctgcataatatctttagtttccaaaaacagattgattatatcggtattgagctgcatctctccgcgccgggcttcatcaagcaggttttccatgaggtgcgtggtttcctgcaaaatggtgaagccaaacgtgcctgcgccgccttttatggagtgcgctgcacgaaagatggcattcagttgttcggaatccggggcttcaggcaccagatccaacaaatgctgctccatgtcggccaacaactcgtcagcttcatcaaaaaacgtctgataaaaatcgctaatatccatgctcacgctatcacctcggatcgggttgtggcgatgtgggaactgtcgcctggggcaacgcctctggctgttttaataaacttactggctcgttctggctctcggcattttcgtgcaaaattgcctgttccgcctgccggttgagaaccaggagactgatgcggcggttaatcgcatcatcagcgcctttgtcgctaaggcgcatggtcgccgccatgcccacgacacgcaggactttaccgtcgtccaggccgccgatgaccagctcgcgacgcgatgcgtttgcgcgatccgcggagagttcccagttgctatagccgcgttcgccattagcataagggtaatcatcggtatggcctgacagactgactctgttaggaatgccgttcagcaccggcgcaatggcgcgtaaaatatcgcgcatatacggctctacttcggcgctgccggtcttgaacatcgggcgattctggctgtcgatgatctgaatacgcagcccttcctgcacgaggtcgatcttcagatgcggacgcagggcgcgcagtttcggatcggcttcaatcagctggtcgagatcgccgcgcagcttgctcaggcggttctgttccatgcgtttacgcaaatcttccacgttcggctgacgctgcacttcccccttctgctgggtgaaatcatcaccgccaccagggattgggctgtcgctgttcgaaatacgcggtccgccggtcaccgccgtcgccagcggtgtgcggaaatattctgcgatctgaataagctctttaggactggagatggaaatcagccacatgaccagaaagaacgccatcattgccgtcataaaatcggcgtaggcaatcttccacgatccgtgcgagccgcctccgtgtcctttatgtttacgtcgtttgacgatgacaatgggatgggcctggtttttcatgcgtcctcagtcgtggtctgctggtttgggtttctgaccgcgcgcacgtgctcttccagttccacgaaggaaggacgttcgctggagtacagggttttacgaccaaactcaacggcaatcggcggtgcatagccgttcagattagagagcagcgtgatcttgacgcactgcatcatcttggtggtttcggcgctcttctggcgcagcaccgtcgccagcggcgagatgaagccgtaggccagcaggatgccgaggaacgtccccaccatcgcatgggcaatcagcgcgcccaattcagccgccgggcgatccgccgaggccagggcgtgaacgacgcccataaccgccgccacgatcccgaacgcgggcagtgaatcaccgaccatcgccaggctgttggcgggcacttccgcttcggcttcatgggtttcgatctcttcgtccatcagcgcttcgatttcgaaggtgttcatgttgccgctaatgataagacgcagataatccacgataaattcgagcatcaccggatcggcaaggatacgcgggtagctggcgaaaatttcgctctctttcggactttcaatatcacgctccagcgagaacatgccctgttgacgcgatttcgccatcaggcgataaagcagcgccagcaagtccatgtacatgcttttggtgtattttgaacggcgaaacagcagaggaagcgctttcagcgttcctttgatggctttgccgttgttgcccacaataaacgcacctacgcccgcaccaccgatgataataagttcggcaggttgataaagtgccccaaggtgtccgccggtcatcatataaccgccgaagactgtaccgagaacaaccaggtaacctaataagatcagcacgacatcatccttcactgttgactaaggcgaggagaaacagatttgcgtttggcgcggcggcggggcaaaaaaaagcagcggtaattgcttaccgctgctggagtgttgctcacaccgttcggtcaaacagcctgattaatctgttcatccagcagttgtgaattactatcggcaacttccggggaaagtttacgtctttttactgccctggaaggcggctgacacaaactacaggcgaagcttcccacgggctggtgcgcatgggtaataaaattgccgtcgcagcagttacagcgtgaaagctgcagcattccgctttcgacgaaacggaccagcgtccaggcgcgggtcagggccagcaacggcccctcttcctgctgcggacactgttctaaatagagacggtaagctttgatcacggcgtcaacgccgctgcaaaggcccgttttcagtaaaaactgccaggcgttacagaacatggaggcgtggatattctgctcccacgtcataaaccagtcggtcgaaaacggcagcatgcctttcggcggcgggctgccgcgcagttctttatagagtttgatgagtcgaccacggctgagctgcgtttcgctttccagcatttgcaaccgcgcgccaagcgtaatcagttccatggccagctgaatatcgcgcgcttcctgaacaatgcttttaccggtcataaatcaggcccttttcttccgggcaggcgtatcaacagtctgaccagcatcgctgagtaaacgtgtcgacagcaaaataccggtatgcacctgctgcaaatcgtctacacgggattcctgcgtcagacgggtgatcgtctggtggctgtcaaagcggaactggcaaatcagctgattggtttcagccagttttaccatttgcggcaatgtcagctcgaccattgtggatgccatttcttcactcatccccagacggaacatggctgaggctttgtcctgactaatcagacgctgtgcaagaaggagatatgacaaattgatgtcataaacgtgtttcagcaactcggatgtatgcatttttcccatccagaataaccaacgaaaatcttaagcggtcagaccgcaccccgtgatgtcgccgggaaaaaacccggtagaataaaaagaaaaggcaaaatgcaatactacgattcagggatgtgacgcggaggccttcgcctctttgggcgacctggtccttcgcacgctgccatcatttcttacgctaaactaagatttttcctaaatcgaggcaactgtactcgcggacactcagacatacaatgtgagcaagtagtattttgaaaataatgtgatcgacgtcacataatttaagcgaatattccgaataaatccatcaataagactattgctttgcgtcttttttgttctattgaatctgttttctattcctttcgcacgaatagacatgcaaacacctctgacctgtgcgtgaaaagaatgcactgcttttcaaagcaacggcttagcgtaaatgatcgatctctattgtagagacaaattaataataatcttataaaacaacacattatgcaggaagataaaaagcccggtcgcttttgttaacgattacaaaattactaatcctcaggattagtaaaacagcagccagggttttttatcgcgaagatttgggttaagaagcggtatttttgcaaaatggttacgttgtgaactattccagtagtaagaataattaatgaatatttattaactctgtcataaaactaacatcttttgtagttgcgctgaaacataaaaaagagtatgggagtggcaaaaacgaggaagcgggaggcgtgtcgggcaagagaaacacgtgctcccgcctgcgcgggagcacgtgttatcaggctaatttcggaaaggtcgccacgttattttgcagcaaactttctgcactacgtggcgttatgcgctttaggtcggcgataaacctcttctgccaggcgtcgatgtcatttttctggataatgtccagcatctcggcgtggcgggaaatacgttcagccagcggcatcgtcagcgcgcggtccatcgccgccgccacatcatcgcgatcgtacgggttgaccagcagcgcggacgtcagttcgttggcggcaccggcgaaacgggaaaggatcagcacgcccgggttcgccggatcctgcgcggccacgtactctttcgccaccaggttcatgccgtcacgcagcggcgtgaccagaccgacgtcagagtagcggaagactttcatcaaaagcttgcgatcaaagtgctggttgagatagtacagcggcgtccagcccagctggccgtatttaccgttgatgcgccctgcttcggtttccagttgatgacgaatatcctgatacgcctgcacatcaccacgggaagtcggcgcaatctgcgtataacgaattttgccgtgatgctcggggaatttctccagcagcgtttcaaaggccgcaaaacgctccggcaagcctttggagtagtccagacgctcaacggagaagatatttttaacgcctttcagctcttctttcagctgggccatttttggcggcagcggcccggcggcagcctgggcgatctcttttggctcaataccaatcggatagacttcagtggcgaaggttttgccccaggcggtatgcgttttcttgtctttggcgatcagacgcgtctggctggcaatgctgtcgaggaaagacacacggtcgctttccgtctggaagcccagcagatcgtaatcgcacagctgttctaacagctcggcatggggcggtaaggcgttgaaaatttccggcgtcgggaaaggaatatgcaggaagaagccgatctggtttttcacgccgcgctcacgcagctcatgggcgaacggcagcagatggtaatcgtggatccacaacacatcgtcttcttccagcagcggcagcagtttgtccgccagcagggcgtttacgcgctgataaccttcccaggattcacgctggaactgtaccaggtccagacggtagtggaacgcaggccagagcaccgcgttagagaactggttgtaatactcttcgtaatcctgttcgctgaggttgaaagaggcccaggtgatattaccgcgcgtctctttctttaagggttgatcttcattgcctgtctcaccgctccagccaaaccagagtcccccggtggctttcagcgcccctaaaatcccgacagccagaccacctgcgcttgcttttttatcatccggcggtgcaatgcgattagatactacgactaagcgactcatagccatctctcctgtttgttagcgctaatttttcttgttgtaagtgatgatcaatcatctgttcgagccactggtgtacagcagaaacgccgtccagtcgccattgtgcctgggtgtcccctaagccgactttgatcgagacgccgcccacgcggttcacgaccttaaatccttgttcatcggtgaggtcatcgcccaggaatactggtgttctgcccgcaaacggggtttcctgcataaatgcgtcgatggcggcgcctttactgatgccgcgcggtttcagttcaacaacgcatttgcctggctgtaaggccagttcatcgtgttttgcttccagcgcctgtgccagcgcgtagatagcgtcttcgtggtgcatggcctgacggtaatggagtgcaaatgccattccttttgcttcgagttcggtgccctcaagaccatccagcccggcaatcagctccagttcaatctgctttaccagctcaggcggcagcgtcaccacgtggtgttcgccattgctgtcacggcgttctgcgccgtggacgcccgcaaggggaaagcgatatggactggcaagcgcatccagctcacgcatcgaacggccggacaccagagccactgcgccctggtaaagctcagcaagttgatgcaactggtcccgcaccctggcggggatggctacctgatcgggatggggtttgatgtcagcgagggttccgtcgaggtcaaaaaagaacgcaaaattaccagaaaaaatcggcggtacagttaactggtcggccactctggtctcctccttacagttcagatggtctgctccggcagacgcatcgcattatcattagctctgtaagtatagacagtgtgacggggctcgccattttaagaaggcgttgccagccatcgggacggctggcaacgggggagataaacttaaaggttaagcttaaacagtacgcttcgctttttgcttgtagcggtcgaaaatcaccgccgccagcaggatcaaaccgcgcaccacatactgggagaatggcgaaatattaagcaaattcatggcgttctccaccgtgcccagaatcaggatcccggccaccacataggagattttgccaatgccccctttcagcgacacgccgcccagcacgcaggctgagatgacgatcagctcatagccgatggaggtcattggctgtccgctggtcatgcgcgacgccagaataatgcccgcaatcgccgacaccagacccgacagaataaagatgatgattttggtgcgcaccacagggacaccggccaggcgagccgcctcttcattgccaccgatcgccagcgtatttcgaccaaaagttgtacgatttagtaaaaatccgaaaatggccagacagataacggtgagccagataggcgccggtaaaccgagccagttagtgtaaccgagggcgaaaaaacgctcatcttcaatgccgaccgccttgccatcggaaatgatataggccagcccgcgcacaatctgcatggtcgccagcgtggtgatcagcgcgttgattttcagccgggcgatgacaaagccgtttaccagaccgctgagcacgccgagcatcagcccggcgaagataccgatccacaggctttcggtcatgttgatcaccaccgcggtggtgacgcccgcacaggcaatgaccgaggcgacggacaggtcgaaatccccggaggcgaggcagaacagcatgccgcaggccaccatgccggacatggagatcgccagccccagccctttcatgttcacaaagctggcaaaattgggcacaaaaatggcgcagccgataaacagcacggcaaacaccaccagcatgccgtactggtcccagatacgacccaggttgaatggcgacttaggcgcgccggaagtggttaaagacgacatcatattctccttgctcaggcgacagcctggctaactttaggcatggcaaggcttaacgcctgctgttcatccgcctgaccgtgtagtaattcaccggcgatctccccttcgcgcatcaccaggatgcggtcggcgaggccgagcacttcgggcaggtcgctggaggcgaacagcaccgccacgccgcgtgccgccagcgcataaatcacgttatagatttcatgtttcgcgccgacatcaatgccgcgcgtcggctcatcgagcaaaatgaccttcatctcttcggataaccagcgcccgagaatggccttctgctgattaccgccggagagattcatgatcagctgctcagcgccgggggttttgatattcagtgaacgaatatggtggtcggcgttctgtacttcccagccgtcgttgatcaggcagcctgcgcggatgtatttgcgacgggcgctgatgttgatgttatcgcgcaccgaatgcaccggaataatgccttcggctttgcggtcttccgggcacaacatcatgcccgcggcaatggcgtggccgggtttctggatgttgatggccttgccatcgatccacacctggcctgcggtgatgcgcgtaccgccaaacagccctttcatcagttcgctgcgtccggcgcccaccagcccgaacaggccgacgatctccccgcgcttcaccgacaggctcaccggcttacgcacgcccggcgctttgacctcatcaaggcgcagcatctcttcaccggtctcacgcggctgccagccatagatatcgcccagatcgcggcctaccatcgctttcaccagtgaatcatggttgaccttctccatgtcgtcgaaggtgcagacatagcgaccatctttaaatacggtaatggcatcgcttaaggcgaaaatctcctccatgcggtgcgaaacataaataatcacccgcccttcgtcgcgcagttcgcggatgacgcggaacaggttgtcgatttcacgggccgagagcgaactggttggttcatcaaaggcgatcactttggcgttacgcgccagcgctttggctatttccaccatctgccactgcccaatcgacaagtatttcagcggcgtttgcggatcgatatcgaggccgagatgctccagctgtagccgggcttcgtagttcagcagcgaacggttaacgaagccgcctttatggggcagttgtccgagataaatattctccgccacggtcatttcaggcaccagatgcagttcctgatagataatggcgacgccggcattcagggcagcgggcgtatccgcaaaggtgacgtcttcgccgcgcagggccagggtgccggtggtgggggcatagttgccgctgaggatcttcagcagcgtggattttcccgcgccgttctcccccatcagggcgtgaacctggcctgcatagcaatcaaagctgatgtcgctgagcgcttttacgccagggaaggttttgccaatcccccggaaagacaggtatggagttgactgttgcataacatctccgaaacgcttttcagtgtacgactggccctccacccggcgggtgaagggcacacttgccacgcgtattacttaacgccgagtccttttttcgccagctcttctttgaagttatcgcgggtgatcagcaccacgtcggtaacggcggtgaatttcggcggctcaacgcccttctccacccagttgtaaagcatttcgctggttttatagccgtgcacgtccgggcttggcagcagcgaaccatagaagccggtgccctgcgctttcgacagttcgctcaccgcatccacgccgttaatgccgataccgatgacatcagccgctttaaagccctgaccttcagtggcgcgcacaccgcccagcacggtgttatcgttcataccgaccaccagccagtgtttcacttccggatgctgcaccagcagagagttaccggcatcaaacgcgcccggaatatcgttcgctttggtcggcacctggtagatctgtttttccgggaagcccgcggctttcagcgcgtccatggaaccggtggtacgacggcgggcggtatccagttcgtcggcggtaatggccatcaccgcggtatctttcacgtcccagccacgtttttgcatctctttatagagttcctgcccctggcgcgcgccgatttcacttgctgccatcatcaccagcggcacggattccatcggtttgcctttcgcggtcacgaactgatcatcaacggcgatgaccttcatgtcatagcctttggctttcgccacaatggcagaacccagtttcgggtccggcgtgcagatcacaaaacctttcgcgccgctggccgccaggctgtcgatggcgttcagggttttctccccgtccggcacggcaattttaattacttcaaaacccagatctttcccggctttatcggcaaacttccattctgtctggaaccacggctcttccggctgtttcaccagaaaaccgagtttcatggtttctgcgatagcggattgtgacataacggcagccagaccgatggctgccagcgctttagtgaatttgtgcatggttaactccagctttagcgttcttttatgtagggaaaaacggtttttctgttctttaatcagacagaaaacaaagcattagccgatactgttcaggatatgcttctgctggagagtagttttagcgggaaattaatcatccataggagagcgccatcacaccgcagaattacagtaattgcgtacataaattcagcggaaaatgacataaaaaaaggcgcatttgtcggacaattgcgacgggtgccagcaaaattatccataacgtcagccagcttatccttgtcgcccggatgcgttgcacatccgggcctgttcactaccagggataatagatatgttcagcgtgttcgcgcacaggcgcgtcgtcacccagtaagcgtgccgataccgtgagcgcaaaatcaaatacgtgccccagacctttgccactgatcagattgccgtcttccactaccggcgcatccacatattcgccgtttttcactccctgccacagatcgccggagcagacgtagcgccgcccgttcagcagatcgttaccccccagtacgcgtgccgccgccgaacagatcgggcaaatcagcttacccgcggcatcgtgcgccttcacaaactggatcacctccgcgctggcggccagattgacgctgccctgcggcccgcccggcagcactaccgcgtcatacagcgtctccagccgctcggtgagggtgctgtctgccaccatcgggatagcatgatagctttccaccgcgcgggtgtcagcgcaggccagggtttccacctcaatatgcagacgacgcagaatatcgatggtgacaatggcttcggcttcttcaaatcccggtgcgagtaataacgccacttttttcattttttattccttcaggtaagagttaacttcaccataaacttaatttcagtaaaattaaactgccagttcaaagccatcgcacgtaaaacttatccccggtaaatttctgccgtttcgcctaagtgccttccaggtcacagtaattatcagcgcgatctttctatgctgtagtcagttactcataacaaggatatttgctatggctattgtcggaatggttcaaaaactcaacacgcaaatgaatcttgagtttcaggcatccagtctttatttgtcgctcagcgaatggtgcgccggacacagcctgaacggaaccgccactttcctgcgtacccaggcgcagggcaatatcacgcaaatgatgcgcgtgtttgaatacatgaaacgcgaaggggcgaatcccatcgtaaaagccgccgaaccctaccatgacgactattccacccttgaagatctgttcaaaaaaatgcttgaggagtattcgcagcgctgcgccaccctcgcccacttaacggcggaagcggcggccatgaacgatgcctgtacgctcgaatttttgcggcagctggacaaagagcagcagcaggacggcctgttgttgcagaccattatggaggaagtgcataacgcgcagctgtcgggtatgggtttaccgcaaaccgatcagcatttacttaatatcgttaatttccggcagcattaatccgccactgagacccagccccggcccgcgtcggggttgttattttttgcagctcaatgttgcaaaattgtatataagcccttgattacccgcgttttaacaaagtcgatctggctcgcaaagatcaaccttacaaaatgtaatgatttagagcatcaatgtttaattacacaggtgcttcatgatcactcttgaatttattgtcattatcctctgtctgctggtgggtacccgcttcggcggcatgggcctcggcctgatcagcggtatcggcctgttcatactgacctttgtgtttggcctgcaaccgggtaaaccgccggttgacgtgatgctgactatcctggcggtgatcggctgcgccgccacgctgcaaaccgccggcgggctgaacgtaatgatgcagtttgcagagcgactgctgcgacgtcacccgcagcacattacattgctcgcgcccttcaccacctggacgctgacgtttttgtgcggcaccggacatgtggtctacaccatgtttcccattatcgccgatatcgcgctgaaaaaaggtatccgcccggagcgaccgatggcggtggcgtcggtggcttcacaaatggccattaccgcctcgcccgtttcggtggcggtggtgtcgctggtctctattctggcggcgcagcacggcatcgggcaggcctggagcatcctggagatcctcgccgtctccgtgccggcctcgctgtttggcgtggccgtcgccgcgctgtggagcctgcgccgcggtaaggatctggcggatgacgcggagttccagcagaaattaaccgatccgaaacagcgggaatttatctacggcagcagcgacaccttaatgaatcagcgcttcccgaagcaggcgtactggtcaacctggatcttcttcgccggtattcttgtggtggtattactgggcgcgttgccggaactgcgaccctcatttgaggtgaagggcaaaatgacgccgctgtcgatgaacctggtgatccagatgatgatgctgattgccggggcggtgatgctgatcgtctgtaaggtgaatgcgtcgaccatttccagcggcgcggtgttcaaggccgggatggtggcgattttttcggtgtttggcgtggcgtggatgagtgacaccttctttcaggcgcatctggaggagttaaaagtggcgctggagggcgtggtgcagaatcatccctggacctacgcgattgtgttattcctggtgtccaagctggtcaacagccaggcggcggcactgactgccgttgcgcccatggcgctgatgctgggcgtcgagccaaaaatgctgctggcgtttttcccggcgtcatacggctattttgtactgccgacctatccgagcgatctggcctgtatcggctttgaccgttcaggcaccacccgcatcgggaaattcatcatcaaccacagctttataattccggggctgattggcgtcagctgtgcctgtgcggcgagctatgcgctggtgatggcgctgttctgatcctgccggcggggtcgcccccgccttttttcagcgcggcttccgcgcccgatcttcgaaaacatccgtttgaataattcaaaacgaaggtttactttagctagtgcgcctcgccctgcggcgtgaacttcagctcaatcagcgcaatggctttctgaatggcgcggcgggtcaccggatcggcggcagccggatgggtggtgaaatcgatggttttcagctgctgcgacattttctcacgcacttcaaccggcgcgataacgtcaatgatgtcgaggatttgtttgatcaccagctggcaggcgacaacgtcagataccagttcttgatcggcactcagggattcagacatggaaggctcctttcagtaaggacgccatagtagcgggaagcgctgcgaaaaggtagtttgcccggcctgcacagcgtacatcagatataaaaaaacctgccgcagcaggtttttttatcagaacatcgcgccaggcgggacgtctttgaaagttttgcagtaggtttcaaaaatgcttttcaggatcttacgcagtttcatcttttgctccggagaaatttgttatgcaggtgttatgtttctgtgtgcacataatatgacctgcatcacaaaaatcaaccagtttgtgaagcccatcacattaaaaaacgcattgatattttagttttgttaaaaaatgcatgataaatccgtaagttacggacatttcatttctgtaaaaatttaaaattttttttaaaatggcagaccaaaaatgagtgacagcacccaaccggaggccagacgcggcgtttctcccgccgcgctgctggtcgccggggcgttttttatggagtttctcgacggtacggtgatcgctaccgccctgccggacatggcggaaagtttcggcgtcgatgccgtcgatctgaatatcggtatcagcgcctatctgatcaccctggccgtgttgatcccggccagcggctggatcgccgaccgcttcggcgcgcgtaaagtcttcgcctcggcgctggcgatcttcaccctcgcctcggtgttctgtggcctcgcggtcagcgtggagtggtttgtcgccatgcgtattttacagggcatcggcggcgcgctgatggtgccggtcggacggctggcagtattgcgcaccacccccaagcatctgctgatcaccgccatcgccacccttacctggcccgccctggtcgcgcctatcattggcccgccgctgggtggctttattaccagtttcgccagctggcggtggatcttctttattaacgtaccgctggggctgatcgccattgcgctggcgctgcgcatcattccggatattcgcgaggaggagcggcggcctttcgatatgcccggtttcctctccacggctattgcgatggtcagcctggtgtatgccatggaattgctgggcgcgcagcagccgcaggggtggctgacggcggcgatgttgctgctgggcgcgggcacgctgttttatgcgctgcgccattttcagcgcgcccgctggccgatgatacgtctcgatgccatgcaggtgccgaccttccgcgtgaccatgtacggcggttcgctgtttcgcgcctccatcagcgccgtgccttttctgttaccgctgatgtttcaggtgggctttggtatggatgcctttcatgccgggctgctggtgctggcggtgtttgtcggcaatctgacgataaaacccgtcaccaccccgcttattcgctggctgggattcaaaaaactgctgctgatcaacggcgcgctcaatgtgctggcgctgctggcctgcgccttcctgacgcccacgacgccggtgtgggtgatcctgctggtgctttatctcggcggcgtctttcgctcggtacagtttaccggcgtcagtaccctggcctttgcggatgtaccttcagcgcagatgagttacgccaatacgctgttcagcaccgcgacacagctggcggtggggctgggcattacgctgggggcgattggtattcgtatcggcgaacgggttggcgactggctctcgctgggagaggtgccggggatcagttttcgcctggcattcgtggcgatcgcgctgatttgtctggtgggcatggcggatacgctgcggctgacgaaagatgccggcagtgcggtgtcgaataaaaagggataaaaaaaggccagcgaacgctggcctttcgggatgttatgcgagcatttcacgtacgaaggcttcgatctctttatcctggcagttttcgaagaaacactcctggaaacgctgaccggaaacggcagttttcaccagctccggatcgatggcgcgcagggtgtccagatagttgtctttcaccactgccgctttcacctgattaaggatcccggcgttacgcacctgcggctctttacgctccggcggatacccttcgcctttgcggccggtgaaggctttttcgaagataaagcgcacgttcagctctgcgccccagccaaaacctttagcgaacggcaacgccagcgcgttaccgttgttgatctgcgcgaacaggaaagcatctgccggatcgatgcagtagccgcagttcacgcccggatggatattcagcgacatcagcgcgccctgaccggtgccgcacccggcaatcacgaaatcaacggctttagagttcagcaggatgctggccatgatgcctaagtggatgtaggtcaggtgatggtcattctcgtcgctcatgccgacgttgaaaaccgggaagttcttctcatccgcgacggttttcagctctttaaggataatggcgtttttggcagcctggctgttttccatcatcagtgcaattttcattgtgtcttctcctgaagcgttgcgggatgtcccgccgtgaatagcgaacgttttagaaaccttactactaagcaaacatactttcaaatttagtgaaaaatcgttttaaaaagttgcgaggtgctcacagtttttcccgcttcgctggccgttacaattagtaaggccagaaaatccggctattcaggctattggcgggaaagagaggttgtaggatgagaacatcgaaactgaatcagagcgataccatgaagagtatgcttttagccgccgcagtcctgctgctggcaggatgcaccatcactaaagagccgcaggttagcgaggtcattcagaccaccggtgtggtacgactgaattttaacgaagccatgctgcaaaatgcgcgctttgatgagtataccacccacggcaccgccacgcgtcagtgccagcaaatgggctatgccaccgccgccgcgtacggtcagccgatccgtacctgtagtgtattcagcggttcactgtgccttaatgaaaaaatcaccctgcaataccagtgtcaggggctggcgctgtcgcctgccgccaccggctattattaatctttaccacctgcgttattacgcaggtggcgcttatttataataaaaagaattattctcaggtaatttaaccttcacatctaatgcgtattattcacattaccattcaaattaattattctattttaccttttgcaaataattaaataacaaattatagtggcgccattattcattgcgcactccctggagccgtatcatgcttaaagcagaaatgatcgaaaaattaaatgagcaaatgaatctggagctttactcctctctgctttatcagcagatgagcgcctggtgcagctaccacagcttcgaaggcgcggcagccttcctgcgccgccacgcgcaggaagagatgacccacatgcaacgcctgtttgattatctggccgataccggcagcctgccgtgtattaatactattccatcgccggttgcggaatatgcgtctttagacgatctgttccgttccacttatgaacacgaacagctgatcacgcaaaaaattaatgaactggcgcacgtggcaatgaccacgcaggattatccgacctttaatttcctgcaatggtatgtggccgaacagcacgaagaagaaaaattatttaaatccgttatcgataaattatcgctggcgggtaaaagcggcgaaggcttgtatttcattgataaagaactatcgaccctcgacgcccaaaagtaatacttccggcggtgacactgtcaccgccttaaacctctgtaaatattaaattacaccatctgtaacgcctgtttgacgagactgtcattttcccttactctgcgccgcatattcgaatgtgcaatggtttatgggcagaggaaagcgtgaagaatcggacgctgggtagtgtttttatcgtcgcgggaacgacaatcggggccggtatgctggcgatgccgctggcggcggctggggtgggatttggcgtgaccttagtgctgctgttcggcctgtgggcgctgatgtgttataccgccctgctgttgcttgaagtgtatcagcacgtccctgccgataccgggctgggctccctggcgcgtcgctacctgggccgctacggtcagtggctcaccggtttcagtatgatgtttctgatgtatgcccttaccgctgcctatatgacaggcgcgggcgaactgctggcggcaagcctcggctcctggctcgacatcaccgtttcaccggtcgccggtgtgctgttgtttaccctgattgcgggcggcgtcgtctgcgcgggcacgtcgctggttgatctgtttaaccgctttctgttcagcgccaagatcctctttctgttgatcatgctggcgctgttaatgccgcacgtacacaaaatcaatctgctgaccctgccgctggagaaagcgctggcgctgtcggcaatcccagtaattttcacctccttcggttttcacggcagcgtgccgagcatcgtcagctatatgaatggcaacatccgtaagctgcgcacggtatttattaccggcagcgccattccgcttgtggcctatattttctggcaactggcgacgctgggcagcatcaactcctccacctttatgggtttactggcggatcaggccgggctgaacgggttattacaggcgctgcgggaagtggtcgcctcaccgcacgttgaactggcggtgcatctgttcgccgacctggcgctggccacctccttcctgggtgtggcgctgggcctgtttgattacctggcggatctgtttaatcgtcgcaataacgttgccggacgtttacagaccggggcgatcaccttcctgccgccgctggcttttgcccttttttatccgcgtgggtttgtgatggcgctgggttatgccggtgtggcgcttgccgtgctggcgctgctgatcccgtcgctgctggcgtggcaaagtcgtaagcataatccgcagacgagctatcgcgtcagcggcggcaagcctgcattagcgctggtgtttttgtgtgggatcgcggtgattgccgtgcagttctgtattgcagccggtttgctgcccgaggtgggttaatagcgcttcttttattgccgggtggcgcagcgcttacccggcaagctggtgcaagtgactatcagtgcaggcagcactgcttgaattttttaccgctgccgcatgggcaagggtcgttacggcccactttttcaccggcggtgaacggcttcgccacttcaatttcctgctgattgtcggcccagtagtcatacagcgccagcgccgcaggtttaatcgcctcgatgctttcttcaaaggcttccggcgtcatctgctccacacgttcgaagttctcttctttaccgtgcagttcaatggccgccagcgctggctttaacggatccggtaaggatgaccagtcgctcaggctgacgccgcgcagataaccgaagcaccactcttccacaatggtcagctcctgatcttccacgtcgcgcgttccaaacagcggttcaaactgttccggatactcggccagacgatcgccgatatcgtccatatgctggaaagcgagcatcatgaaacgctccatctccttttccgacgaccagttcggcaccttgtcagcaccgccccacagcgccaccagccactggctcggctcaaccggcaccggcgagcttagtaccgcagtgagtaagccatccagctctgagacatccataatggacgcctccgtaccgtacttcatcagtacgtcttccagccattccagctctttctcgttcaggggtccggttttcattgtgcatattcctcggtgaggtgcgaaatacgcaccataaaaaagaaattttaccacaggtgagtagcaaaattattggcgatgcagaggtaactgtgttctcctttctaccctgcacacacggttatgccgatcggtttaaggatctcacactatgttcaacagacacagccaccattccgcggaattctggcgcgatccggcgatggagcatgtagagacccgtcgcgcctgtcatagccgggcgtgttataagtcgcacagtcatcccaccttttctattggcgcagtggatgcgggcggaagtcattttaccggcgtgtcaggtggcccttctgcattgcatcccggcatgatggtgttcattccggcgggctgtgttcacgcctgtaatcccctgcctaatgattgctggagctatcagatgctgcatcttgatgccgcctggctacgccagttactggcagaaactggtccttcctcagcaggccttattcgcgaaaatgaaattcgcctcacggataaccagacggtctatgcccggttttgccagcttaatgacaccctcttttcagcagccactacggaagacaaaaatgccgcgctaatagaatttatcggtgactgcgcctgtgagaatgatcgggtggaaactttcgccgcacagctaccccagggcaacggggcactggcgcgggtgatcagccagttgcaggaaatcgaacgcccgcccctgccgcttgaagatttggcgaaaatcgccgatatgagtcggtatcagcttatcagagcttttcgtgccgtcaccggtatgacgccgcacgcttatcagctcaacaggcgcgtgaatcaggcgcgccagtggctgcagtcaggcagtgaaattaccgatatagcataccgactgggttttgcggatcaaagccattttcagcgcgtatttaaggcgcataccggcgtcacgccaggctgttatcgggcctgagtccctgcaattttattcaatacaatcatcctgtcagcctgcaccctgtaggaaaaatttcttagagggtgatggcatgatgcaacaatttcttctggtggcaaccgcacattttctggcgctactttcccccggcccggacttctttctggttgcgcgtacctcaattaaagcgggctggcgtcatgccgcctttgtctgtctgggaatagccgtcgcaaacggggtgtttattctcgcggccttcagcgggatcacgcttttccgctcgggcagcgcagggtttatcgccattcagctcgctggctgtggctatttgctgtatgtcggccagctttttattcgttttgctggcgcaagctccctcaccggacacaagatgactccggaagccgctttgacagagaagactgatctcacagatcgctggcgtgaattcggtatgggctttatgtcgggcattctcaatcctaaaaatgcgctcttttatgtcagcctggcgacgttaatcggcggtgccggtactgcgcccggactgaaagttgtctatggcgtgtggatgttcagcgttgtgctgttgtgggatttgctggtggcgatctttatcgggaatgatgcagtgctgcgcactttttcgaaagtgttacccgctgtggagcggatttcgggggtgatcctgatttgtctggcactgagcgttattgtgatcaacgtgctgcaactgtcacgataagttagtgggatgagagcaatcaggtcagaaacggcaaatttcaggcataaaaaaaccacccgaaggtggcttacacgacactgcttatcattgattttattcgatgtttcccatggtacccggagcgggacttgaacccgcacagccataagccgagggattttaaatcccttgtgtctaccgatttcaccatccgggctcgggaagaaattggaggcgcgttccggagtcgaaccggactagacggatttgcaatccgctacataaccgctttgctaacgcgccgaaaatcttcaggtcttgcgaccagcatccgcaatatgccgatgctattaactggagcgggaaacgagactcgaactcgcgaccccgaccttggcaaggtcgtgctctaccaactgagctattcccgcaatatcttgtgattagctaatcacttgattttactatcttctggcaagcagtgccgccgtctgatgcgatgcattctacttacctgacgcactgagtcaacgatattttttcaaactcaggatcgtttgctgaaatttacggcgaaacgatcacggttcaagcaaatcgccgcgcgcggcgtttaaatattgcagcatagaccacagcgtcagcaccgcagccacaaacagcaggcctacggccgcgtattccgtaagctggttaggacgccacagcagccccaccagcgccaccatctgcgccgtggttttcactttaccgatccaggacacggccacgctgctacgtttgcccatttccgccatccactcacgcagcgcagagatgatgatctcgcgcgcaatcatagttgccgccggtaaggttacccaccatacgtgatagtgctggacaaccagcaccatcgcaatagccaccagcactttatcggcgaccggatcgagaaacgcgccaaaacgcgtgctctgattccagcgccgtgccagaaacccgtcaaaccagtcagtgatcgccgcaaagcagaaaatcagcgcacatgcaaaaggagcccagacgaacggcagataaaatgccaccacgaagaacgggatcaaaatgactcgaaaaagcgttagtaacgtcgggatattaaatcgcatagtgacgggtaactgtctgttgtcagtaaaaattagctctatgttgctacatagcccttaatgtttcaacgagtagtagatcttttctgccaggccttgcgaaatacccggcacttttgcaatttcctcaatggtggcattgagtaaaccttgcaatccgcccatgtatttcaacaacatttgccgacgttttggccctacgccctcgatagtttcaagcgtactggtatttttaacttttgcccgtttttttcgatgtccgctgatggcgtgatcgtgtgactcgtcgcgaatgtgctggatcacatgcagcgccggggagtccggcggcaggttaaagccctcgccttccggttcgaagaacagcgtttccagcccggctttacgatcggtgccttttgctacccccagtaataagggatgatgcttatcccagggaacgtccagttcggcaaacaccgcttttgcctggcccaactgccctttcccgccgtcgatcagcaccacgtcgggaactttactctcctcgattgccttgccgtaacgacggcgcagcacctggttcatcgccgcgtaatcatcgccgggggtaatgccggtaatattgtagcggcgatactcggcgcgcaccgggccattggcatcaaagaccacgcaggacgccaccgtctgttcgcccatggtatgactgatgtcaaaacactccatgcgctttacttccggcagcttgagcatagcggcgagtgccgtcatacgctgatgaatggtcgactgctgcgaaagcttagtgctcagcgctgtcgcagcattggtgcgcgccagtttcaggtaacgcgcccgatcgccgcgcggtttggtctgcacgtttacgcgccgccccgcaaccgccgacagggaatccgccagcagcgttttgtccgtcagattaaagtccagcaggatctcggaaggcagcgtgcgcatctggctaccctgcaggtagaactgaccgacgaaggtttccaccacctcgccaagctcagtgccgcccggaactttcgggaaatagctgcggctgccgagcactttcccctgacgaataaacagcacatggacacaggccatgcccgcatcaaaggagacgccaatcacgtccagatcgtcgccagtattggaaacaaactgtttttccgtgacgcgtctgaccgcctggatctgatcgcgtatccgcgccgcctgttcaaagtccagcgccaggctggccttttccatacgttcgatcagcaggttcaacacctgatcgtctttccccgccaggaaaagccggacgtaatccacctgctgcgcatactcttcctcgctgaccagtcctgccacacaggggcccagacagcggccaatctgatattgcaggcacgggcgcgagcggttgcgataaacgctgttttcgcactggcggatggggaaaatcttctgcagcagcgccagggtttcgcgcaccgcatagccgttcgggaaaggcccaaaatactcgcctttcgcatgctttgcgccacggtgcgtggccagccgcggatgggtatcggcgctcaggaaaatgaaaggataggatttatcatcccgcagcagcacgttgtaacgtggctgatacagtttgatgtagttatgttcaagcaacagggcttcagtctcggtatgggtaaccgtgacgtcgatttgctggatttgcgacaccagcgcctcggttttccgtgagccgacgttggtacgaaaatagctggacagccgcttcttgagatctttggctttaccgacataaatgacggtaccgccggcatcatacatacggtagacgccgggtttgctggtcaccgtgctcaggaaggctttgggttcaaaaacttcactcactgacttgataacgtctccgcattacacagaccatgtcgaatggccagatgggtcagctcaacatcgccgtgaatgtttaatttactgaacatccggtagcgatagctgttcaccgtcttcgggctgagattcagttgctctgagatctcattcaccttctggcctttggtaatcatcagcataatctgcaactcgcgttccgacaaacttgcgaacggcgatgcggttttttccggctcaatctgactgagcgccatctgctgggcaatgtccgaggcaatatagcgctgaccggcatacacagagcgaatggcgttaaccatctctttaggcgcagcgcctttactcagatagccagccgcgccagcctgcatcactttcgccggcagcgggttttcagtatgcacggtaagcataatgactttggtgtcagcggttgagcgcgcgattttacgcgtggcttcaaggccgccaataccgggcatgttcatatccatcaacacgacgtcgacaggattagcgcgacaccatttaacagcatcttcgccacagcaaacctcgccggaaacttttatacccttaatatcttccagaatgcgtcgtatccctgcgcgcaccagttcgtggtcatcaacaagaaggacgttgatcaaaggaaatctccagaatagggataacgctactttcagttaattctgcacatattaccgttttttagcgcaagataaaaatccaaaaatgcgcagggtacgttttcggtcaggcaggtggaaacaggactgtacaatttccggaaagaaaaagtgctaaatgacgtctaaagtggccgatttaagcagcgtttattcaaagatttaaatatcaccggataaacgaagcggtaattaatgactgtcatttaacaatatttaaccagcgggataccggctataaacatatattgtgtaacagataattatactgtttatcatttatgggattaatttgttaaacggcatcaataacgatcaaaaaacaagcactgctattttttgccggccttgtggtatactccgccgccttcacattcactggcgcattcaggcgctgttacataccgaggacgttacatgaacacacccgatttcactactgccgaaaatggccctgaactggctcaggaagtctcctgcatgaaagcgctggtaaccctgatgttacaggcgatgggccaggcagacgcaggccgggtgatcctgaagctggaaaagcagattgcccagatggaagatacggcgcaggctgacgtctttgctgccactgttaagcagattaaacaggcttaccgtcagtaataaaaaaccggctgacagtgtgttgccctgtcagccggtgtaacgttcgacacgcgaaacgtatcgtctttcagataaaccctgtcgccgccgcatagcaggctatctgcgttttattaggcgcattgaattttttctgcatatttttctggtggaagttcaccgtattctccgagatggacaggatcatcgcaatctccgccgaggtcttcccttccgctgtccacttcaggatctcgcgctcgcgtttgctgaatttcatctccggcgcggccaccgtgtcatcattcagcttgctcagcgtcagcaggctcatctgcaccagaaattgcaggcgtaactcaatctcatcatcagagcgcgttttaccgcgcacatcggtgcgggatacagaaagaaagcccatcgcccggttgggcagcatcaggcactgggtgacacccttgcgcagaccgtgatcgcgtgcgccatcccataaaggctgggcttcgctaaataaacgatcgctccacggcagatgtccctgaataaaattctcaggcctcagcaccggatcgatggcgaaataattttccgcctgataatgcgaggtccatgcgacagggtaggtggtctccagggataattttggccgcgtgaaaggcacaggatgccgcacacaaagtgagaaataatcaaattccagctgctgcgtctgacgctgtagctcgttataaacctctgccgctgatgtcatcccctgaaaaagatgcagcaactcccgtcgccaggtgaaaaagtctgtctcctgcatatataccggtaaaacccctgcttgttatcatcattattatgaatgtataaaactaacacataaaacttatttataaatacaaaataacgtcctggtgtggaataacccgcatcttattgtcgattcattgtactggtcagcattaatagcggtatttcaaataccgctttagaaatatttagaataattcagaccaaaaggaaataatgaaaccgccagataaaaaacttaacttaagataaattaaagcaggatcgcctgaggcgatccgccttttttattgcatgaggaatttttcgaggaactgccgggttcgcggctgttgcggattagcaaacagatcttttgccgggccctgttcgacaatgcgcccctgatccataaagatggcacgatcggcgacatcacgggcgaagctcatctcatgggtaacgatcaccatggtgcgcttttcctgcgccagttgacgaatggtgctcagcacctcgcccaccagttcgggatcgagcgcggaggtcggctcatcaaaaagaatcacatccggacgcattgccagcgcacgggcaatggccacacgctgttgttgcccgccggacaagcgcttcggatagctggtttccttgccgctcagtcccactttcgccagcagttccctggcgcgggtggccgcctcggttttttcttcgcctttgacgatgaccggcccctcaataatgttctccagtaccgtgcggtgtgggaacagattaaaactctgaaagacaaagcccacgcgctgacgcagttcacggatagccgctttttgcgaactgagcgaccgcccggcatcaatggcaatcttacctacccgaatggtgccgctttccggctgttccagcagattgatgctgcgcagtagcgtggtttttccggatccgcttggcccgataatcgccaccacttcgccctcttccacttcgaggttaataccgtgcagcaccgtctggccgtgaaacttcttcaccaggtcttttacttcaatcgcactcattttggatcacgctcctggcggttaagctgattttcaaaataattttgcagcgccgacagcaccgtcgccatcacccagtaaatcagggacgcggccagatacatagtgaacacttccagcgtacgggaggtgatcagctgggcctgacggaacaactccggcacctgaatggtggccgccagcgaggtgtctttcaccagactgataaaactgttgctcagcggcggtagcgccacccgcgccgcctgcggcaaaatcgcccggcgtagcgtctgccacggcgtcataccgatactggccgccgcttcccactgacctttgtcgatggaggaaatagccgcgcgcagcgtttctgaagtataggccgcggtgttgagcgacaggccaatcatcgccgccggaagcggatccagttcgatcccgaactgcggtagcccgtagtaaatcataaatagctgcgcgatcagcggcgtgccacggaagacagagatataaaagcgcgccagccagcggatcggcagcagcggcgacatgcgcatcagcgccagaataaagcccagcagcaggccaaaaaacatgccgccgatactgagctgtagcgtaaataccgccccgcgaagcaggaagggcgcggagtcgatcaccagttgtatactttcttgcattatcgttcttctgttcgcaaatcagacatgggggtggtaggcgaaaagcgccggtgcgccacctgtgtgtataaacagaaccggtccctgatccttaaagcgattctgactgataccgtcaatcaagcccgccatggctttgccggtgtacaccggatcgagcaaaatgccttccagacgcgccagcagtttaaccgcttccagcccttccggattcggcgtgccgtaggatggcgcaaaatagtcgtcccacaacacaatgtccgcgcgggtctgcacgtccagcagggtatccagttccttaaccagcgtggccactttcggctgctgatccgccacgctgcgcgataccgtgacgccaatcagctccgcctgcggcattaactgcccgaggcccaccgccagcccggcatgcgtcccggcgctgccggaggccaccaccaccgaggatatgtccaccgtatcttcgcactggcgggtgatttccagcgcgctttccacatagccaagcgcccccagcgcgttggatccgcccacagggatcacgtaaggacgaaagccctgggcttcgacgcgcgtcgccagttcatccagctggcgaaccggatcggtcagcgcgtcgcacatctctatttgcgcgctgaacagatccagcagcaggcggttgccattagtgaggtagttttcggcgcgggtgccaatggggttttccagcagcgccacgcagttcagacccagcttcgccgccaccgccgccgtctgacgtacgtggttggactggatggcgcctgcggtcaccagcgtatcggccccttcgcgcagcgcatcggcggcgaggaactccagcttacgcagcttgttgccgcccatggcaatcggcgtcacatcatcgcgcttgatgaagatctcgcggcccagataatcggaaaaacgcggcaggtactccagcggcgtgggcgcgccgataaattcgaggcggggaaaacgggttaaattatgcagggacatgaaatctccggtgctgtgtaacgaatcattcattgattatgcacggtacggcgcaataaataaaaaaggcgctctaatcagcgcctttttcgttaactgccgatgattatttcgtcacgtcagcgccaaaccacttctcagacagcgccttcagggtgccgtctttctgcatatccgcaatggcggcatcgatagctttcagcagatcgtcatcgcctttacgcacggccacgcccgcttcctgacgggagaacgcatcgcctgctaccgccagcgtgtctttggttttcttcaccaggtccagcgccgccaggcgatccaccagaatggcgtcgatacggcctacgcgcagatcctggtatttggtcgggtcatcgtcataggtacgaatgtccacgccctgtacattctggcgcagccactcttcatagttggtgccgaggcccacgccgacttttttgcctttcagatcggctgcggttttgatgccgctttcgttaccttttttcaccagcgcctgaataccagagatggtgtacggcgtggagaagtcatattttttcttacgctcatcggagatggtgacctggttaatcaccacatcaatgcgtttggagtccagcgacgccagcatgccgtcccacttggtaggcttaagatcggcttttacgccaagatgttttgccagctcctgcgcaaactccacttcgaagccagtcagtttgccgtcatctccctggaagctgaagggaggataagtgccttccagcccaaccagtaaggttccgcgttctttaactttattaagcacattatctgcagcgaacgtcgtcgcgctcatacctgctaccagcgcaacagccataacgcccatcagcgcctgacgacctaactgaacaagtttcatagtcaccccgaataagaaaattttcacgatagtgcatggtgtatggcctgttggtcaaacaccactacgctacatgttattcatttttaatatatatcagaagttgcctgaggcgcgattttctgtgcggcaataaagtgggattgtgacctgaactgggcgtacttgcgcagcgcaatccggtagttattggtgctggtcaacggcagccagggttccaggacttcatcaaggaagccatcagccagctgttcgtgagaaacattattttccgtaagatggttgccaagacggcgcaggcggacaacatactcacgcaccgtgccgtggctcatttcggtctgctcaaacagatactgtttaaaaccgataatatcgaagaaatcgctctgctctttgcagtgcaaatcgccgcagaaacgacatagcgcgacccactcttgctgttcctgttgccaggcggcttcgtccagcagggtgtcgaggcgcgaaatcgcgattttgttaacgatctcaccgcgacgcaccagcgtgatgcgatcaagcagtttgtggcaatgcgcacaatgcgtctggctgtgtttaaagtctttcaggtagcggcttaagggccgtcttttagcgtgctgcaccgtcatgataactcctggttgtcaatacgttgtgcggcattcttcaggcgataaacacgtgcctataacttacccagcttggtacgtaagcgcttaatggcctggctatggagctggctcacccgcgactcgccgacttccagcaccgcgccaatctctttgagattaagctcttcctggtagtacagcgtcaggaccagttgctcacgttccggcaaggcttcgatagcctccatcacgcgatggcgcaaattgctctccagcaactggtgtaacgggttctcctgctggtgatcgtcggtcaccagctcgatgctatcgccatgctcttcccgccactcgtcataagagaagagctggctgttattggtatcgagcaacatctgacgatattcttcgacaggaatactcagccgctgcgcgacctcggtttccgtcgcgttgcgtcccagttcctgctccagctgtcccatcgcctgtgccacttcgcgggcattacgccggacgctgcgcggcacccaatcacggctgcgcagttcatccagcatcgccccacgaatacgctgcactgcgtaagtggtaaatgccgttccttgcagagcgtcgtaccggtcaactgcattcagtaaaccgatgccgcccgcttgtagcagatcgtccagttccacactcgccggcagacgcacctgcaggcgcaatgcttcatgacgcacaagtggtacataacgctgccacagcgagtgtttatccattacaccttcagcggtatacattgaattcacgataaacagccctgcgttaatgagttatcggcatgattatccgattctggagggcttttaatcggatgaatagtgggtgaaatgggcggttatttgccttcattaagccaaatcctaagcgcggaagcataaaatgtacaaaaaatacctgttaatcaacagctcagctaaaaacctgttttagctcacaatccataataaaattgcgcgtgtcatcgacaaaaaaatagcgaacggggaacattaccttgcttccccgtttcatctttatgcgcttactggtcagaccggaataaagtaaaaaacggtttccagcaccccttcggtatagtggcgcagatacagcttataatccgatcggaacgagaagaccagctcaggcaatttccagtaatcatcaacccggtgatagcagcaaatcgccagcgccggatgatgcgtaataatcgactggcgcgcgccttccagcgccgcatattcgtggccctctacgtccattttgataaaggtgggcgcttcggttaccagcgaatcaatggtatcgacgttaataacgatatcgccgttatcatcaaggtgtgaccagctgccggaggaggtgaatgtcagcgtctctttcttatttgaggcaccgcactgatgataataaatatcacgttcgtttgttaatttttcctttatcaccgccatctgccgcggctcaggttcaaacagatcgacccgatgatacgccggacagcggcgaataaactcgcgcgccgtttcaccgtcaaaactgccgacgtcgacaaaaaccggtttttccgtatgcagattaacaaagggttcgaaatagctttcctgggggcggaacgtaaaccaggacatcaggttaagatcctcttccagcctgaattttaccagccgggaaaaggtttcgcgtgaaatgtcatccgccagcaaagccgcgatacgatcgtatttctcgcgattgttccggtaatcgtcctgaaaggctgcggatgaaacaaacgcgccttcttttagcgggaaatcaacgtagtttttaaatgaaaaatagtcgataacctgtctgccgctgcttttcagcaggcgatccacgctcaccggacggccatcgacaattgcagacagcacgatggcgtgctgcggaacatcagccatttttaccaccggcaggccggcaaattcgcgctcagtggtaaaatcatcaataacgccatccggcgttatatattcagcgatgctggccgcataaggcgtacgcccgaaaatataacggggaacctctccccgcataaaggcgtcgcagagtgggcgaaggtgctcgctgcatgtattcgtcatgaaaacctcattcacaatcacttgatataaaaatcgacggcgtcgacgtcgagcaccagcacatcttcccgctgcgcgacatcaaggcgctccgggaaatagttatcgataaaaatggccggaccgctgatatacgccgatttcttttcaccttctttgaggtgaataatctcatcgaacagcagcggtgaaattgccgcgcgatgcagggtttcaatcggctcatgtacatggcgggtaattaaataaaggcgcttgccgtctatccggcactgatataaaaacgccagcaccgtgggattcggctggccgttgatgatcagcgtatcgtcaaaatcgacatacacatgctcatactgcaatgcggtatcagcgcgtgtgcggatggcgcgctcaaccagcgtgacgtgcggcgttaccagcggcgacacgtcgcgccccatataatcatgcagcgccatcagcggtaaattcaccccgcgggcgcgttgcgccaccatggtccccgcgacacggcaggagatttccagcagcttccagcgatcaaagcgatcctgtttaagctggaagaaccaggggccgcgcagagttacgcgttcattgatctctgcagcgatggtggcaatctcatcatccacaggaagcaaagtggaacgcatggcgatccccgctctgatacgctcacgagtacgcggcccggcccacaccagcttgccgttgcgatcggtaaaacagtcgacggtgacttcccggcccggcagatattccacgatcaccggcatgtccatcgtcgttatcgcctgcgcaagctgttgcgcatcggcggccagcaccacgccgttaccaccctgcccgcagtcgggtttgacaatcaccggccagtgttgtggttctgcgcccggcggatacatttcaggtacccagtccgtacccgcaaaagcctgataggtgagactctttcgccgcgccagttgggtggtatgcggatcgccgttcaccagataacagcccgctaattccgccatgcccgcgagtttttcacagacggtatcatgggtggcgaaaatcacatcaatctgttgtgttttcagcagatcgccaaaataaccgttgaatgccggatcgtgaataaaaggcacatcaccgatatagtcagaaaaatgaaaacgaccgtgatcttcaacgctggacgcgccaattaaacggttaacgtgcagggaataacgcagtgactgagctatctcaccggcattttctgaaccgcagggaaacaccagtacgtttaattttttcattattattcagtccttatcgccatcttccaccactgccctgacaatgtcgcttaattgctgcatatcgctttcgctgtaacgctggtcgcacggcaagggaaccatataattgacaaaatttgcttcaatgctgtccgctgtaacgcgatccagtacttcccgccagtaggtcgccacaaagacgccccgggcaattaatgccgcatgcaatgagcgggcaggaaaataaaacgggtaacaaaaagggccgctgacgggtaatgcaggaaagcgaaacgcattcagatccgcaagacgggcgcggagcaggcgataatttcgctcgcggatctgctggatctcgcggtaatttaccgcgcgcaataacctgtcggtcagtgccgacatgccgctggccgaaatggtgctcagcgccgcttccgcctgcaaaaacgcgccatagcctgaccgggtatcgtattcatgctgcagcaataaatgcgcggtatgactgtgcgtctcttctgtcggctcatccgcaggcggcagggttattgccgtttgcagtaatcccccgtcggcaacgccaaagaatttacgcggcgaccagagacaggccagcgcctttggcggcggggaataaaatccctgggagcgatcgataataacgctttgcgccggtaacaggcgtaataacctttcgctctgcgcctcgcagtggcctaaataatcgacgtataacagacagtcatccacgccgaatgcttcagataactgcggaaaatagtcgtcatccagctgataccagatgatttccacgccggatgccatcaccgcatcgattacgctctgacaaattaacaccggcatccagagccgctgcggacaacgggtcatcagcaggtgataaagtgcattgcgggcagagcgatattgccgtgcgtgcggataataatgtgattgcggggcaggtaattctaacgggaaatagccgccgaaagttttggttgtcatgggcggctttactcagtgtagtgataatgatccagcgcctggcgcacggcatccggagtgcagtacatcagcacgtcaataatggacaaattcggcacaaattcaggcgttccctgatcataggcaacattatttgcctgcagaaaacgcagggcgatcccttgtgccgcgaaagctgcggcagaatagagatgtcgcccaccggtactgttaacgtagatatcgccgctcagcgcgttgcacatgccgatcactttattttcggcattctccgtacggtcatagtcgagttcggatgagcggatcagccgccgcgtcaggccgagataagcgaggatattttccattccccgctggcaacaggcggtaatatcacgatcctgatgcagtaatacgtcctcgataagcggcataacgtcagaatacgccggggcgtgccggtaactctggcgcagcgtcttaagcagcttctcaacctgagtatcaaatgccagttcgccaatacgtttattggatgacgcgccgggcaccggcagcgtaaagcgctgcgcctgccccgccgctaacaacgtattgcggttgatgtagccctgtttgatgtagcaggcatcgtcataaagcacgaaaacgtccgcctgcgccagcagttgaaaatagccaatccacgggaaaagatagggctgcatgatcgacacaatcatctgcctgccctcatcaaccggcttcgtccattttaggctccacgcccaccagcgcggcggatttaatgatgtcggcgatgcgcatctgatcgtgacgcgccagatccggataaatgggcagacagaggatctcttccgccacctgattggctaccggcagcagcgatttggcggcgctgttcagcccgcgatacatcgggaagctactgatcaacggataaaaatagcggcgcgacatgatgccgttttgtttcagcagcgcataaagctcgtcacgcttcagggggtaatctttactgatgcgcaccgggaaataggcgtggttccagtcggtgctttccggcaccgagagcagcgtcatgcccggcacgtcggccagcagttcgcggtagtacgcatcaatagccgctcgcttatccagcgcgtcatcaatatgctgcaactgcattagcccaaaggccgcctgcagttcgttcattttgccgttgattcccgccgccaccacggtggtctcatcggcaaaaccaaagtttttaaggtaatcaatacgctgcttcattttggcgtcacgacagacgatcgccccgccctcaatggtgttgaatactttggtggcgtggaagctcagcacggaaagatcgccgtgattcaggatgctgttgtcctgctggcgaacgccaaaggcatgtgcggcgtcataaatcactttcaggccgtaaatatcggcaatgcgctggatcttgtcgacatcacacgggataccgtagcagtgcaccggcataatggcggtggtctgcggggtgatcagctcttcgatgcgctcggggcagatattaaaggttttcggatcaatatccgcgaataccggcgtcaggccgttccacaacagagtgtgagaggtggcgacgaaggagtatggcgtggtgatcacttccccggtcacgcgcaacgcctgcagagcagttaacagcgccagcgtaccgttggaaaacaggcagacgtgattaacgccaagataccgggcaagggcttcttcaagctcctgatggaattcgccaccgttggtaaggatcttgttctgccagattttctcgagatacggcatgaatttttcgagagggggcaaaagcggactggtgacaaaaatgttatcgcccatgagcaagcctgcaaggtaaagaggaatgttctcataatagcgaggggggcatggagcttatcggtaaaacaacaggcattttacgccctatttgaggtgaacgctcagacaggcgcagggtggacagtcgcagaaacggcccaccctgctgatggccttagccaggcagccaggctttcgcccactgggtaacgttatcgctgttcagcgtccagtcgcgtctgatttcatcatacagttcacgtcccatacgttcactggcgcctgcgttatccagatggaaacgaatcgcatccacccagtctttataacggtttttcacccgcgtgaccgaattaatggtctgataacaggccacgtcgctgcaaataaccggaatggcgcaggcaccgtattccatcaggcgcaggttacttttacaggcgttgaagatgttgtcttccaccggagccagcgccagatcgagattcagcgacgccagcttttgggggtacatttcaatatcaatacctgagtggaattcatggatccacggcagcagttttggcggacacatgccgaagaagacccactccacttcatccgcaaaggctttgatcacatcggcgatcatttccagatcgccggtatggctggagccgcccgcccagccgacgcgcggttttttaccctgctgacgtaagctggttaacccgccccaccagtcttccggcagacggttatgcatcaccacaatatccgggtgcaggtcggagaacgcttccgccagcggcgcggtagaaaccacaaagcggtccatatagctcaggcttttgcgcagcatcttaatgacatccacgctgaattccgcgcggtgcacgttctttatgggcaggttagtcagataatcatccagctcatacaccataaacgtattatcgatgcgggaaacccgcttcgcccaggcatgaaattccggggtcagctgacgctggaagataatactgtccggctggaaacgtttcagatacggaatactgaggaaggtttctgataattttccgtcggcaatggcgaggcgctccatcgcctcaaagggtttgatgacgcggtaataaccacatccggcgtaatccgccatatgagggatcaccaccggcagcggtttccaggacaacggacgccagctcagcaggctgtcagggcagaccataaactgctcgctgctgagcgacaggttggtgttgtacgccggatcgctggcgatctgcggctcccagcgtctgaacatttcatcttctgccgtctctatcgcctcctggcgtaccgcttcatccttttcactcagggccactttactcgccaccgagcggatcacagttgccgacggcgtccagacggtcagccagccctgagcgcgggcgcgcagacataaatccacgtcccagaagtcctgaatagtctcatccacgccggacagcgtgttaaagacgtcgcgtttaataaccagcaaatcgccggacaccgcgctgtagttctgatcgaaatgcaggcgacccatatgacctttatcgtcattattcgccccgaagaaggcttcccctgccacaccgtttaagcccagcacgtaaccggcatggcgcacggtgccgtcgctgtacaactgcttgccgccgacgatcgccacctccgggcgcagcgcgtggttaagcagttttgacagccagtctggctggctgatgatcacatccgggtggaggatggtgagatattccccctgcgccagggttgaagcctgattgatggtcgccgcgcggctaagcaccgcatcggtgagcgcgaccttaatgcgctgcggatcgatttccgccagcgacgccatccactgctgcatctccagcggcgcggcgccatcgcccaccacgatcagctcataaggcgaccaggttgttttttcgataagcgaggttacgcaggtgatcaaattagccagcaccctgcctgccgggatgatgatcgacaccagcggcgcagtggcgtggacataatcaatatggcaatgaccataaatatcgcgggtcaggcgcgcgtggggatagccacggttcgtcagatgacgcagcaggatctgattttcttcttttaccgcaagcgtgcgatccggagtaataaacagtggctcggccaggtgaccaatggccgaaaaaccattgttttcaatcaggcgcaccagaatatcgaattcaaaggcagctccggcctgcacatcaaatttacccacctggtttacgatctcgccgcgcagcagccagccgtaccccattaccgcagggttgcttaaaaacatatccaggctgaagtccgggcggaaacgcgcgccgatgggctgatcgttaacgtaaaagatttcgtcgccgcacaccgccagcaagcctgtggcttcaaccagcgtggttgacagagagatcaggccagaaggggtaaaagtggtgcccgccagcaccaccagatgccaggcctgcggcgcggctgccgcccgttcattcatcacatttacgatgcctgaatctgcgggcaatgtcgtgacaccctccagttcgaggtcggtgatgacaacaggcgtaattatcagcgaggaaaaatagcggctgttcaacgaggccagcgtgctgtatatcgccgtggcggtcgcctgacggccatcaatcagcagggttaactctgccgcttcacgccctgccagatgatcggcaatcagctgttcctgggttgccgtcagttttctgaccgacatccagtgctcgaacatgctttgtttcaggccatcttccagctgttgctcaatattttctacgcgtacggcggtcacatcatccagcggcgctacgcgggcaaacccaggcgcaacggtgtcgtccgcgccccaccctttgagggtcaggagttccgggaatcgtttatgggattctgccgcccttttatccttcatacgtcccagttggctgacctgttggtgcgaaaccctgaagctcgacagcggctccaccagataggccagatcgctgttgcgcagaattttggtgtacatcaccaggtcgccgagaaaatacatcagctcgccgtcaatgttacacagacgatcttcatgggcgattaacgccagcagatcttcccggtaaaacagcaccgtactgggttcaccgataaagttgacaatgcccttgtgctgaaaacggatcacatcgttaccgttcagtaccgaatcggcttttaccggcgcggcattggctctgtcgtccaccatacgctcgcccttgacatcaatacgatgacggcgcgaggtggcaatgcgaatagctggcgatttttcaatggcggccaccagcgccgacacgcagcccggcgccagcacatcgtcatcgaacagatatttaaggtatttcccttccgccatttcgatgcactgctcatagttaagcagttcaccgagcgccggtttattgcggatataacgcagcggcacagcggtttttttctgccacttttcgacaatgtccttgatctcgtcagtcgcgcaatcgtcgctgacgatcacttcgaaattactgtgatcctgagacagcgcgctgcaaagcgcctcttcaaaccaggccgatttatacgcgggtattacaatactgacgagagcgggctgtgccatggataatttcctgatgtgcttccaataccaaccgttaacctagcgcatttacgttttttcaatagcgctaaaaagagggcaaaccggggggatttctgcgggtttacgcttattcgggcataaaaaaacccggcagcgccgggttttgtttttctgcgtaagaattaacgcagcagggacagcatggtctgcggaacctggttggcctgagccagtacagaagaaccagcctgctgcaggatctgcgaacgggacatgttggaaacttctgtcgcgtaatcggaatcctgaatacggctacgagcagaagacaggttgctcacggtgttgttcaggttagtgatggtggactcgaaacggttctgagacgcacccagcaggctacgctgagagtcaacagatttgattgccgcgtcgatgtctgccagcggagtggtaccagaagctgcaccagatgcgccgccagtcactttacctttcagtacgtcaaagcctacagcttcggtggtacgtgcgttaccgttaacaacgtcggtaccggaaaccatggatttggtgttcagcacagtaccggaagaaccagcagaagccaggttgaagctgtcgctggagctgattttgatgccgatagtttcagcgtctttggaaccaacctggaagttgtaggtgctggagcttgcaccggtgttcagcactttgatgccgttgaagtcggtctgcttggttacgcggtcaacttctttcatacgttcgttaacttcagcctggatggagtcaacgtcggatgcggagttggagctgttctgcgcctgaacggtcaggtcacggatacgctgcaggttgttgttgatttcgctcagcgcgccttcagcagtctgcgacagagaaataccgtcgttcgcgttacgggcagcaacggtcaggccgttgatgttagaggtgaagcggtttgcaatcgcctgaccagcagcatcgtcttttgcgctgttgatacgcaggccagaagacagacgttcgatcgcggagcccagggaagactgagatttagtcaggttgttctgagtcatcagcgacaaggtattggtgttgatcactgccatggtatttatccttaattaatagtgttaatgctatttcggcatgtgcccaacggcctcatcgccttcaataatgttatcgacacgtgatgcagaagctttagcctttacgtcgatttattttgattatttctgcgcgtaaaaataaaaaaagcgccgataaacggcgctttttgcataaagctaaattgcgaattaacgcagcagggacagcatggtctgcggaacctggttggcctgagccagtacagaagaaccagcctgctgcaggatctgcgcgcgggacatgttggaaacttctgttgcgtaatcggaatcctgaatacggctgcgagcagaagacaggttgctcacggtgttgttcaggttagtgatggtggactcgaaacggttctgagacgcacccagcaggctgcgctgagagtcaacagatttgattgccgcgtcgatgtctgccagcggggtagagcctgctgctgcgccagttgcgccgccagtcactttacctttcagtacgtcaaagcctacagcttcggtggtacgtgcgttaccgttaacggtatcggtaccggaagccattgctttggtgttcagcacagtaccggaagaaccggctgctgccaggttgaagctgtcgctggagctgattttgatgccgatagtttcagcgtctttcgcgccaacctggaagttgtaggtgctggagcttgcgccggtgttcagcactttgatgccgttgaagtcggtctgcttggttacgcggtcaacttctttcatacgttcgttaacttcagcctggatggagtcaacgtcggatgcggagttggagctgttctgcgcctgaacggtcaggtcacggatacgctgcaggttgttgttgatttcgctcagcgcgccttcagcagtctgcgacagagaaataccgtcgttcgcgttacgggcagcaacggtcaggccgttgatgttagaggtgaagcggtttgcaatcgcctgaccagcagcatcatcttttgcgctgttgatacgcaggccagaagacagacgttcgatcgcggagcccagagaagactgagatttagtcaggttgttctgagtcatcagcgacagggtgttagtattaataacagccatgatggtattcctttgaaaaagttatcagattcaggcttccgcctacggttttctcaccgtcaacctgattatcgacagctcctccacaacctttagaaaaaaagatcatttttttaaaggcgcaaactgccggttaatgaggggctttattccgccattgttttttctaaaagactctaatcttttcgctgtcgctgccgatagaccatccagtgattgtctaaataagaaaggatgaatcaatggcatcgataagctcaatcggcgcgggtaccaacctgaacctggatactttatatagcaacctggaaaccgccgaacagacgaagttaagccctattacttctcaacaaacgtcttttaaagccaaactgaccgcatggaacgtggtgcaaactgcgctgaataaagtacagaccgcttccgatgcgctgaaaaatacctctgctatcgcctcggccaaagtgtccagcactaataccgcgttcagcgccgtgctgtctaatagtgcctctgcggggacgtactctgtagaagtgaccgcgctggcggcgtcacagtcgctgctcagcccgaaagtggccagtaaagataccgatctgggcgattccagcctcgcctcacgcaccattaccatcgcgcagccgggccagaaagatccgctgacggtgacgctcgcggcggataaaaccagcctcgcggatgtgcgtgatgcgattaacgctaaacagggcagcgtcaccgccagcatcattaaagcggacgacaacagctattacctggcgctgacctcccgtgacagcggcacgaaaaatgccatgaccgtcaccaccaatgacagcgagctggcaaaatacattggttatgacgccaccggcgctaacccaagcaatatgacgcaacaggttgccgctgccgacgcgaaagtgaagatcaataacattgagatcacccgcagcagcaacagcatcaccgatgcgccggaaggcgtgacgctgaacctgacgaagctcactaccggcaccccggaaaccctgacggtcgttaaagataacgccccgatgaccgcagccattaacgccttcgttgatgcctataactcgctgcaaaccactatcggcagccagaccaaatacacggcggttgataaaggtaccgctaccggccaggactccagcaacggcgatctgctgggcgacggtacgctgcgcaatatccagacgcgtctgcgctccatgctctccacgtcccagactaacgacggcaccctctctgccctgtcgcaactggggatcacccaggatatcaacggcaaactgacggtcgacagcaccaagcttgataaagcgctgaacgaaaaaccggcggacgtgatcagcttcctgtccggcgatggcaaaaccaccggctttgccacccagaccagcagcctgctgaaaagcattctcggtactgatggctcactgaaaaatgccaccgacggtatcaacaagtcgttgaaacagctggatgagcaaaaagagcgtgttaccgcgcagatcaccgccaccatggcccgttacaaaacgcagtttactgcactgagtcaaatggtttcctccctgacctccaccggcaactatttgacccagcaatttaacgcgatgaattcataagttatttattgaggtttgctatgtatacaaaatcgggaattcaggcttatgcaacggtcggcgtggaaagcgccgtcctgagcgccagcccccatcaacttgtggtactgctgtttgacggcgccttaagcgccatgaaaaaggcggccattctgattgagcagggagatattcccggtaaaggacaagcgctgtcgaaagccatcaatatcatcactaatggtttgcgcgcgggacttaaccacgatgtcggtggtgagctctccgcaaacctggacagcctgtatgactacatgacacgacgtcttttacacgccaatctgcacaatgacgtcagcgccattgaggaagtcacaattttgctcaacaacattgcggacgcctggaaagaaattggtcccaataatcctaatgcgcgagagtccttctaatggaagcacatgtcgggttgctccaccactatcagcagttactaatcgccagttgcagtatgcttactctcgccagagaaggccgctgggacgatctgattgaacatgaacttaactacattgcggcagtggaaagattgacgcagtttcaggatgccggagaggtggcacctgccgtccaggcgcaggtccgtccgctgctccggcagatccttgataatgaagtcgagttgaaaacgttattacatcagcgcatggaagagctgcgcaccctggtgggacaaacctcccgccagcacaacctgaattcagcatatggacgtctttccggtaatattctgttcccgagcgagctgtaagttccgcttctgaccggcgggtgacgttttttataaactgcgcccgcgtcattttttgattttcacccatacttcgttgatccccacaccggagcatggaagatgaaaaaccccaccttattgcagtgctttcactggtattaccctgacggcggaaaactctggccggaaatcgccgaacgcgcttcaggtttcaatgacatcggtatcaatatggtctggcttcccccggcgtccaaaggcgcatcgggcggcttttccgtaggttatgacacttacgatctgttcgatctgggcgaattcgatcagaaaggcagcgtcgccaccaaatacggcgataaagcccagctactggcggccattgccgcgctgcgggaaaacgatatcgcggtactgctggacgtggtggtgaaccataaaatgggcgctgacgaaaaagagtccatttgcgtcaaccgggtcaacgaacacgaccgcacgcagattgatgacgcggtgattgaatgcgaagcctggacgcgctacagctttccggtgcgtcagggccagtactcgcgctttgtctgggactacaaatgcttcagcggcatcgaccatattgaaaatcctgacgaagacggcgtgtttaaaatcgtcaatgactataccggcgatggctggaaccatcaggtggacgatgaactggggaacttcgactacctgatgggcgcgaacatcgatttccgcaacaccgcggtggcggaagagatcaaatactgggcgcgctgggtgatggagcagaccggctgccagggtttccgcctcgatgccgtgaagcatattcccgcctggttctataaagagtggatcgagcacgttcaggatgtcgcgcctgaaccgctgtttatggtggcagaatactggtcgcacgacgtcgataagctgaaacagtatatcgatcaggtggacggtaaaaccatgctgttcgatgccccactgcacatgaaattccacgaagcctcgctccagggcagccatttcgacatgagccagattttcaccggcacgctggtggaagccgatcctttccatgccgtgacgctggtcgccaaccacgacacgcagccgctacaggcgctggaagccccggtggaagcctggtttaagcccctcgcctacgcgctgatcctgctgcgggaaaacggcgtgccctcggtgttctatccggatctgtttggcgcaagttatgacgataccggcggtgacggcgaggtgcatcacgtggatatgccgatcatccaccagctggatcagttgatcctcgcccgtcagcgcttcgcccacggtgtgcagacgctctggttcgatcatcctaactgcatcgccttcagccgcagcggtacgctggaggagccaggttgcgtggtggtgctctcgaatggtgatgacggcgaaaaaacactgagtctcggggataactacggcaataaagtctggcgggattttctcggcaaccgcgatgaaagcgtcaccaccaacgccctgggcgaaggcaccttcacctgtaacggcggcagcgtcagcgtgtgggtaatagaagaggctgcgtaaaacaacgggcagcgcggggaacgcccgcactgccctgtcagtcagggtaacggcgacggcagcggatttttcgccagcgcctcggcgcattcgctggtcgggcgttcgacgcgtttaagcgtcatgcccgcatactccagctggttgccttcccgctccacaccataaatttccagcttacgggtgacgtttttcagatcgtcgccgctcagcatcagtttacccggtacggcaatcacccgctgccactggcggcagtccagcgtatcgccatcctgggtgacgatcaggctggccatcgcctccgggctgaccagcgcgctctgtgggccgtttgactgccagtaaccggcaagccccgccggtgcgggatgttttaccaccgcctgataatcttccacttgcgcacagccagccagcgccagcaatgcgccaagaattgctacttttttcatctgttatcctgctcatgaagaaaaaaaacagtgtggcattaaagcgttgcccctgccagcctttcaccgatacggcataaaattgatctctgccagataaaagggtctttctgctttgcaaacccgcgcacgcgtgtagtatcgcctcttcttttaaaaccttctgagttcagaggtcattaatacaatgtcgtggcaacagttcaaacaggcctggttaatcaaattctgggcccccgcccctgccgttatcgccgcagggatcctctccacctactattttggcattaccggcaccttctgggcggtcaccggcgaattcacccgctggggcggtcagctgttacagctgatgggcgtacatgccgaagagtggggttactacaaattgatccatctggaagggacaccgctgacgcgtatcgacggcatgatgatcatcggcatgttcggcggctgctttgccgccgcgctgtgggcgaacaacgttaagctgcgtatgccgcgtaaccgcatccgtatcgcgcaggccattgtcggcggcattattgccggtttcggcgcgcggctggcgatgggctgtaatctggcggctttcttcaccggcattccgcagttctccctgcacgcctggttcttcgcgctggcgaccgctgtcggcacctggtttggcgcgcgcgtcaccctgctgccggtcttccgcatcccggtaaaaatgcagaaagtctccagcgcctcgccgttaacccagaaacccgagcaggcgcggcgtcgttttcgtcttggcatgctggtgtttgtcggcatgatcggctgggccttgctgacggcgatggataagccaaagctgggtctcgccatgctgttcggcgtcggctttggcttactgatcgagcgggcgcagatctgctttacctcggcgttccgcgatatgtggatcaccggccgcacccatctggcaaaagccattgtgctggggatggcggtcagcgccatcggcatctacagctacacgcaactgggcgtcgagccgaaaattatgtgggctggtccgaatgcggtactgggcggtctgctgttcggctttggcattgtgctggcgggcggctgtgaaaccggctggatgtaccgcgcggtggaaggccaggtgcactactggtgggtgggggttggcaacgtgatcggctccacgctactggcgtatttctgggacgacctgtccgcgccgctggcgacaagctgggataagatcaacctgcttaacacctttggtccgctgggcgggctgctggtcacttacgccatgctgctggcggcgttcctgctgatggtggcctgggaaaaacagttcttcaaacgggcggcgcgcgtcgccattaaggagccagcatgaaagctatcgtgcctgattatcgtctcgatatggtgggcgaaccctgcccctacccggctgtcgccacgctggaggcgatgccgcagctgaaaaaaggcgaaattctggaagtggtcagcgactgcccgcagtcgatcaataacattccgctggatgcgcaaaaccacggctataccgtgctggacattcagcaggacgggccaaccattcgctatctgatccagaaatagggttaagtctccctccgcctgacgggaggcgtttttccactacagacggctgagattgtcatcaatgctggcctgaatatcccggagcgtctgaggcgttatctcccgcgcgaaacgggccttcgccctggcggtgaaaccgctggccacgtcagcaaatcgggtaatgagcgcgctgatttgctcagccgttaattccgcctcctgcatacccagacgttcgatctgctcgcgacggattgccagcgcctcgcccagcacatccatctgatgatagccgccggggccgtcgcaccaggtaacgtcataagcgggagcgagcgtccattttccggaggctgacatcagataagcaaagttcttcggatgatcgtcacggttatgaaagatgatattgaacagggcgcgttcaaaagcccgctgtttttcccgcacatcgttcgtacaaacttgcgtggcgcgcagaaagttcacatagtccatcgatccggcaagctggtaattcgcgccagtaaaagccgccaggctttgcatcggcacacgcataccgttgtggcgatcaaagcgtcggctgccaaaggccgcctgcccgcccggaagggaaaaatattcggtatcaggggtgtcgatgccgcattcgcgcaggcattcggcatagagcatttcgatggcgcacacttccggatgttcactgcgggccgggaatttgatcagccagggttgcagaccgtcctgttgcgccgtggtgaaaaggccgctggcggcattacggtagaccagagctttgggtcgtgcgccgtggggcgagccgcccacttgcagcagacgggccagaaactccccgccttcgccgtccagcacgtcctgcacttcactggcaagctgcgccagcggaatatccacatccgccgatgtggcctccgcctgatgaggcacaaaagacattgcacccatggcgttatcaccaatccaggtcagccgctccagcggcccaatgcgcgcggcattcaaaccgcgctgcctgaacagacgatccatcagcaacatgccccagccatccggcagtgaatcataaaccgggccgggtaatcccagttgatgtgcaggaaagccctgccgcagccgttcgcccttaagaggcaaggtccaggccgacagctcaaggccgcgtgtcagcgccgcctgactgtattcgaaaaagatcaccggacgggcgctcagcgccgtcgtggtcgccagcgtcccccacagccagcgttcaccccagccttcatagtaaacatccacacgatcaggcatggtcgttcctctttttgatgcgctggcggctggtgctttcttcgtaacggcgtaaatcgtccagcgtggtaagctgcggtttgaaaagttcttccagctctttaccccggccaagcaccatcgcgatacgcaccacgctttcaaaggcgatattacgccctgcttccatattagaaaccgtgttgacgctcacgcctgccctgccagccagttcggcctgggtcatttgttgcgcgatacgcatttgccgtaagcgctcgcagagcaacttaacgatctcgtcgggtttgctgaaggtaaagtcaatcatgttatcggttaccgcctgaggttgcgcttaactgaaaacattataggaaatgagcgggaggagaggtaggaaataatacccaataaaaaagatttacaggcataatacgcctgtaaaccccaataaataagaattataaaagcggtgaactacacctgcatcgacatcacgtcctgataggcggcaaccagtttgttacgcacctgaatgcccatttgcagggacacggacgatttttgcagatcggtcatcacgtcgttcagcgccacgccgggttcaccgagggtgaatttctcagcctgggtgcgcgccgcgttttgcgtatcgctgatgcgatccagtgccgcatgcagctgtccggcgaagctcaccgtcggttcgctttgcatactttgattcttcgcgatccccgccgttgcctgcaactggctgatgaccccttcaataccctgtactgacatggttttaccccacatgatttgataccaggtaagactaacagcttgtcaataagataaaggcggcaaatagcgataaaaaaccaggttatttgacccatagaaaattccgaatcatcaaataatgactccgccatcaacatggaacttttgtcgtgtttgccgacccgggagtctgttttgcttcattacacgaataacgccgtccgcccagagttaagaggtgcgcaatgagtgcgactgcaacgactgcatcacaaaataaatctctcgagtggatgaaccgcctgcgcgcgaaccccaaaatccctttaatggtggcgggcgctgcggctgtggccatcatcgtcgccatggtgctgtgggcgaaacagccggattaccgcacgctgtacagcaacttatccgatcaggatgggggcgcgatcgtcacccaactgacgcaaatgaacatcccctatcgcttctctgaaaccggcggtgcgctggaagtccccgcggacaaagtgcatgaactgcgcctgcgcctggctcagcagggcctgccgaaaggcggcgcggtcggttttgaactgctcgatcaggaaaaattcggcatcagccagttcagcgagcaggtgaactaccagcgcgcgctggaaggcgagctggcgcggactatcgaaaccctcggtccggtcaaagtcgcccgtgtgcatctggcgatgccgaaaccgtcgctgttcgtgcgcgagcaaaaatccccgtccgcttccgtgaccgtgaatctcgaaccgggccgcgcgatggacgaaggtcagatcagcgccgtggtgcatctggtctccagcgccgtcgccggactgccgccgggcaacgtcaccctggtggatcaggccggccatctgctgacgcaatccaacaccagcggtcgtgatctgaatgatgcccagctgaaatacgccggtgatgtcgaaggccgcattcagcgccgcatcgaagctatcctctcgccgatcgtgggtaatggtaacgtccatgctcaggttaccgcgcagattgattttgccaataaagagcagacggaagaaaactaccgtccgaacggcgacgcggcgcaggccgtactgcgttcccgtcagatcaatgaaaccgaacagtccggcggcagcgccggtggcgtgccgggcgcgctctcaaaccagcctgccccggccaataccgcaccgatcaccacgcctgcggcgaataatcagcagaacggtcagcagaatcagaacgcgcagcagacctccacggcagccagcagcggcccgcgtaacagctcgcgtaatgaaaccacgaactacgaagtggatcgtactatccgccacaccaagatgaacgtcggcgatgtccagcgtctgtcggtggctgttgtcgtgaactatcgccagctggccgacggcaaaccgctgccgctgactgccgatcagttaaaacagattgagaacctgacccgcgaagccatgggctactcggaaacccgtggcgacagcctgaacgtggtcaactcccagttcaatgccaccgatgatggcctggcggaaccgccgttctggaagcagccatggtttatcgaccagatgctgtctgccggtcgctggttactggtgctgattgtggcgtggatcctgtggcgtaaagcgattcgtccgcagctgacccgccgcgcagaagaagtgaaagcagcccaggaagcgacgcagaatcgtcaggaaatcgaagaatcagttgaagtacgcctgagcaaagatgagcagatccagcagcgccgcgctaaccagcgcatgggcgtggaagtcctcagtcagcgtattcgcgaaatgtcagataacgatccgcgcgtcgtggcgctggtcattcgccagtggatgagtaacgaagaacatgagtaaccttaccggaactgagaaaagcgtcattctgttgatgacgattggcgaagaccgcgcggcggaggtgttcaagcacctctccacccgtgaggtgcaacatctgagtaccgccatggcgggtgtgcgtcagatctccaacaaacagctgaccgatgtgttacaggagtttgagcaggaagccgagcagtttgcggcgctcaacatcaacgccaacgattatctgcgttccgtgctgatcaaggcgctgggcgaagagcgtgcttccagcctgctggaagatattctcgaaacccgcgacacctccagcggtatcgaaacgctcaactttatggagccgcagaccgccgccgaccttatccgcgacgagcatccgcagatcatcgccaccatcctggtgcacctcaaacgcggccaggcagcggatattctggcgctgttcgacgagcgtatgcgtcacgatgtgatgctgcgtattgccaccttcggcggtgtccagccagccgcgctggcagaactgacggaagtgctcaacagcctgctcgacggccagaacctcaagcgcagcaaaatgggcggcgtgagaacggcggccgaaattatcaacctgatgaaaacgcagcaggaagaagcggttattaccgcggtgcgcgaatttgacggcgagctggcgcagaaaattatcgacgagatgttcctgttcgaaaacctggcggaagtggacgatcgcagcatccagcgcctgttgcaggaagtggattccgagtcgctgctgatcgccctgaaaggtgccgaacagccgctgcgcgagaaattcctgcgcaacatgtcgcaacgtgcggcagatattctgcgcgacgacctcgccaaccgtggtccggtgcgtctgtctcaggtggaaaacgaacagaaagccatcctgcttattgtgcgtcgtctggcggaaaccggcgagatggtaattggcagcggcgaggatacctatgtctaacgaactgccatggaaagtctggaagccggaagatctggcgatgccgttatccgaattcgtgcccgccaccgtgcgtgctgacgcgaaagaggatgacgaggacgtcgtcgaagaagagatctccgaggagcagaaacgtcagcaacagctggcgcagatgcagatgcaggcccatgagcagggatataacgccggtctggcagaaggccgcaagatcggtcaggaacaaggttataaagaaggcctcgcccagggccaggagcagggactggcgcaggcccatcagcaacaggccccgctgcatgcccgcatgcagcaactggtcagcgaattccagtacacccttgatgcgctcgacagtgtgatcgcctcccgtctgatgcagatggcgctggaagccgcgcgtcaggtgatcggccagaccgcctgtgtggataacaacgcgctgatcaaacagatccagacgctgttgcagcaggagccgctgttcagcggtaaaccacagctgcgcgtgcacccggatgatttacagcgtgttgaagagatgctgggcgccacgctcaacctgcacggctggcgtttgcgcgccgatccgaccctgcaccctggcggctgcaaagtctctgccgatgagggcgatctggatgccagcgtggcgacgcgctggcaggaactgtgccgccttgcggcgccgggagttgtctgatgaccgcacgcctgacccgctggctgaacacgctggataattttgaaagcaaaatggcgcaactgcctggcgtgcgccgttatggtcgtctgacccgcgccaccggtctggtgctggaagccaccggcctgcaactgccgctgggcgcgacctgcattattgagcgtcaggacgggaacgaaacccgcgaagtggaaagcgaagtggtcggttttaacggccagcgcctgttcctgatgccgctggaagaagttgaaggcatcctgcccggcgcccgcgtgtatgcgcgtaacgccagcggcgatggcctgcacagtggtaaacagttacccctcggcccggcgctgctcgggcgcgtgctggacggcagcggtaaaccgcttgacggtctgcccgccccggacaccaccgaaaccggcgcgctgatcacccagccgttcaacccgctgcaacgtaccgctattgaacacgtactggataccggcgtgcgcccgatcaacgccctgttaaccgtgggccgtggtcagcgtatggggctgtttgccggttccggcgtgggtaaatccgtgctgctcggcatgatggcccgttatacccaggccgatgtgatcgtcgtcgggcttatcggcgaacgtggtcgcgaagtgaaagattttatcgagaacattctcggtgccgacggtcgtgcgcgttcggtagtgatcgccgcccccgctgacgtctctccccttttgcgtatgcagggggcagcctatgccacgcgcattgcggaagatttccgcgatcgcggtcagcatgtgctgctgattatggattccctgacccgttacgccatggcgcagcgtgagatcgcgctggcgattggcgagccgcccgccaccaaaggctatccgccgtcggtgtttgccaaacttccggcgctggtggaacgcgcgggtaacggcatccacggcggcggctcggtcacggccttttataccgtattgaccgagggcgacgatcagcaggatccgatcgccgactcggcgcgcgccatccttgacggccatatcgtgctgtcgcgccgtctggcggaagcgggccactatccggccattgatattgaagcctccatcagccgtgccatgaccgcgctgatttctgaacagcattacgccaaagtgcgcacctttaaacagttactgtcgagcttccagcgtaaccgcgatctggtcagcgtgggggcctatgcgcgcggcagcgatccgatgctggataaagccatcgccctgtggccgcagcttgaagctttcctgcaacagggcatttttgaacgtgccggctgggaagattcgattcaggcgctggatctgattttcccgtcagcataagcaacgtgaggttcctttatgacgcaacatagcgcattagcgacgctaaaggatctggcagaaaaagaagtcgaggacgccgccattaccctcggggatatgcgtcgcgcctgccagcaggcggaagagcagctcaacatgctgatggattaccagaacgagtaccgtaataacctcaacgttgacatgacccagggcatcggcagtcagcgctggcagaactaccagcagtttatttcgacattagaaaaagccatcgaacagcaccgtctccagctgacgcagtgggccaataaagtggatcaggcgttaacctgctggcgtgaaaaaaaacagcggttgcaggcgtggcaaaccttacaggatcggcaatccgcttcagcattgctggcggaaaaccggcttgaccagaaaaaaatggacgagtttgcgcagcgcgcatcattgaggaaaattgaatgatctctttgccaaaactggtaatgaccgatgcagaagccccgacttccgggctgatgaccgggaaagcggacactggcgcgcaggattttatggcgctgctgaccggcgcaatttccggcacgccggttgagggtgaaggcgcgtcactgtcgctggctgatttacagtcagcgggcgcgacgcttcagaaaggtttgctgagtaaggacaccggcgaggcggatctgcgcactccggcggctaagcttgcggatattctggcgcgtcagacggtgcaggaagaggcgctgacagaagacgcctcgcaggcgcagggcgtgacgccgctgctgaccagcggcctgaaatccgacagcctggcgctgctcaataaaaccgtgaaagccgacgacatagagacggcggatcttagcgaagaagagatcgccagccttagcgcactgctggcgatgctgcctcatcagcaaaatgcccaggccgccgcacctgttaccacaaccggcaccgccgcttccgccgccgtgacgaccactgccggcagccgcacgctgaacctggccgccgccgatccccgtggcaacgcgttaaccgacacggcggatgccgcagccggtcaaccctcccataaagacgcgggcgcggcgctgaacgcacaattgccaggcgctgacagcgcgcagcaagccgccgccccggtagccgctaacgccgccaaagccgatgcgcaggcggcgatccatgccgtgaatactacggtcagcgctgctccggccgtcagcaccgccgcgccagcgcaggccagcctgccggttgccgctccggtgatcagcgcgccgctcggcagcagcgagtggcagcagaccatcagccagaacatcacgctctttacccgtcagggcaaacagagcgctgaactgcgtctgcatccggaagatctgggccaggtgcagatcaacctgaagctggatgataaccaggctcagattcagatgatgtcgccgcacagccatgtgcgcgcggcgctggaagctgcattgccgacgctgcgcaccagccttgcggaaagcggcattcagctgggtcagagcagcatcagcagcgaaagctttaccggtcagcagcaatcgtcttcccaacagcaggcgtcccgcggcagcaatcgcggtgatttcggcgctgaagatgatgacgctctggtggtgcctgccagcctgcaatccgccgcgcgcggcacgggttcggtagacatctttgcctaaacgcaaaaggtagcgtgattatctccgtcttttccaccctttgacggacggcagacacgggataatcactctatcagcagtaccgaaacaggaagcttgtaacagatgactgactccgccattcccaaaaaaagtaagcgtgggatctggatcccgctgttggtgttaatcaccctcgctgcgtgcgccaccgctggatacagctactggcgtatgcaacagcatccggcagacgccagcgtaaaagcagaattaccgccgcctccggcaccggtcttctttgctctcgatacctttaccgtgaacctgggcgacgccgatcgggtgttgtacgtggggatcaccctgcgtctgaaagatgacgcgacccgtacccgtttgagcgaatatcttccggaagtgcgtagccgcttactgttacttttctcgcgccaggatgcgtcacaactggcgaccgcagaaggcaagcagaaactcgtggacgcgattaaagatacgctctcttcgccgttagtcgccgggcaaccgaagcaggaagtgactgacgttctttatacagctttcattttgcggtaaagacatgggcgacagtattctctctcaggctgaaatcgatgcgctgctcaacggcgacagcgatagtaacgatgctccaaaacccggtgagggttttgagagcgaaattcgcccttatgatcccaacactcagcgtcgcgtggtgcgagagcgtttacaggcgctggagatcattaacgaacgttttgcgcgtcagttccgtatggggctgtttaacctgttacgtcgtagcccggatattaccgtcggcgcgatccgtattcagccgtatcacgagtttgcgcgtaacctgccggtaccgacaaaccttaacctgatccacctgaaaccgttacgcggcaccgggctgtttgtgttttccccaagcctggtgtttatcgccgtggataacctgtttggtggcgatggccgcttcccgacgaaagtggaaggccgtgaatttacccataccgagcagcgcgtgatcaaccgcatgctgaagctggcgctggaaggctacagcgatgcatggaaagcgatccacccgctggacgtggaatatgtgcgttcggagatgcaggttaaatttaccaacatcaccacgtcgccgaacgatattgtcgtcaatacccctttccacgtggaaatcggtaacctgacgggcgagtttaatatctgtctgcccttcagcatgattgagccgctgcgtgaaaccctggttaacccgccgctggagaactcccgcaacgaggaccagaactggcgcgataacctggtacgtcaggttcagcactctgagctggagctgatcgcaaacttcggcgatgtacccctgcgtctgtcgcagatcctgaaactgcaacccggtgacgtgttgccgatcgaaaaacccgatcgcatcattgcccatgtggacggtgtgcctgtgctcaccagccagtacggcacgattaacggccagtacgccctgcgtgtagagcatttgatcaacccgatcttgaattcgctgaatgaggaacagcccaaatgagtgacatgaacaatccgtccgatgaaaacaacgaagcaatggacgatatctgggctgatgcgttaaacgaacagaaaaccaccaccagcagcaaaagctccgctgatgcggtgttccagcagtttggcggcggcgatgtcagcggcacactgcaggacatcgatctgattatggatattccggtcaagctgaccgtggagctgggccgtacccgcatgaccatcaaagagctgctgcgtctgacgcagggttccgtggtggcgctggaaggtctggccggtgagccgctggatattctgatcaacggttatctgatcgcacagggcgaagttgtggtggtggcggataaatacggcgtgcgtattaccgacatcattaccccgtctgagcgtatgcgtcgcctgagccgctgagtatgaaaacccaggcaaccgttgcccatccttctgccgtacccggttcgccgctgctacaggtcagcggcgcactgctgggcattattgccctgatcctggtggcggcatgggtggcgaaacgcgtgggctttgccggtaaaaccgccagcgcgcgcggcctgaaggtcagcgccagcaccacggtcggcccgcgcgagcgcgtggtgatcgtcgacgtggaagacgcccgtctggtgctgggtattaccgcgtcaaacatttccctgttgcacaccctgccgcccgcccagccggagccggaaggtctgaaagagaacaccccggatttccaggccgtgttgaagaatttgctcaagcgttccgggagatcctgatgcgccctttgttatcccttgcgctggctggcttaatgctgattgcgccctctgcgtttgcccagctgccgggtctgatcagccagccgcttgccggtggcggccagagctggtcgctgccggtgcagacgctggtgtttatcacctcgctcaccttcctgcctgccattctgctgatgatgaccagctttacgcgcatcatcattgtgttcggcctgctgcgtaacgcgctgggtacgccctccgcgccgccaaaccaggtgttgctgggtctggcgctgtttctgacctttttcattatgtccccggtgatcgacaagatttataccgaggcgtaccagccgttttccgagagcaaaatctccgtcgacgtggcgctggaaaaaggcgcgcagccgttaaaagaatttatgatgcggcagacccgcgaagcggatctggccctgtttgcccggctggggaataccggcccgttacagggcccggaagcggtgccgatgcgtattctgttgccggcttatgtcaccagtgaactgaaaaccgctttccagatcggctttaccattttcattccgtttttgattatcgatctggttattgccagcgtcctgatggcgctcggcatgatgatggtgcccccggcgaccattgcgttacccttcaagctgatgctgttcgtgctggttgacggctggcagctgctggtgggatcgctggcccagagcttctacagttaaggaatggcactatgacgcctgaatcggtcatgatgatgggcaccgaggcgatgaaaatcgcccttgccctggctgcgccgctgctgctggtttcgctggttaccggtcttgtgatcagcattttgcaggcggcaacgcagattaacgaaatgacgctgtcgttcattccaaaaatcatcgcggtggtggtggctatcgtggtggccgggccgtggatgctgaatttactgctcgactatatgcgcggtctgtttaataacatcccgtacatcatcggataacgcctgagatgctgcacgtcaccagcgaccagtggctgcactggctaagtatgtatttctggccgctgctgcgcgtgctggcgctgatctcaacagcccctattctgagcgaacgcactgtgcccaagcgcgttaagctgggcctggggctggtgatcacctttgtgatcgccccctcgctgcccgcgaacgacgtcaccatcttctccgccaatgccctatggctggcgctacagcagattttaatcggcattgcgctcggttttaccatgcagttcgcgtttgccgctatccgcaccgcaggggagcttatcggcctgcaaatgggtctgtccttcgccaccttctttgatcccgccagcaacctgaatatgccggtgctggcgcgctttatggatctgctggcgctgctgctgtttctgacctttgacggtcatctgtggctgatttcgatgctggtggataccttccatacgctgccggtgggcaacaaccccattaataccaacgcgtttcttgcgctggcacgggctggcggcctcatttttatcaatggtctgatgctggcgctgccggttatcaccatgctgctgacgctcaatatgtcccttggcctgctgaaccgtatggcgccgcagctttctgttttctctattggttttcccatcacgctcagcgtcggcattctgctgatggctttactgatgccccttatcgcgcccttctgcgaacatttattcagcgaaatcttcaatctgctggcggatattgttggcgagctgccgcaaaatactaatccataacgttagtgcagttttcctgaggttattcctaaaaatttattgcaggcacatctaccaggatataactggcgcggcttatttgtttttaccctcttcacataactaaacatttactttactttaagatgattcctggcaaattatacgtaactttacgggatagtaagttcgcctgaaagtcttgtgttgctcaaacgctttttagattattttcatccggttggctgatcgtacagcattcaggcaggggtgaattatcgttacgcattgagtgagggtatgccatgtcaacgattattatggatttatgcagttataccaggttgggattaaccggatacctgacaagccggggagtaaaaaagcgagaaatcaatgatgtacagacagtggatgagcttggatctgcctgcgaggcgctaaaacccgcagtggtatttattaatgaagactgctttattcatgaccaggaactgagcctgcaaattaagcaaatcattaatcagtatccgaaaacaatgtttatcgtgtttatggcaattgctaatatccactttgatgaatacctgctggtacgcaaaaacttattaattagttcaaaatcgattaagcctgaatctctggacgacatcctcggtggttgtctgaatacggagtcaaagggcacgggttccattaatctccctacactctctttaagccgtactgaatccagtatgctgaaaatgtggatgtccgggcagggaaccattcaaatatcagatcaaatgaatattaaagcgaaaacggtatcatcacataagggtaatattaaaagaaaaataaaaacgcataataagcaagtgatctatcacgtggtgcgtctcaccgataatgtgaccaacggtattttcgttaacatgcggtgagagggtaagcgggcgctcccctcccccgccggagggtttactgttcctgcttctcaacaaatatcccgtccggatgcccgagttcattaaagaaccagatgcctaacgggtagtcctcaagggataccagatacatggtgccctcactgaacggctcgatggccagaaccactcccggacggcgaggacccccgtccgttttcaccgtaaccttatcgtttaccttcattttcatcctcctgaatgcatttttgccagtgtagatcaaatccgctgttctgacagtgttcatctgccttattgctgcttttctccaccgtctatacttaggctgtcggggcgaaagaggtaacggcaatgaaaggcgatcacggcactaaaccttctggcgaaggtgaaatcaacgttgacgctctgctggccgccatcaatgaaatcagcgaaagcaatattcatcgtatagacagcgatgacggacaacgggtgagcgttgacgggcgcgattatcatacgtggcgggagctggcggaggcatttgagctggatattcgtgattttagcgcatcagaactgaaccgctgacatcaggatataaaaaaacccggcctggggaggccgggttaaagcttgcgattgcaagaagcacttgaaaattcgttacaccaggaaatctgatgcgggagagactgtatctactattgatatagctgacaaggatatatttacaatggtaataattcactaacatagaattcataaaggttataattggcaaggtcgcgcggcagaagacttgcagcgttgcacctctgacaaaaagccttacaaaccttcacagtatttaagaattttcttagctctgcgccattttattctgactacaggagccgcttttatgccagcccttcacgacccgctactgattttcaccgacctcgatggcactctgctggacagccatacctgggactggcagcccgccgccgaatggctgagccgccttggacagcagcagatcccggtcattttatgcagcagcaaaaccgccgccgaaatgatggcgttgcagaaaagtcttggcttacaggatctaccttttattgccgagaacggcgcggtgatccatctggatacgcactggcaggatcacgccgattacccgcgactgattaacggtgcgtcccatgacgaggtggtacaggttctgattcggttacgcgagcagcatggcttcaaatttaccctgttcagtgaactggaagaccgggtactggcggaggttaccggcctgacgcctacccaggcgggcctggcgcggctgcacgaggcttctgagacgttaatctggcgcgacagtgatgaacgcatgaacgccttccgcagcgccctggaaggcctcgggctgcgttttatgcagggggcgcgctactggcatgtgctggatcagcgcggcggtaaagaccaggccgtaaactggctgaccagtcagtaccgccagcgcgttggtcatccccacaccactatcgggcttggcgatggccccaacgacgctcctttactggataacgtcgattttgcggtagtggtgaaaggccttaaccgcgacggcgtcacgctcgctaatgacgatccagaccgcgtgtatcgcacgacgttaaaaggcccggcaggctggcgtgaagggctggatcactggcttggcgattcctgatcttcatcgctggcgcatacctgattgcgcccgctgcgcttggcacggtaaagccggttatcggcgatggactgcaacatctcaaaattggtcatctcatcggccacgccgctgctgacacccagcgacgcggtcatccttaaggtacggcctttcggcagcaggatctctttcgcggcgatgcgcgcccggatacgttcagccagggccttcgcctgcgccagcgtgctgtccggcaaaatcacgcagaactcttctccgcccacgcgtcccgccgcatcagtggatcccagcgtgttttctatcagccgcgccacgtgcgccagcacccgatcgcccgcctggtgtccgtgacggtcattgacctgtttaaaatggtcgaggtcaatctggatcaccgataacggctcgccggtttgctggctttgcgcggtgagttttttcgcctgctcaaacagcccaccgcggttgctcaggcgcgtcaggggatcgtgccaggcctgccatcgcagggagttttgcatctggtacatattgcgaaccatccggcggatcaccatccatgacagcagcaccatggtggtgaacagcagccagagcagcgcaatcacaatgctgatggtgccaaaatcgccatccagaccggcgctcagggagtgaatacggatcagtacaccgtcgaaatggcggaggttttgccagctgacaaactggctgccgagatgcagattaccggtggtctcatgggcgactgcctgtagcagctcatgccgatctgcctcgctgaacgcttccggcgcggcatcgttattcgtcgaggcggtgattaacctgaactcgctgtcatagagctgatactcgccctggtcttcatcggtaagggagtcttccagttgcttcttaagcaggaccaccgggaactgtagcgcaatggtgccgtaccagtaatcctgatggtcgagcggaatgctggcggtgacgtaagcgcccttatggccggtatgggcaaaccagcgcacattgcgttcgtgattattatgttgcgactgaccgctgaaccaggacgaattaatgatcctctggtagcgggtaacgatatcatcggtgcctggcggagcgctggttgaaagaaaatagcccgcgcgggagacgtacatcgcgcgttccggcgccaccggataaaccgaagagaggcgcatcatatagcccatttccagcgcggcagtcatttcataattcagggcgggaatatcgcggctcagcagcggatggcggcggacaaagtcatcgcccacgccgttcagcgccagcgtacgccgggcgtctacatcaatctgccagaacggctgctggcggacggtggaaaaatcatgttgaacattgttgaggacatcaaaagcgagcggggtttgcatcgcggtctgcatactgttgcgatagaacagcagcagattcacgccggtctgcaactgtcgatccagcgcagaggcggctttatccagagtggtctgctggctggcggcataggcatcttccagcaccacggcctcgcgccaggtgagcaaggttgagctaatcagcacgaaagcaaaacagaggttaacgatccgcgcgggatcaaaagagtggcgcaacttttttaacagcactacgagtttcctgaatgtcataagttgtgccggtaaatctgcccggcagcgccgggcaggagaagattaatgcgccgcaccgcgtaaccgtgcgacagcttttaccaccgccacaacggccaggccaatcacaaagcccagcactagatttgccagcataggtaaggttgcctgcaccaccgcgccgtgcgcggcagccgcgtgttcaatggcatggtgcagcggggcgataccgtgcaccacgatcccgccccccaccagaaacatcgccagcgtaccgatgatggagagcgccttcatcagccagggggcaaccaccagcaggcccttgccgacagatcttgccacagcaccgggtttctccgccagccagtaacccacatcatccagtttaacgatcactccgacgaggccgtaaacgccgatggtgaccaccagcgcgatacccgacagcaccagaacctgattcagcagcggcgcatcggccacaatgcccagcgtgatggcgacgatttctgccgacagaataaagtcggtacgcaccgcccctttaattttatcgcgctcaaaggttttcggatcctgggcggcaatagccgccagacgctgctgtcgcgcttccggcgtctctttgtgcttacgggcatgcagagtatgcagtaccttttcaacaccttcaaaacataaaaatgccccgcccaccatcagcagcggcgtgatcgcccacggaataaaggcgctgatgagcaacgccagcggcacaaggatcactttattgagcagcgatcctttcgccacgctccacaccaccggcagctcgcggttagcgcgcacgccggacacctgctgggcattgagcgacaaatcatccccgagcacgcccgccgtttttttcgccgccagtttgcccatcaccgaaatgtcatccagtaaggtggcaatatcgtccagtaaggttaataaactacttcccgccaaaatacattccttctcttttttgttgatataacaatgagtatggagcataaacgcccggcgcgaaatgcccggcgtaaagtcaacaaaaaattaacattcccccgacgagtaaatgactcgccagctaactacttttgtcgtttactgtaagccttcttactgttccgccgtgagggcgtatgcgtttcaggcagcttttaccgcttattggttctcttttcgcgctttatattatctggggttccacctactttgttattcgcgtcggggtcgaaagctggccgccgctgatgatggcgggcgtccgctttctgacggcgggcgtgctgctgatgaccttcctgctgatccgcgggcatcgactgccgccgctgcgcccgttgctcaacgccgcgctgatcggcgtgttacttctggcggtgggcaatggcatggtcacggtggccgagcaccagaacgtgccgtcggggatcgccgcggtggtggtggcgacggtgccgctgttcacgctctgcttcagccatttttttggtatccggacccgcaaactggagtggcttggcattgccattggcctgtgcggcattgtgctgctaaacagcggcggcaacctgagcgggaatccgctgggcgcggtcatgatcctgatcggctccctgagctgggcattcggctcggtttatgggtcgcgcattgaactgccggtcggcatgatggcgggggcgattgaaatgctggcggcgggtgttgtgctgctggcggcgtctttctgtagcggggagacgctgaccgctctgccgacgctgtcaggctttgtcgcggtgggttatctggccatttttggctcgattatcgccatcagcgcctatatgtaccttatccgcaataccaccccggcggtggccaccagctacgcctatgtgaatccggtggtggcggtgctgctcggcaccacttttgccggtgaagtgctgtcgccggtagagtggctggcgctggggattattattcttgcggtggtgctggtcaccctcgggaaatacctgttccctgcccggccggtggtggcctcctgtgagatcaggaaatagtctgtattccctgcgtatcgatctgcgcggcctcgccgccgccgcagatccactcctccagccgcacgcttaacctttcatcgctcagcttctgccgcccgcgcagggcgcactcccacaccaccagtacccgccagccgtccgcgcgcagctgcgtcagatcgcgcctgtcgcgcgcaacgttctggccgatcttcgccagccagaaatcggtacgcgtcgccgggactttaaacagataacagttatggtgatgccagaaacagccgtgggtgaagacgacgcagtggtaatcatcaatcacaaaatccgggcggccaggcagcgtggcgtcctgcacgtgaaacgccagcccgaggtcggtgagtaatgcggccagccgctgttcaatggccgtgtcatgcgtgccgatggcacgcatatttttactgcgcgttgctttgtcatgcacatccgccatcgccctctcctttattgtcggctataacgccagtgtagcagtcagagcggcgcaactctttaaaagcaaattgccgttgcgggccggctcctgtttatgtcattatttcgccgttattaacctgcatgactttttatattccttcatttcgttatcatgctaatgccttgatgtcgccagcctgtttgggctggctttttttttgcccaaggcgttaatcatacattatataaatactaactcaccaatcaataaaatccatgaataccagcaacataaaatacgctaataattaataaaaccgcaattacataattggcgattatgattgcaacccattgatattgatgcgataaataccaggaaattaagaaacaaattgcaatatataatatgatttacttacacctttcctttaaaaaaatatgaactttatagaatagtatcgggactgtgatttaacctcaaatcacatatattcatatagattattattcatatgatgcgaagggattaaataatgaaaagaaaagtactggcaattattgtgcccgccctgttaatggctggcgcggctaacgcagctgaaatttataacaaagacggtaataaactggacctgtacggtaaagtcgatgcccgtcatacgttctctgataacccgggcgatgatggcgatgaaaccatcatggagctgggcttcaaaggcgaaacccagatcaacagcggcctgagcggttatggccaggtgctgctgaaaaccatggcaagcgacactgaaggcagcgacaacaccttcgctaagctggcattcgccggtctgcgcgccagcgattttggctccttcgactatggccgtaactacggcgtggtgtacgacgttgaagcctggaccgatatgctgccggtattcggtggtgattcctacacctggaccgacaactttatggttggccgtgcgaacggcgtagccacctaccgcaacactgatttcttcggtgcggttgaaggcctgaactttgcgctgcagtaccagggtaataacgaaggtagtaacacgaacgaagatcaggaaggcactaaaaacggtcatgacgacgtgcgcttccagaacggcgacggctttggtctgtcttcatcctataacttccagggcgcgctggaaggcctgagcctgggcgcggcctatgcgacttctgaccgtactaacgaacaggttgcggcgggtggagtgaacgatcgttacagcaaagctgctggcggcgataaagcagacgcctggacctttggcctgaagtacgatgcttataatgtatatctggcgatgatgtacgctgaaacccacaacatgaccccttacggtgatgagggtatcgcaaaccacacgcagaattttgaagcggtggcccagtaccagttcgacttcggtctgcgtccgtccctggcgtgggtttactccaaaggtaacgaccttggcggtaacagcaccaaacacggtactgactatgtcgaccaggatctggtgaactacatcgaagtgggcgcaacctactacttcaacaaaaacatgtccacctatgttgattacaaaatcaacatgctggatgaagatgacagcttctacaaagataacggcatcgccactgatgacgtagtcggcgttggtctgacttaccagttctgataaccgcttgtgctaaagcccgcccctgtgcgggctttttttatggccgcaatttgagaataaagcggtagcaagataggtgcggggagactactatccgggttcagcaggaataaaggattttctcaacgggacgtcggtcactgaaacgaaacgggataagtgattgaataatggcggagagagggggatttgaacccccggtagagttgcccctactccagttttcgagactggtccgttcagccgctccggcatctctccgttctgatggttgccatcatgccaggttctttggcattttaacagaccctgtccctgcaattgtgttcaagtgacgagtttgcgagcaaagcgatgattaaatggccctggaaagcaaatgaaacggcacggactctggcgctcccctgggaaaatgcgcttgccgtcccgatgttatcgactctgaccccggaggaacaaaaccggctggttcagcttgccgatcgctttttgcagcaaaaacgcctggtcgcgctgcaggggctggagctggatgagctgaaaagctgtcgtatcgccctgctcttctgcttaccggtgctggaactgggcatcgaatggctcgacggttttcacgaagtgctgatctatcctgcgccttttgtggtggacgacgaatgggaagatgacatcgggctggtgcacagtcagcgcatggtgcagtcagggcagagctggcagcaggggccggtgatcttaaactggctcgacattcaggattcgttcgacacctccggctttaacctgattattcatgaagtggcgcataagctggatacgcgcaacggcgaccgcgccagcggcgtgccgctgatccccctgcgcgaagtggctggctgggagcatgatctgcacgccgccatgaacaacattcaggatgagatcgacctggtgggcgaaagcgcggccagcattgatgcctacgcagccaccgatcccgcagaatgtttcgccgtgctgtcggagtatttcttcagcgcgcctgagctgttcgctccgcgtttcccggcgctgtggcagcgtttctgccagttttaccgtcaggatccgctggcacggctgcgcggcaatagtactgctgttaacgatgaaccgccttatgttcactgaaacagcaatttgagctaatattcgccagttgaatcagcaagttaaatttgctgttgacacaaatatcgggggccagtagtattcgccccgttcacacgattcctctgtagttcagtcggtagaacggcggactgttaatccgtatgtcactggttcgagtccagtcagaggagccaaattcgagagccccgctcagggaaacctgagcggggtttttgcatttccgccgcagccaattccttgtttttcattttcttgccgtcgcacgcaaaaaattcacaaaatctaacaattcatattgctaatgataaccattatcggcaaaattcttattctcaaaaaataaatgttccctttcgtgctgattttattgatctaattccggcgtgatgccgcctggcgttcacgcggattatgtataaaaactaaggaatgataatgaacacctgcaaaaagacgctctgggcgcttaacccgctatttctggctatgataacgcccgcgctggcacagcaaaccagtgaacaggatatggtggtatccgccagtcgcactcatcgcaccgtagccgaaatggcgcaaaccacctgggttattgaaggcgcagagcttgaacagcaggttaaaggcggcaaagagctgaaagacgcgctgtcgcagctgatccctggcatggatgtcagcagccagggccgcacgaattacggcatgaatatgcgtggccgcgcaattgtggtactgattgacggcgtgcgcctgaactcctcgcgcaccgacagccgccagctggacgccatcgatccgttcaacatcaagcatatcgaagtgatctccggctccacctccctttacggcggcggcagtactggcgggcttatcaatatcgtcaccaaaaaaggccagccggacacgcaggtggaatttgaagccggcagcaaaaccggatttaacagcagtaaagatcatgatgagcgggtggcaagcgccatctccggcggaaacgacaaaatttccgggcgcatggctgtggcttaccagaagtttggcggctggtatgacggtaacggcgatgccacgctgctggacaatacccagaccggcttgcagtattccgatcgtctggatgtgacgggcaccggcacgctggcaattgatgatacacagcaattgcaggtcgtcagccagtactataaaagccagggcgatgaagactacggcctgttcctcggggagaatttctcggcggtaacgggtaacggtaaagcttatgccagtaaaggtctgaattcggaccgtattccgggtaccgaacgccacctgatcagcatgcagtactcgaatacggatttcctcggccaggagctggtgggccaggtttattatcgcgatgaatccctgaccttttatccgttcccgactgtcgcaggcggcgcggtgaccagcctctcctcctcgcagcaggataccgatcagtacggcgcaaaactgacgctgaacagcaaaccgctggacggcctgcagctgacttatgggctcgatgccgatcacgagcgctttacctccaaccagatgttcttcgatctggctaaatccagcgcctccggcggtctgaataaccagagcatctataccaccgggcgctatccgggctatgagatcaccaacctagccgccttcctgcaatccagctacgacgtcaacgatctggttaccctgagcggcggcgtgcgttaccagaaaacgcgtaatgccattgatgatttcatcggttacacgcagcagcaggcgattgccaaaggcacggcccgctcggctgacgacatccctggcggcaccaccgactatgacaacttcctgtataacgccgggatcctgttgcatctgaccgaacgccagcaggcgtgggtgaacttctcccagggcgtggaattaccggatccagggaaatactacggcaacggcacctaccgcctggtcaacggccactatcgtctgctgaacagcgtcaacgtcggacaatcgaaactccaggggatcaaagtggattcctacgagctgggctggcgctataccggcgatgccctgcgcacccagttggccgcctattattccctgtcggataaatccatctccattaaccgcagcgacatgaccattaacgtcgatgacgataagcgccgtatttacggtgtggaaggggcggtggattactttattccggaaacggactggagcaccggcgtgaactttaacgtgctgaaatccgaaacccgcgttgacggcaaatgggataagtgggatgtgagttacgccagcccgtcaaaagccactgcttatgtcggctgggcgccggatccctggagcctgcgtgtacagactacgcagtcctttgatgttagcgatgcaaatggcaataaaatcgacggctacaacaccgttgatctgatcggcggctatgccttaccggtggggaacctggcgttcagcattgagaacctgcttgataaggattacaccaccgtctggggccagcgcgcgcagatgctctacagcccgacttatggcgcatcctccctctatgaatacaaaggtcgtggacgcacctttggtgtgaattattccgtccagttttaagtcctgaacccgctgcccggcttctgccgggcagatcacccttcgctaaatctgataatcaatcgccacgtcgtccggctccatcgcctgacgtttgatctcatccagcgacagcccggcattacacagttcgataaagcgccagacatagttgcgctgcagctggccgcgcttcagccccagccagaccgtattggcgtcaaacagatgacgggtatccagacgcaccaggccgccggattcgagaccgtcgccggactgctccgccaccaggccaatgcccagccccagctccacataggtgcggatcacatcggagtcctgcgcactcagcacaatatccggcgccagccctttgcgcataaaggcttcgtcgatacgcgaacgtccggtgatcccctgacgataggtgataatcggccagcgggcgatctcctccagcgttaacggattgacggtatttaacggatgatccaccggcagcagcagattgtgatgccagcggaaccaggggaaggccaccagcgccggatcgttgctcagccgctcactggcgataccgatatccgccccgccattgtgcagcagagtttcaatttcctgcggcgtaccctggatcagttccagacgcacttccggaaacagggcgcggaaagatttgatcaccggcggcaggctgtaacgcgcctgggtgtgagtggtggcgatggtcagcacgccggtggcatcgttggtgaagagatccgccagccgccgcacattgctggcctcgttaagaatgcgctcggcaatgaccagcagtgccttacccggctcggtcatgcccagcaatcgcttgccgcgccggatgaaaatctcaatccctaactcttcttccagttcgcggatatgacggctgacgcccgactgcgaggtgtaaagcatattggcgacttcggtgagattgaaatcccgccgcgccgcttcacggattattttaagttgctggaaattcacccttctctcccggccttcagacataacgctattgttagagtctgaaggccggggtaacaaataataaaaacctgcatcttatgtcgaaaaggaataaccctagcccaccagcagcagctcacgcgcctccagcgacggacggctgaccagcgacattaagatctctttcacggcctgggcctgcggcgacagcggcccgcgtgcggagcagttcagtgacagcggcaggctcatggagggcgaggtgatccgcgccatccagccgttagtggcttcgcacagggaacgggcagcggattccggcaacacggtgccgcccatcccgctggcaatggcggcggtcagcgtgccgatggactcgatctcgccgataattttcgccgtcaggcggcgcagggaaaaagcttcatcaacacgcaggcgcaccgcgctgtaatcccgcggcaggaatagattcatgtccgccaccgccgccagatcaacgctctgacccggacaatcgcgggtacccacgaggtaaagatcttctttcagcagcggctggctggtgatgcccgcgcccggcgcgcgctcatacagcaccgccatatccagctgaccgctcagcagtttgtcattcagcgacatgccgctgttttcatgcagatagacggtgacgtccggcaactccatacgcaccgcctgcaataacggcatggtgatggacgaggccgccgtgcccggcgcaaggccgatcgacacctggccgcgcagcgtctggccgacattatgcaccgccagctgcgcctgctcgcactgacgcagaatggtgcgcgcatgcgcatagagaattttgcccgcttccgttggcgtgacgcctcgtttggtacggatcagcaactgctgatccagttccccttcaagggtggcaacttgctggctcagggcgggctgcgcgatatgcaggacttctgcggcctgagtcaggctgccaatgtcgacgattttcacgaagtatttcagtcgtctaaagttcatattgcctccggtacggaataacagtgccacgctggcagtcatcatgtcggaggagttgcaagatgcttgccagttttggcaaagcctctctggtcgctcgtaacccaccagataataagagattctgattacccgctacgttttcatcactgaaacagcggtttgaaagcgttccatcaggaggcacccctgcactgtactggtgcacgaatacgggtttcggtgaggaaatcagcggattgctgaatttgtcagcaaacggttgtcgacaggcaatccaccctttgacaagcccggatcgcgccgctactattcgccccgttcacacgattcctctgtagttcagtcggtagaacggcggactgttaatccgtatgtcactggttcgagtccagtcagaggagccatatttaagaagcccgctttttagcgggctttttgctttctgttagttacgatcctgtcagcgcccgcttcgggattagccagccaacacccccgtcaggcaatgttttatatgtgcgcaggcgataagccgcctgcgctgcggcctggaatgcttattcgcgcacgatagctcctgcatcctttttgattgccggcccctctttcacttccagggtcagcccccgggtttccagctctgcattgcgaatgcgtagcccctgaacggcttcaatattcacattactgaaatggaatccgctcagcggcgcttccggcgtacctatgataaaggcagccgctttgctgtctccggtggatattaaattctccactgtgatattgcgaaagtgcggcgttttgtgtttgtcgaagggttgtttcggatcgctgtccggcggataaatctgctcgccaagggtaaatccgcccgccttaagcagcttcgtaacttccgcttcgacaataggcgctgctttatagtacgcagagaagaccagcggcacctcgacatcatgcatggtggtattgcggtaaataatattttttacctcaccgcccttcccgcgcgggcttttaatacggatgccatacatcgaaccttcgaaggtattattttccaccagcaccttattcacgccgcctgcgctttcactgccgatggaaatgccgcgcccctgtttcagggtattgttggcaatatagatattctccaccacgccgtccgggaaacgcggatcggctttttccgctttaatggcaatatgatcgtcattgcagtcgatgtaattattggtgatgcggacattctgactgtcgataggatcaatggcatccgtattgggagcatgccagggtgaaagaatgcgcgtaccgttaatatccacatcgtgcgcatagcgggtcactatatggaagcttggcgaatgcgtcagggtgacgccgtcaatcagcacattgttcgagcgcgtaatatagatcaaccgtggccggtcagtgccgccctttttcccggtagcgcgaatattttcccgccagcgctcccaccataccgccccctgaccatcaattgtcccctcgccgacaatcgccacattttgggcatctgcaatactgataaacggcagccagccgttttccgcttcagcatatttcgttttattaccggcgcgataagcggcctcttccgtagaagccaccagcgtggcgtctttctcaagtttcagctggatattattcttcagaaaaagcggattggttaagaaattgcctttcggtatcagtaccgttccgccgcctgctgccgcacagtcatcaatggctttctgtatggcatcggtattaagcgcgatctgtaaacggtggccttcagcgccatattcagtgacgttgcagaccttatcgggaaattttaccgcgcttgccgcctgcgcagcatgaagcggtaagatgcccgccaccgcagcgacggcccacagaggcagagtacgaggagacatagtgttgtcctttttatcttatggtgagttgttttgtaaaattagcaccactgtttctttttattgagtgtggggatcacgctttatcgcttgtcgttcttttgccagaaatcagggttgattttttgtgcaaatgactgaattgtagcccatcgtcatcagatattgttcagaatgacgggtaccgacaacataacaacgagggactgaatatgaagaagaacatcaccctggcacttgccatcacggcactcctcggcggcgcggcggcaccggttgttgccgcgcccttcccggccacgccggatcaagccataccggtcagccagtatgtgacccaggtgaacgccgataaaagcatcaccttccgcctgttcgctccggacgcaaagcgcgtatcggtggtcaccggctccagcccggacagacttgcttcccatgatatgagcaaaggcgaaaacggcgtctggacgtggaaaagcgacgtgatggccccgaacctgtatgaatattactttgatgtggacggcttccgctccgttgatacgggaagccgcttccagaagccgcagcgccaggtgaataccagcctgatcctcgtgccgggcagtattctggatgaccgtgccgtgccgcatggcgatctgctgacggtgacgtatcactccagagccctggcatctgagcgccggatgtatgtctggacaccgccgggttatagcggccagggcgaaccgctgccggtgctctatttctatcacggctttggcgataccgggctttccgctatcgatcaggggcgactgccgcaaatcatggacaacctgctggcggagggcaaaatcaaaccaatgctggtggtggtgccggatactgaaacggacatcactgacgcgatcccggaaaattacccgccgaaagagcgtcgcaagaccttctatccgctgaatgcaaaagccgccgatcgcgaactgatgcaggacattatcccgctggtggatgcgcgctttaacgtgcgcaaggacgccagtggccgcgcgctggcggggttatcccagggcggcttccaggcgctgttctccggcatgcaccacctcgacaatttcggctggctgggcaccttcagcggcgtcaccaccgccaccgtgccggatgcgggcatcagcgcgcagcttaacaagccgcaggaggtgaacaaacaactgcataacttcaccgtggtggtgggcgaaaaagacgccgtcaccggcgaggatattgccgggctcaaacgcgagctggaggcaaaaggcatcaactttgaatataaaaactatcctggcgcaggccatgagatggacgtctggcgtccggcctatgccgaatttgtgcagaagctgtttaagtaagtaagaagaataaacgggtatgacattttttatctatggttaagaagggatttagatggctgcggttgaagcattaaaaatgaagtatccgggcgcagaggcctggcaaatgggtgacagccctgaactggccagcgagcttgccgaacttattaaaagaggtatcaaaacggcctcctgcggctcttttgcctcttaccagcaggaagcgtctgccccgcggattgggagttataacatcatcctcgatggccagaatgtcccggtctgcgtaacaaggctgatgtcgatgcgactggtacgtttttgtgatgtgacagaggcgtttgcccgcaaagaaggtgaaggcgatttaagccttgaatactggcagaaagagcatcagcggtttttcaccggggaaggacatttttctgaggagatggagcttatcgcagaagagtttgaagtggttgaggtgctgtgaggtgaaatcaacggggcagcgtgtcatcacctgccctttatagccatgttcgcgatgagtgaggagcggacatttgcaaagtcttacttacaccgtggcggtttgagccgcaataatgtaccggagaggcggttacagctccccaggcaaaaccaaaatagatcgaccacaaaaatcaaaccgtttgatttttcgccgcttcaacgagagaatccttataaaatgcatggaataaggaaggaacggaatgttcactctttacatgagatgggatgcagagcgggaactggctccaggtgatattcagttcattctgtcgccacaagatgcgctggaaatggcgagcatcttttacgaactggattaccttgaatacgaccataacaaccgcattctgcctcacagcgtcccgaagcgacgggaaggggtttaccaccgattcgcaacacaaccctacaaacgcaagcgtcttgctgaatacgacggactctatgatgaggtgaaatggaatctggagcacggctggatggtcggagttaaccctaaagaaaaatgggaccacttccgcaatccgttctatttcgatgatgacagtaatctgatttacgactgcttcatggatacatatagcgagggttttcagcaggcagtgcgtcaaatctatgaatatagcctcagcgagcatcagggaagaaagccgcctccgaccattaaacatcactattccgatgccccgatacagcacgcccaggcgggtaaaactatcaacagcaaagcagccggacgtcttctggctgcgggtggtatctataacggcaatgtcgaggggttccatcagaccgcacagcagctcggtggtgatgcgccagcaggctacgatcaggtcatggacaacaagggattactcattactgccgcttcgacagcagccgtactgacaatgggaaaagttaacgtcactggagaactagaagagctatcgtcattaagcaaaatcccaacatttgaatctcctgctttaaagggttttacctcagagtcagggacattactgaatgctgaacacgccgttgtagattacagaaagctatctacttactctttagaccctactcatccaactggagggcataaagcgagggtgttccagtcagcgctgggttataacccaacgaatgctgacattttaggtgcacgagttcaggagggagtattgtgggcaccagcaaagatgctagatccaattaattttgggcaaaaaatggctgtagacatgccgattttaggggtaaatggcgaaacagcgatagtccgaacgggctggatctatgaaacagattcgttagtaccaaggctaaccactatttttgtgaaatgagagagctactgatgaaacgagccgaacttgatgtggtagttttagctgaggacttgcctggggaaggcttagcaaaagggatgatcgggacaatagtcgttgtatttgaaaacccgacactcgcttacctagttgagttttgtgatgaagaaggccgaacacttgctctgcccgcattgttaccagaccaggtgattgattatcttccgccagagagatccaatgtaccataaacccgctgtacggtttgaatgaaaagacctcattccaactgcgggcttaaggaaacgcccgtcaggtgctccgaggctagagggtagaagcgaaaacgcgaataggctttttctaatactgatcatagcgacacatgaaacctcaatacggataagtgcggtttaaaggagtattaggttgtgtaaatatccctgcaaaaccatccatccaattttagaaagactttgacactccaacgtccgcttctggcacagagcggacaggatggctgggctaaaggtctgcttagagcgaagagcggacgtccggcatgagttctttctggtaaacagtaatgtcagtcaatgaagtaagcacgtaaccgctcgtcctgacagccctgctgccggatgattttcactgaggcctggctcagaaattcagtacgatccgcgttcttcagcctttcacttccatcatttcagctgtcttaaaccgttcatctatactgactcttgcagtgcaatttgcacaggaggccgcgccgctgtcaacgttttcattttgctgacaaagtaagaatgggcattgcaggaggcaacccagcgcgcaaaggataagcttttgaatgacctgagcgtgtgaatgccttaattaggccgtttgttctcggtttacccccctcaaagcttaaggaataaaaaatttttatttatcctggagataactaatgaaaataaccgattttgtttattccgccttaattggcgttgtcgccagttgccgctcgatgacgccgatggcgaccctcgctgcagcacgcattgccggacgcaacacttctggccgtctcctgctgctggaccgtccgctatttaaatttggcgcgttagcgatgggtataggggaaatatttggcgacaagatgaagtcagcgccagaccgcactgtgtttttgggcatgacagcacgtgtggccagtgcagggattgcgggcgccgcgttggcaccccgcggagaggaaaaaaccggggcagcgatcgctatctctgccgctgtaccacttgcatgtgtcactcttgcggcacgcaaaaaggccatggtcgggatgggtcagaccaggagtggcctgattgaagatacgctcatcgtcgctatcggagcagcggtggtcttcttcgccacgcgcccgaagtaaacgcactcagtctttaaaggattatcccgatgaacaatcctgaaggggtcagagacggcttctggtacagcgcggactgactcccgggcagatgtccgcctggttccaaaagcggacatgcctgcttaacagacttacttcaacagcagccgtaatcccagaaaggccataacgcctccgcttagtttatctataaacatgcggtatttaatgtaagcctgacgcggcccgtccgttgataataagcaggcaacgacggcataccagagcacatcaataacgaatgccattgtgggcaggatgatgtacataacaggctgaatatttttgctcagcgccgcggaaaaaatactggcaaataccagtgcagtatggggattgctgatttgcgtgaatacgcccgtcataaacgcttttaaggcgctcacttcctctgttccggcagtgtcatttaaccgatttgaaggacgacgaaacattttcaacgccagccataaaagatagcaaccgcctgcaaccttgagtccggtgtaaagtgatggaaccagagtcagcagagtgtgaagacctgctaacgctatgcccgcaaaaacaaacgcaccaaaacccataccagcagcgactgaaaaagctgcccgtctcgaactggacatggccgttcgggcaacgagaagaaagctcacacccggactcattgcgccaaacaggatagctacgccaatagcggagagcgcgatcaaatcacttgtcatccatcttctccatcattaattaatgtcagacagccccatcattgcgcgaaccgcacaccccatgaactgctccggttaataacataacacgatcttaataacgtccgcttctggcaccaggcgcagcgtttacacacaaaatcaaagctgcctgatacaggactttttcaacgtaaccggatccggatggcgaagccagaggatcacggaaatcatcgtgacaagcagacccagaacaacagagacaagcaacgtgccgggaatgccagcgcgctcaagcagaaaggcatacgccgagggtgccagagccgcaagaaaaaatgccggggacagcaggatgcctgttttccgggcatagtgctctgaaccgaacagagtaaggggaagtgcagcctttactaccgtgctcagcccgttcacggcgccgtaacccagaacgaacaccgccgtcgctgccggggtaaaatgccccgccaggcctgtcagaaaacagagcggcaacgcgataccggtaataagattcaggcgtagcgcactgatgcgtgcgccggacatcacgtccagcaagcgggccccgacctggcctgcgccccagagcatccccgccagggctggcattccataagcggccagtatctgtggaaagtgcgtggacacaccggttgacacgaagctcagcagggcaatcaacgtcgcataccagagtccgctgatcatcgtccgccggttttccgttgcccttccctctccggcgtctgacggagcggcaacgggaagcgcaggactgccgtctgagggaacagcgcaaagaaaaagcaggctaaccagccctgcgccagcgtaaatgaagacggcatgccgccagtcggtgatgcgcaacagggccgcccccacaggccagaacaccgctgaagcgaggccgcccagcagggtgaccagtgaaatggaccggcgggcgtggactcctgccattgccaccagtagtgcaaacgcagcgtcatacagggcaaagcgcatcccggcacctgtcaggacccaggcggcaatccacatcgcggcagaatgcgttaaagccatcaggagacatccgccagagatgcaaagtgttcctgccatcatcatcgtacgcccgccagcgcgcgccacaaaaaggccggtcaggggcgataccagtcccataaccagcatggccactgttaaccctgaaaacgtcaccactgcagaccagcccgtctccgccataacagccgtgccgaacgctcccggcatgtagaaggtaattccccagttaatcagctgcgtcatgccgatgcaaaaaacggtgcggcccgttagccgtccgccactcaatctgcatattccggaaaggtggcgtcgccctgcccgagggtgcgctgcatgataaccgtatccagccagcgcccgtgtttgaatcccaccgatctgagcgtgccggtgatgctcaaccccgcggaacgatgcagggcaagagaggcggtattctcgctgttacccaccaccgccacaagctggcgaaagccacggttttcagccaaggttatcgcacgggacaacagctgtttgccgatcccctgccccttaaacaaggggtcaatatatacggagtcttcgagggtgaagcggtaggcatagcgttcacggtaaaaagacaggtagcagtatccccgaacctgcccttcatcaatcgccacaaaccagggcagccctgcggcacgcaccttattcagacgggccatcatttcagttacatctggcggtctggtttcaaaagtggcggtgccatgtaatacgtgataagcataaacccgctgaatgccgggaagatgttgttcatctgcttcagttattttcatcggtacggctcctgttccggtcagaaacggagactaacccggataactatattcagacagatcgtgggacttatcagcggtataaggaaaactttggcatggcaatcctgaatctcgaccacctgactaccttcagactggtaatcagccggggcaccttctccggggcggcagaagcgctcgggctgtcgcagcccgccgtcagcctgcagataaggcagctggagcaggcgctgcaggtccggctgatagagcgaaccagccgggggataaagcccacgcctgccgggatcactctctgtgagcactgcataaaaattgacgctgctgtcggtgcagcggtggaatccgtgtccctgcattcagacgatatcaccggtaccgtgactgtggggacaggcgcaacggcctgcattcatctcctcccccccctttattgcaggagctgcgacagacgcatcccctgctgaaagtggacgtacgtaccggcaatacgtcagatatcgtgcgcggtgtggaggaaaatcgcatagatattggcctggtcaccctgccggcagcaggcaagtgcctgagtgtggccccgctcggaacggaagagtttgtgatcatcctggaaaaggatcccgcagagcagaatataaaaccgctgtctgcggacgatcttttatccctgccgctgattgtatttgaacccggaagcggaacccgttccctgattgatgagtggtttcgggatgccggacaggttgcccgccccgtaatggagctgggcagtattgaagccatcaaaaggatggtccgcgccggtctgggctacagcatcgttccccgcatgtctgttgaaagtccggaagaaagccgggggctgagtgtgtattcaatggcacctgccctgcaccgcacgctcgggacggtaatacgggaagatcggattgtcagcaggggaatcaaagcagtactgaaaagactgagcgccagtttcacttaaatatatctggaaacgttgatcggctccctgcattgtgcggaaggatcgattgccgtttagtcatctgagataggtatgatggtaataattaataacgatgcctttgcggattcagaactaaggacataccagagaggtttaaatgaaagtaaccgctaaaaatgaaaatgggacgatacaacaacttgaagtctcatcgttgattatcacactggacaacggtgaaaccattgagatcagcgatgaaaacaaaaatcgtccaggcgaaatacctgaaggtgtgacagtgtggggaggtaaaatgcctgaggaaggggcgactttagatgaacttaaaaatacaacacgcgggcttggggtgtatccactggcagccaacatggtgcacatttttccctatactctgaggaagtcataatccctgctaagccgcgtccgcgatgcgtatctggcgcagcgcgttgatttccgccgtcaggtacgccttatgaatgaagcgaaatgctttgatgctcgcaagaatgctggaacagcagcgttgcctctaattttttaaatatgccctgcaactttccgactgtgcgaacacatcatcatctctgcacgccgtctggatggcattgacgacgttgccattgccaatcggtgtccagtaattatctactatcaaatatttttgccgctgcttcggctcccggagatgtaagcgagtcaaaaatgacgctattttcttcatataaacgtttttagggctggttttgtattcagcaaaaaccacaatatattccggaaccatataatcccttgccaccagcggcgggatgcgaaaattcacttcagacttagcgcctagctcattaccatccatctctttatattcataggctggcatataggttgtattaccacctggtattgtcacgccgccattgtgcacgttggcatgaatatctttggtaattttgaaaataaattgttgatccggatcgggcgttatcctgaattcatctatcacctgatcaacagagttattattgcttaactgaaattcataacctctgccggaaggcttaaggtatttaacctgcacatcccccgtcaaaaaatcatatgcaaagcttgcaagtaatgtaagcgcccccgtagccagcaaaaactgaccggcacgcttagcaaatttccctatgccgcgggaggtttttttatgtgccgcctgattagtcctttgcgtactacccggaccattttgtttactccgttgggttctgcttttattgtttttcctgcctgccatgtcaaaacccatattttctgattttcattattgaacgtaaaagatcatccgcagttactgattacctgcgaatgatctttccaggcgatggtgatgctaattaatcgccgttttttcctccatcttatcatgtgaaatttttcataaagccctactaaaaatagtaattttttcccataacgactcatcagcccgtcgtgtcagggcggatcctgaaccagatggcgtacatggcgggcaggaacaccagcgtgataatggtgccgccaaaagtgccgccgatcagggtgtaggccagcgtgccccagaacaccgagtgcgtcaggggaatgaacgccagaatggcggccatcgccgtcagcagtacgggacgggcgcgctgcaccgtagcttccaccaccgcatggaacggagccagcccttcctgctcgttgtggtggatctgccctatcaggatcagcgtgttacgcatcagaatgccggagagcgcaatcagccccaccagcgcgttaatgccaaacggctggttgaacagcagcaaggtcggcaccacgccgatcagccccagcggtgcagtaaggaacaccatcaccatcgccgacatcgagcgcacctggaggatgatgatcagcagcgtcagggcgatcatgatcgggaacaacggtgccatcgctctggtggccttgccggactcttcaatggaacccgcctgctcaatacggtagccgggcggcagcgtgtcgatgatcggctgtaaggatttcaggatagcggtcgagacatccggcggttgcaggtgttcggcgatgtcgccgcgtacggtcagcgtcggcatccggtcgcggcggcgcagcagcggatcttccatctgcacggtcacttcaccaatctgcgacagcggaatgcgctgcccgtcggcccccaccagcgtaaagccttcaattctggccggatcgaggcgaatatcccccgccgcgcggcccgttacctgcaccgaacgaatgtcttcccgcacgctggtgatcggcacgccggagagcaggaactgtaactgctgcgcgacggcgttcgacgtcagccccaccgcctggaggcgatcctgtttcagggtgaaatgcagcgtcggcacgcgctggccccagtcggtattgacggtgcgcatcatcgggctggcctgcatcactttctccacccgcccggcgatatcgcgcagcgtggcggtgtccgggccgaccacgcggtacgccaccggatagggggagtacggaccaaatacaagttgagtgacgcgtacgcgggcttccggtgccagcccggcggcgaccgcgtcacgcaggcggaatttcagcgcttcacgggcttgctggctgtcggtcagcaccacgattttggcaaacgacggatcgggcagctcaggggccatcgccagataaaagcgtggcgatccctggccgatgtatgaggtgacaattttcgcttccggctgttgttgcagccaggcttcaattttcgcggtggtggcgctggtctgctcaatggcggtgccataaggcagctgcacttccaccagcacttccgggcggtcggaagtcgggaagaactgttttttcaccagccccatgccgaggatcgccacgctaaagatggcgatcaccgcgcccgcgactatccatttgcgggcgatgacgcgggtcagcaggcggcggaaacggttgtaatggcgtgtgttgtaaatggcggcatgtccccccgccacggttttgatcgccggcagcattttcaccccgagatagggcgtaaacaccactgccaccacccaggaggcgataagcgcgatgccgacgatccagaacatattgctggtgtattccccggcggtggactgggcaaagccgttcggcataaagcccacggcggtaaccagcgtcccggccagcataggcgcggcggtatggctccaggcataggccgaggctttgatgcggtcatagccctcttccattttcaccaccatcatttcgatggcgataatggcgtcatccaccagcagccccagcgcgaggatcagcgatcccagcgtaatgcggtcgaagtttttgccggaggcttccatcaccacaaagacaatcgccagcgtcagcggcacggcggcggccaccaccacgcccacgcgccagcccatactgacaaagcacaccaccattaccaccagcagcgcgacgaagaatttgatcatgaactcgtcaacggcggagctgatgtttaccgactgatcggtgaccttgctcagcgtcatgcccaacggcatttcagcgttgatgctggcggtttccgcgtccagcgcttttcccagatcgaggccgttccagccttcacgcatcaccacccccagcagcagcgccggttcgcgctgatggcgcaccataaaggtggccggatcttcatagccccgctccaccgtcgccacgtccgacagcttcagcgtgcgcccctgcgccaccagcggcgtgtcgcggatcttctgcaacgtgtcgaatgcgccatcaaggcggatgttaacctgcggcccctgtgtatcaatggatccggcaggcgtcaggacattctggttattaagggccgcgaaaatcgcctgcggcgaaatccccagcgtggcgaggcggtcatgggagaaagagacgaagatgcgctccgcctgctcgccaatgatattgacctttttgacgcccggcacgtgcagcagccgctggcgcagggattcggcgtcgcgcaccagcaggcggtgcggctcccctttcgccttcagcgcgaacagcgcaaaggtgacgtcggagaattcatcgttcaccatcgggccgataacgcccgcgggcaggtttctggcttcgtcgccgagctttttgcgcgcctggtaaaattcctcctgcacctgcgagggcggcgtgctgtcctgtaaagagagggtggtaaaagccatgcccggacgggtgaacgtctcggtacgatcataccatttcagctcctgtagacgtttttccagcggttccgccacctgatcctgcatttccagcgcagtggctcccggccaggcggtgatgatggtcatctgcttgacggtaaacggcggatcttctgcgcgccccagttgaaaaaacgacagtatccccgccacggtgatgagcaggatgaggaacagcgtgatggagcgctcgcgcaccgccagcgccgacaggttaaatttaccctgactcatggctggctcccggctgcgcccgccgcgatacgcacggcttcgccttcatgcagcaaatgcgcgccgagggctaccacctgctcccctgccgtcaggctaccggtgacctgtgccgcgtcatcccccagcccccgtacctgtaccggtttccagcgcacagtggcgggcttaccaacaatctgccagacgcccggcccttttccggcatcataaatcgccgccagcggcacctgcataagcgcatcccgggcttcgccttcggcaagatgcagcgtcacggtggagccgaggggggctgcggccagcgcgccttgcagcacatagcgggcttcaaaggtgcgggtgacgggatcggcggcatccgaaagcagacgcagcgtggcgggcaccggcgggtttttactggcgtagaggctggcctgcgcctcgctgccgatggccggacgcagggtttccggcagctgcacgatggcttcccgctgcccggcccgggcgagtctgaccaccggctgcccggcgctcaccacctggccgggttccgccagggtttccatcaccacgccgtcggcgtccgccagcagcacggcgtaaccggtgctgttctgcgcgacattcgcctgcgcctgcgccgcgctgaggtcggcgcgggcgctgtcggcggcggctttgatctgatcgtatgccgaaatcgacaccgcgccggttttcaccaggctgcgatagcgggcttcgtcggcagcggcttgacgcgcacgggcgcgggccgcagaaaccgcctgttgctgcgcctgcgccgtcaggttcagatccacaggatcgaggcgcatcagcggctgaccacgcttcaccgtctggccggtatccaccagccgctcgaggatcttgccctgcacccggaaaccgagatcgctctgcacgcgggcgaccaccaccccggtaaaggcgcgggactgaccggcagcgctcaccaccgttgccgcccgtacctggggtggctgcgtgcgcggatcgtcctgactggcggtgtcaccgcaggccgccagggccagcggcaggaagcaaacagcaagggagacaggtttaagcctgaacatgggatacctgattaaatggaaggaacaatggcggcattcttaaactagtgacaaaaattgtcaatggtcacaaagcgagacattggaacttatttttgttcgatcgggccagttgacagcaagtgaccgtttgataatgtagtcacatttgcaccgtggctgaacgggggaaggatgaaaaggacgggtattctcgggttagatgcgctgaccgaagcgctggtcagggatctctttctggcggatccgaatgcgcaggtgtttctctcccccggcaccggcgagcgggcgcaacggttgtcgcaggaatttccctgctggacgctggacgatccgcaggcgctggtggatgaagtggacgtgctgattatcagttctgacgcggcatcccggccagaactttatgatcgtgtgcagctgcgccgcgcgttgaacctggtttcactggtgccggaggtgtcgtctcaggctttgcgaaaacgcttccgccaggcggagtgaagcggcaccgtgccgctgaacccggcgcacagggtcagcgtggcgaagaacgccacggcataacccgccgacagccgatccatgatcagcccgaacagcggcgatccggcagtctgccccaccgccagcgtcagaaagcagatcatcagtcccgtcgccgggcgttccggcagcgctgaaacgccccacatcagatagatgccggagatcgtaatataggccgcgccgaacagcgccccgccgataagcgtcagcgcgggcgtcgtgctctcaaagccgatcagcagcatacccaacgccatcgccagcaaaaacagccggtgcatgagatccataccaaagcgcgccaccagcgttcccgccgccgcaccggcgatgcccgccgcccccgtcaccatccacagcacgcctgcgccggtatcgcgccactccagccgcagcgcgaccagctgactgccgaacgaccagatcgccgtgctgcccgcgcccattaaaaacgaggcgacgatcagccgtttcagggacgcgctgatcggcggcagaccgccagcgcggttgcttgcgccaggcgaactgcgcggcacaaaacgcgcagcggcaagcgccattgcgaacgccaccgcggcaaaaagcccgaacgccagccgccattgtccgcccatcgccagcgccacggggcctgagagcaccacgcccgcgcccgtcccggcattaatgatggtgttagccgcgccctggcgatccggctgaaccgcagccgacaccgcggccgccagcggcggcgagactaaccccgtactggctccggcgagcatcaccgccgccgccagccacagcggggatgacgccagcgcaatgccggtcatgcccagcgctgccaccagcgcggcggtcagcgccaccgtgcgcggaccgatgcgctccgtcagaaaagccgccagcacaatggtcaggcagtaacccagaaaggatccgccggaaatcagcccgctcagcgtcggggaaagggagagatcggcgtcgatgcgcggcaaaaacagcccgaaggcaaaacgcgcaaagccatagcagacggcgatcagactgaagccggtggtgataagccaggcgtttttactcatgatttagcccccgccagcagcatcgccgccgtatcacgcgcggcagccacggtgcccacgccgcggtaaatggccgccgccgtcgcgccctcaaagaggatgaggatctgctccgccagccggtcgtcctcatggccgatttcacccgccaccagcctgcggatggtctgccaggtcttttctttatgggcgcggatcaccgccgcgatttcgggattgtcgccgccggtttcgccgtacgcccgcagaaacagacagcccagacagccctcttcccgcagccagttatccagcgcatcgaacagccctttgatgctctgctccttcagctgcgcgaaaaagcgctgatcccgctcctccagcacccgcacgatcagcgccgttttgctgccagcatgtttatagagcgtgcggctcgacatgcccgccgcctgcgtgagccgatccatcccggtggcattaaaaccatgccggtaaaacagggatcctgcggctgagaggagtttgtttttaatgtccataccttaaaagtaaaacgatcggtttactctgtcaaactgaccgcctcgcctgataccggacgccgcagcgccgattttcagccttatccccacccttttgtttcacaatcctgtgacatactatcggtatggcagtacatgtgtgaaacaaggagataattatggataacaaggcgagccttaccccggaacaggcccttgaccggctcgaagcgctgtatgaccaggcggtcagtgacttacgcgatgccatcgcgcagtacatcgataagggcacgcttcccgacacgctcgcccgtgcacaggggaaatttgtgtacccgttgctgtcggtcagctgggacggtaacgcgccgaacgcccggaaaacccgcgcttatgcccgctttacgcatcccggcagctatcgcaccaccattacgcgcccggcgctgttccgcccttacctgctggagcagctcaccatgctgtatctggattacggcgcgcagattgaagtgggtccgtctgaacacgagatcccttatccctatgtgattgacggatcggcgctgacgctggaccgttcgatgagcgcggatttaacccgccactttccgaccaccgagctgtcgcagattggcgatgaaaccgccgacggcatttatcacccggcggaattctcgccgctgtcgcactttgacgcccgccgcgtggacttctcgctggcgcgtctgcgtcactacaccggcacgcccgtggagcacttccagccgttcgtgctgttcaccaactacacgcgctatgtggatgagttcgtgcgctggggttgcagccagatcctcgatccggacagcccgtacgtggcgctctcctgcgcgggcggtatctggatcaccgccgaaaccgaagcgccggaacaggccatttccgatctggcgtggaaaaaacaccagatgcccgcctggcacctgatcaccgctgacggtcaggggatcacgctggtgaatatcggcgtcggcccgtcgaatgccaaaaccatctgcgatcatctggcggtgctgcgcccggatgtgtggctgatgatcggccactgcggcggcctgcgtgagagccagtcgattggcgattacgtgctggcgcatgcttatctgcgcgacgatcacgtactggatgcggtgctgccgccggatattcccatcccgagcatcgccgaagtgcagcgcgcgctgtacgacgccaccaaacaggtcagcgagatgcccggcgaggaagtgaaacagcggctgcgtaccggtacggtggtgaccaccgatgaccgtaactgggaactgcgttattcagcgtcggcgctgcgctttaacttaagccgcgcggtggccattgatatggaaagcgcgaccatcgcggcgcagggttatcgcttccgcgtgccgtacggcaccttgctgtgcgtgtccgataaaccgctgcacggtgagatcaaactgccgggtcaggccaatcgtttttatgaaggggcgatttcggagcatttgcagatcggcatcagggcgattgatctgctgcgcgccgaaggtgaacgtctgcattcgcgtaaactgcgtactttcaacgagccgccgttccgctaacggcagaaaagcaaaaagcccgctaaatagcgggcttcttaaatatggctcctctgactggactcgaaccagtgacatacggattaacagtccgccgttctaccgactgaactacagaggaatcgtgtgaacggggcgaatattaacggcgctctgtggccttgtcaaagcctgatttcaaaaaaacgcgcgattgccgaattattccgcaccccgttcaaaaagagcgcagcttaaggccgtcactccgcttttttctgcatggcgcgcggatatttccacagccagcggccgctgaccatacgccagtagaacagcgccccgcgtaccgcccagtcgaggaacatccccagccagacgccaatcacgcccatgccgagcacgatccccagcgtataacccgccaccacacggcagccccacatgccgagcatcgacacccacatggcaaagcgggcatcgcgtgcgcccttctgcccggcaggtaatacccaggaggccgcccagatcggcataaaggcggcgttcagccacagcaggatcttcaccacttcctgcacgtcctgctccggcgtataaaacgcggccagcagcccggcgaagggcgcggtgccccaggcaataatcgtcagtccgatggtcgacagccagaacacatggcgcagctggcgttccgcctggccgatctgtcctttaccaagacgtctgccggtaataatggtggacgccgaacccagcgcgttacccggcaggttgattaatgccgccacggagaaagcaataaagttaccggcgatgacgttggtgcccatcccggccacaaacatctgggttaataatttgccgctgttaaacagcaccgattcaatactggcgggaataccgatgcccatcacttcccagataatggcgaagttaagcggcttaaagtaacttttcagcgtgatacgcagcgccgggttaaagccaatcatcagcacccagatgatcgccagcgcgccgatatagcgggaaatggtcagccccagccctgcgccggcaaagccaatccccggccaggagaacaggccgtagatcaggaagctgctgataataatgttgagaatgttcatgccgccgttaatcagtagcggaattctggtattacccgcgccgcgcagcgccccgctgccgatcagcgtaatggccgccgccggatagctcagcaccgttaattcgaggtaagtcagcgccagggctttcacctctgccgtggcttcgcccgccaccacatcaataatttgcgcgccaaaatagtggatcaccgccgccagcagcgcggcgaacagcgtcatgatcaccagcgattgccgcgccgccgagcgcgcccgccgccggtcgcgtttaccgagactaaaagccaccaccaccgtggtacccagatcgaccgccgcaaaaaaggccatcaccaccatgttaaaactgtcggcaaggcccacacccgccatcgcttctttgcccagccagctcaccaggaaggtactcagtacccccatcagcagtacgcaggtattttcgaggaagataggcacggcaagcggggtgatttcacgccagaaaagtacacggtaactttttcgtttagcgtaccagggcgtgcgggcgacggcctggcgtaaagcggcagtgacgttcaaaatggaccttagtgagaaagtgaaacttcatttcaaatgatgatggagaaatgctaatcctgcaaagtatttcccacaaattttgctggtatttccggcaaatcggcgacgggttcgccagacgaacgcgagagcgtaaaatgcggtttgacaaaaagtttttcgccgctaagattagctcccacacgattcctctgtagttcagtcggtagaacggcggactgttaatccgtatgtcactggttcgagtccagtcagaggagccacatttaaaaagcccgctttatagcgggctttttgctgtctgcaattcaggcggccttactcgttgccccactgattcaggaaattggcgatctcatcaatccgctgctcgttaatacccgcttctgcggccatctcctgctgcgcgtcctcgctgatctcttcgccattcatcaggcgggtgatcagtaactcaaaataacgcgccagcgcatcgcgttcggtttcgcttaccggcgtttcggtttccgtcgcgtactcgtcggcgatgtcataatatttgatgggtacttcattgctcatatctggccctcaggggttttcgcattaagcgtattagtatatcgcacgtggcgggcataaccgcagcgttcgtttacgcgccgcgctcagagcacggtaatattcatgctgttaactatgctgcgcattttctcgtccagctcaccgtcgatcaccagcgtactggcaaggctcagatcgccaatggcgaatgccgaggccgagttgattttttccggcgaggccagcaccacggtttctgccgccctttctgacagcgcgcgttttacgcaggcttcttcgtaattgccggtggtgaaaccggcacgttcgtgcacgccggtgacgcccatgaaaaacagatcggcattgatacggcgaagggactccatcatcgccgcccccacagtgaccatcgaatgcttatacagctggccgccgaggatgatcacctccaccagcggcagattgatcagcgcggcggcaatggtcgggctgtgagtcaccacggtgaacgccagatccggcggcagcagtttaaccatctcttcagacgtggtgccgccatccagaatgacaatactccccggctggatcagggtgatggctttactggcaatattcttttttgctgccatatgcacgttttttcgtgtttccagcgaccccgtcgccgccgacaccgccagcgcaccgccgtgtacccgttgcagtaatccttccgccgccatctcccgcaaatcccggcggatggagtcttccgaaatgttaaaccgctggcttaaatcgcgggacagcacctgcttgtcccgcgccagcatatcgaggatcagttgtttgcgttgccctgacagcatgttttcacctttcacgaatgatcttgattatgcacgattgtgcatgatagcgtatttcctgtcaccttttaaaaaggaaataacatgtctgcacaacccaatattcgccatctccgtgaagagctgctgtccgataactggtacacgcttaaaaaatacactttcgaactgcaacggcgcgacggcagctggcaggcgcagagccgcgaagcctacgatcgcggcaatggcgcggccattctgctgtataacaaagccaaaggaacggtggtgctgacgcggcagttccgcctgccggtgtacatcaatgggcatgatggtttgctgattgaggcggcagcgggtttactggatgacgcctcgccggaagcacgtattattgccgaagccgaagaagagaccggctttaaagtggccgccattgaaaaagtgtttgaagcctatatgagccccggctcggtgacggaaaaactctactttttcattgcggaatatgctgatgaagatcgcagcggcgcgggcggcgggctggcggatgaaggagaagatattcaggtgctggaatggccgtttgaaaaagcgctcgccgccattcgcagcggcgagatccaggacgccaaaaccatcatgctgatccagcacctggcgctacaggcagtttttgagaagtaacaatcacagcggggtgtgatcaccccgccgggggtcagcaaaactacagcaactggccgccggaaatatcaaaggtggtgccgttcgcccaggccatgtcatccgacaaaatggcggcaacggcgctgccgatatcatccggtgaacccacccgccccagggcgatcccctgcgcgacaaaatcattcaccgcttgattatcccgcaccaccccgccgccaaaatctgtggcgatcgcgcccggcgcaatggcattcaccctgatctggcgcgcgccaagctcaacggcctgatagcgggtcagcacttcaagcgccgctttcatcgcggcatacaggctgtatcccggcagcgtaaagcggacaaaaccggacgagacattaaggatgcgcccgccgtcgttgatctgcggtaataattgctgcgtcaggaataccggcccacgcagatgtgtggcggcaagggaatcaaattgttccattgtcgcctccgtaaagttcgcgaacaggccgttaccggcattgttgatcaggaaatcgaaacgctcgaggccaaaagtgttcctgagcgtatccgccacggcctctgagaatgccgcaaaaccggtcgtctctgtgatatccaggggcagcatcaccgccctgccacccagcgcggcgatctcctgctccaggcttgcggcttccgccgcgccgctgcggtatgtcccgataatatccacgccgcgtcgggcaagatgaagggccatattacgtccgaggccacggcttgcgccggtgattactgcaattttattcgtcatgggctgtctctcgtcaggcgcaccggctggtgcagggttgagccgccatgataagtaacccccggcgtctgacccacgcctgaaacgctcagtttattgcctgattgtctcagtggcttgtgcctcctgcgggcgcaggtataatcgcccgatgaaaaacaccctcgccccgcatctggatctcgccctgcggcatgcctcgccgggcacgcccgcgacccgcattccacgccttgaactgaccatcggccagggctctggcgaacgcgcgccatgcctgtaccgggcgatgatctgctttattttgcagggcgcaaagcaggtggtcattaacgatcagatcctgagctacggcagcgaacactatctgatcagcgcgctggatctgccgttgagcgggcacattttcgatggagaagacaggcagccttatgcggcggtgtcgctggtgctggatgcagcgatcctcgcggagttagcggccaacatgccgccggtgcgtgagcgggagcagagtggcatcggcattatgatcaacccgctcaataatgtgctgcgcgatgcccttctgcgcctgatggcgctgctggatacccccgctgatatccctgtgcttgcgcctatggcggagcgtgaattgctttatcgtcttttgcaggagccgcagggacaactgctgcggcagatcgcccggccagagggcgcactgaacggtgttcgtcgcgcggtggcgtggatccgcgatcactcccgtgagcgcctgcgcattgaggatctgtgtgaggtcagcggcatgagccgcgccagcctgcaccgccattttctgactattaccggcagcagcccgctccagtatcagaagcagctcagattacaggaagcccgccagctgttactcaccggcgagcatcgcgccgctgacgtggcatttattgtcggctatgagagcgcctcccagttcagccgcgaataccagcggcagttcggcgcgcccccggcacgggacgcgcgtcagatccgccagaccatcacctgacccagactcagcccggcccttcgctgcctgccgccagcagcggtaccagcacatcgctgactggcgttgcaatcccctgtgccctgccgtaacgctggatcacgccgttgcggatgtcccactccagcgggcggttggcctggcgatccgccagaatggaggtgcccagatcggcgggcgcaccctgaaagcccgcgaggatctcctgcggcacctcatcgcccagcaccgccccctgcgcccgcgccaccgtcagacattcctgcagataggccagcgtcagcgcggaaatatcgtcgcgtctgaacattccggcacgacgattcgccagcaccatcagccccgccgccgcgttctgcaacagcttgcgccaggcaatggaaagaaaatccccggacagctccaccgcgcagcgcgtgccgctcagggcatcggcaatgcgcctggccgcaggcacgtccggcagggtcagacgcggtttggcccgcagccagacggaggcatccgcttcccgctgggccggaaaccacaccaccgagggcaccacggtcgcgccctgcacataaggctcaagctggctttgctgctcaacgccgttttgcagcgcgcacaccacggtgttttcgtcgcacaactgcgccagccaccgcgcgctgtcggcgtcctgggtggttttcaccgccacaaacagcagatcgaccggctggctgaccgccgccggatcgttaagcaccgggccgggcaccaccacctccccgtcgtcgtcacgcagaattaactgcggatgggcggtgcgcccgcacagcagcggcgtacgtcccgcttcatgcagcgcagccgcgatagtggtaccaatagcgcccggaccaagcagggcaattgcaggacgatcggacatcatgtgctctcctgttctggttaattaccccacagtgtatcagcagccttgcaaagccatcagtcctgaatcttcagcctttgtaacgcgcggcggcttccgcctggttgatgtcggccatcagcgcctgtcgactggcgtcgagggcatcccagcgggcggcgttgcgtaagggaggaatggtcacaggctcacggcgatcaaacccgaccagcgcggcatccaccagctcgcccgcgttcataaattgtgtcgagtgagcgatgtcgatcccggcgcgcgcccagatctcggtgtaggtcccggctggcagcaccgcctgcacatacacgccggcaggggcgagttcgacctgcaatccctgcgacagaaacagcacaaaagctttggtcgcgccatacacggacatggcaaattccggcgccagcccgaccacggaactgatgttaacaatagcgccctcacccgcctgaacaaatcgtggcgcgacggcgctggccagccgggtgaccgccgtgacgttcagcgcgataaggcgctcaatggacgccgggctctgatccgccagcctgccggtctgcgcaatgcccgcattgttgaccagaatgccgatctgtttgtcctcgcgcaggcgcgcttcgacacgcgcaacgtcatcggactgagtgagatcggcggcaagcacatcgacgctcacgccggtttcctgttgcaggcgcgcagccagcgcatccagtcgggctttgtcgcgcgccaccagcacaagatcgtggccgcggcgggcgaaacgttcagcgtaaacggcaccaattcctgaggaagcgccggtaatgaggacggatggagtggtcataacatacccttcttgaatgcgttaacggtttccggcgtgccgggtgatggtgcgggttaatgatgatgatcgtaatctatcctgtcaacgtttttgattatggtcatcatcaatgtatacttgccgcaggaatgttcagcattgaaggcgaaacaatgaaagtgtctaaagagcaggtgcgtgaaaaccgcaggcgtattgtggaaacggcgtcggtgttgtttcgtgaacggggctatgacggcgtgggcgtggcggagctgatgtcggcggccgggttaacccacggcggtttctataaacattttgcctcgaaggcggatttgatggcagaggccatgcagtgtggttttacgcattcggcagaccattccgccgggataaaccgggagcagtttattactcgttatctctcgcgccagcaccgggataacaagggccagggctgcgtgatgtcggcgctgggggcggatacctcccgccagtctgagacgattaaagcgacttttgcggcgggtcttgaacagcaactggcgcagctgagtcaggagccggacgcggccggcaagcggcgtgccgatgtgatcgacacgctggcgcatctggtcggtgccatggtgttatcccgcgcctgcccggatgactcgccgctggcggatgaaattctcgcggtatgccgcgcccgccttctggatgagaacacgccggagcagtaagcttcccggcggtgtcattatcagagccaggtttcgtgcagatgtcgccacatcacccggccatccgcaccagtttcaaacaccgccgtggcaaagcgcagcgtttcgccctgacccgggatcgtctgtcgctcctgataagtgacggtagcgccggtgtcgctttccgctatcagttgcagatcttcaatggcgatcgtcagccccgcccgcacaccgcgctgggtgcggaacagattatcgaccgcggtaaaatccatgatggcaccgcgcggcgtcaccatcgagaacgccgggcaaaagcgcgctaataacgcgtcgcacaccgtatccggcgtgtgtgcatcacccagacagtcgcggatcaacacgtgggcatcccgtacttcctgaaaataacgattcattgttgctcctgattaagttttaaaaccacgtgctgattggcgatccgcaggcagcacactatggggatgagggcgctgcccgctgctatcgcaaagcacagatgatacgcctgcatcaccggcagcccgcctgccgccagtaagccatacagcaggctgatgacggtcacgccgcagcagaaactgagctgacgattgatgttccactgggcgctggcatccgccagatccgccccgttaatctgaataaacgccgcactttgcgcggtgctgctgcacagactgctgccaaagcccatcagggtgaaggccagtatacacagcggcacatccgccgcactggccgtcagtgccagcaggccgatccctgccccatgcaccagacaaccggtgataaacagcgggcgcggccccaggcggttgaaggttcttcccgtcagggtgatcgccacaaaagaggccagcgcccagggcagcatcattgcgccggtgaccgtggctggcatcgttaacaggttttgcagataaagcatggcgacaatactgacgccggtaaaaatgccgggcacgaactgatagatcagcatcgcagtctgcaacagcggatctttcatcagccgcaggttaagcagcggcgcgggtttgttcagggcatcccgcacatatgcggccatcacaagtaatccgagcgcgaacagcaacgccccctgccacagataaagccgctcgcctgcaaaggttaagccggtgaggatcaggatcagcgccacgccgccactgagtaacccgcgcagatccagccgctcacccgtggttgaaggcgcatcgggtttaagccaacagcctgccagtattaacgccaccagcgccagcggcaggctcgccagaaacactccgcgccagtgaccactttccacaaaaagcccgccgagcgcgggcgataacgccggagccagcagcgccaccagcatcaccgcggacgagagttttgcccgttcatggctgcgataaagcgcgtaggtcatcgtctgcccgatggggatcagcagcccgccgcccaggccctgcacgccgcgccaggcaatcagcgaataaatggatgaggcgcttcccgcgccgcaggtgcccgcgataaaaatccccagcgacagcataaacaccagcttcgcgtcgatgcgccgcgccagccagctgctgagcgggatcaccagcgtcagccctaaaatataggcattactgatccacgccagctcgctgacgctggccgcgaactggcggccaatctcgggataagccacgctggcgataaacatgttcaccagatcgataaaaaaacccagcagatatacacaggccacccgcacacgatacgtcatgtttttctcagcattaacaaacagagcgcgcactataagcgccgtacggcggcggataaattcccttcccgtggttttactgtcaaaataattttgacaatcagaatacccgaaggaattaacgatggtgaatatgcagcggctggagatgtttgtggcggtggcagaggccggaagttttacccgcgccgcgcagacgctggggctgacgaaagccgtggtgagttttaatatcaaacagctggagcaggagctgggcgtggcgttactcacccgcagcacccgcaaagtggcggtgaccgataccggcgaacgcttttaccatcgctgccagcagttgctacaggacgccgaacgggtgcttgacgaggtgcgcggcgatcacggtggcctgcgcggtttactgcgcatcaccaccaccccggaatacggcgcgcgcgtggtggtgcccgcgctggccgactttgcggcgctgcacccgcagctgcgcatccagcacgtagcctcctcgcaaaatgacgatctgatcgccgggcgctttgatgtcgccatccggctcgggcaactggcggattccacccatcacgcgaggctcatcgaccagtttgatatttacccggtcgcctcccctgcttatctgagcacgcttcacgatggcggtatcagcactcccgaacagcttgccggggcaacgtggatcgcccacagccgtctttcctcgccgctgaactggcaggttgtgcaacccgatggcgatatgctgctgtttgcggcaagccagccgccttccattatggctgacagcgcggcggcattgctggcatttgccctgagcggcgcgggcgtggcgctgctgccgtcatggctggtgcaggacgcgctggcggcaggaacgctgatcgccgtgttgccggatcaccgttttccccgccagggcatttatgcgctctacccgaatacccgccacgtgccggagaaggtcagagcctttattgattttttacacgcccgcgtcagcgtgtgaggatttccgggaggcaatcctgaggaaattacagtaatagccgatggaggcggtgaggcagagcatatagccgaaggattcgctgccctcctccacggcgtttttcacgatgcgcacgtagccgtccgcgaggaccgcatgccatatcgcctgcataccaaacagccgggagaagaccagcaccgccagcagaccgctcagcatcacgccgtaccagggcgaacggatgtactgcgtcagctgtgccagcgtctggcgatgatgtttgagcggaagaatgaccgcgcagagtgttgccagcagcgcaaaccatacccagctgccatgggaaatcagatcaaagaccgcatccagttcgcggatcagcatagtcaggaagaagccgccgaccagaatattgcagtagcgcagcagctcatgctttttcgccagcaggaaatgaatggcgacgatgcccgctaataccagctcctgcacgatttcggtcagcgaaacttccggaatatcgtggtcaaaaatagcgatatcgccccacaggcaaagtacggcaacagagctgagcgccgccgcgccaagaaagaaaagaaaggttctgagtacagccattactaccacccaaaatgtacaaaggcagtatgttaggttatgggaaggggaaattcctgttcagtttgtgcgatatagcggtggggttttggcatgtcaggctggtggcgcggatgtggggagtggggatatggcacggtgatgggagagggttttgttggtatagctggcttactaaacaaacaagccggggaacgggggaaattttaaggctgaggctggttagaattattagctgcgaacgttgagatttaccattatgaccgctttaagtgaggagtgggcatattgagtcaataagcaaaaatgaatataagacatactcgttctaaagtaaaaatagcatcaagcataattaaattacccataataccttagccatcagaaaatcaccccctttttaaacaataaaaagggggtggtcttaggaaaaatattgcgcaatatcattctcaatttttagtatgcttattctaaatatagtaaactcgtcaagcgttatgtctttagcatgagcatctgacctatacttatttataaaacctaaggaatcgaatgtttctttctttgatgtttcaaatatattttcaaaagacccccattctttagatattatcttcctcagatcttcgaaataaattgttgatagatttgggtcaaaaatctcattaaaggatttagaaacatactctaattttctatttttacccagtatatccaacactgcatctttcgctaagtgctctccatgcatagattttaatgtcgttttaattatagtccttaatcttttctcaactgcattacgcctttcagatatttccgcccacttttgctcaacgcttgtttccaccttcctgtatttatttatttctaacagataactcctcatggaatcaatgataaaataataactatcattatcttttcctaaaataccataccccaataaatgagccaatgaattttgttttttgctggagttttctttgaaggtttcgttatcttcatttgctagagtaatgagaagttcatattcttcattataatgctctttcaatacacctataatcatttctaagtaattaaaactgttctctccaaaatctttcacagcatccctataagatatcttccctatgctgacaggttttttttgactgaaagatcttctagcaattatgctacaaacttgacgaataagaaatggatgaccaccgtattcttcgttaatattagtatatatcgcttcctcaaaattcacgcccattctttttccgattcttcttatcatgtctcgtgtggaccgaatgtcaaaacctggcagataagtaggggtgaaatgattaaataatgggttatcagaactgtctattcttggcgtttcaatgcacgaaggatttgtgccaactataagatatgctaaatttatacctacagtttgaaaaactgttctcattgattgccaaaaatatagaaaatctgaacccttactccaatgctcagttggggatgtaatcctagaaatattttcaatttcatcaaatattaagaataatttcttccctttttctttgttaatgtctctaacaaatctcgctaaaatttccgcagcattcttttcagtgaactctttttcttcaggaaggtaagattgaagataattatcttctttcgttttcttgcatacataatagatagcctcgttccattttcttttattaacggatggactttggcagtcaatggtagtaacaatttcgccatttttttgtagatttctagatatggcattaataagagaggtttttccagtttttcgcaacccgaaaataccagaattattaccacccttcattcgattgatagttgataatataatttcatttcttccaaagaaaagccaatcacttttcagcggcgcttcgaatgaaaaaagatctctattatataaatatttctgaactctgttcctaaaaaagtagccatcggaatttgctttttgcgtttcagcatatgtgaaaggaattatattggctgtttcaggctcctttttaataagttcactgatattttcttctatattttgatctttactaatcaaaatacagcatgttttatcaactcttaaagatgaaagctgtttcgctgcttgttcaatagcatcaagtgtgcgtgattggaaatttgtatactcgctaaaaagaacaattacttccctatcaaggttgaacatttctatgtaaatatcagttgggcgtaacagtataaatttatatttactgtttgatgtaagtgttattatccccccgccattagtcacataaaactcttttgataaaacattaattatgtctttttcttgctgactaaagtggtcttctctaacagaagtatgcttaccgggatagacatttatcgattcagtcattttttccatcttcagttaagggtgtatactcttttatatcctttttttaagcacaaatctaatggattaagagaaatcccattttatagagacatagcgaaatccagtgttgtgttattctttgtcggtaaggttgattaacccagcaaatacaaggcccaacctattgatttattaatgattttccttctgtcatgtctctagccctaactgaagaaaacaactaagcactaccttaaggaacgcaggtttgaattgacgaacgtataagtaattaaattgttttttgccgctagaagactgttgcggtaaccggataaactcagttgtaatttgacccatatcacagcaaagcaaagcagcattaacttgcatgcgccaatacgaacggtgcttatcggtttctgcaagttaacttttgaatagaatcctatacattgtcaaaaaatattgtctcaactcccacttctagcacaatgcagacaagcaaccttcccaagccacactcccaggtgccacgcccatcccccgcagcacctgcccttatcccctaccccctcacctcatcaataaatctcactccgtccgccgttcttacccagcgcggggcgttgatttcctcggtcataaacgccatcagatccgccagtagccagcgcagttgttcttcctgctgtgacgtcacgctccggcacagcaaaacctgcgtcagggcggcgcagtattcgccaagggtatcggaatcaggttcaaaacggggaacgtcgttcggcagcgtatccaccgtaaacctgtcctgctgttcaggcgggatcggctcacccagttgcggtttaagcagcgcgaagacggcacaaaggcgtccacacagcgccatacgcagcgcgggatcaagtgactcagcctgcgcttcggcaagctgatgacaatagtcggcaagcacggtgaattccgtgtcgtcgtcaaagggaacggtgagtaacgggtgagtctggtcaaagcaggtggtcatcaggaagcctccggtggcgagtagattaaacgtttatcaccagtatgaagtttcaggaggccaatcccggcacctgattttgcaggtgcggctgcacgataccgctttcagataaaaacggcaatatcagggtgttaccggtgaaggaatttgcgtagcgtctcgcaggaagattatttcccttacatccttacatgctcaataaatgcccgcagctttggcggcatatgctttctgccggagaaataaaggtaaaagcccggaaaggtcggcagaaattcatccagcaccgtcaccagctcgccgcgcgcaatatatggcgcgtacgtctcctccatgccaaagctgatgccgcccccggcgcagacggtgcggatcatcacccccatatcattggtggtcaactgcggattaacgtccacatcaaattcctgcccctgccaggcaaattcccagcgatagggcgacacgccgggggattttcgccagccgatacagcgatgatccagcagatccttcgggtgctgcggcgtgccgtactgcgccagataatcaggcgaggcgacggcgatctgccgctgcatggcggacaccggcaccgcgatcatatcctgggcgatcacctcccccagctgcacgcccgcgtcaaacccctgctctacaatgtcgtacgcctcatcggtgatggtgatgtccagttcgacatgcggataagccgcaatgaacgacgccagcatcctgccgtcaataatgcgttcggcaatcgacgacaccgccagccgcagctggccgcgcggtgccgccagctgatcggcgatatcgctcaccgcgccgttaagctgttcgatggcgggcgcgacctccgcataaagccgctggcccgcttcggtgaggttgatgctgcgcgtggtgcgctgcatcagggagatgttcaggcgatcttccagccgccgcagcgtctgactgatggccgggcgcgtcacccccagccgttcggcggccagacgaaaattgcgcgtctgcgccacgatcacaaacacctcaagcgcgtttttatccactgtcattggttagccatcgttaccagtctgttaagtaatgagcggattatctttatagtctgccgggcgtaagatcaccagcgttaaccgaacaggagaagacccatgacgaataaagtgatcttaattaccggcgcatccagcggtattggtgcaggcatcgcccgcgaactggcaaaaaccgacgcggtattactgctgggcgcacgtcgcgaggatcgtctcgccacgctggcggaggagttgcgttttaacggcgcagaggtggacgtgaaagcgctggacgtcactgaccgtacctctgtggaggcattcgccgccttcgcgctggaaaagtggggacgcattgatgtgatcgttaataacgccggtattatgccgttgtcaccgatggcgtcgctcaaagttgatgagtgggatcagatggtggatgtgaacattaagggcgtgctgtatggcatcgcggcggtgttgccgtcgatgctggcgcgggaagcgggccatatcattaatatcgcctcgattggtgcgctggcggtgtcgccgacggcggcggtgtactgcgccaccaagtttgcggtgcgggcgatttccgatggtttgcgccaggaaaacagccagctgcgcgtcacctgtatccatccgggggtggtggaaagtgaactggcgggcaccatcacggatccgaccgccgccgaagccatgaaaagctaccgggcgattgccctgcaaccggatgcgattggccgcgcggtgcgctacgccattgagcagccggatgaggtggatgtgaatgagatcgtggtgagaccgacacgcaccacggcgtgataaagaaaacggcctgcatcgcaggccgtttagtcgttattttttcagcaggcgcggcagctggttgtccagctccagcaggcaggcgtccatcatcttctgcgtttcctgagtgactttcgcgtagttactggctttccagtcattgagcggtgcggtcacgcgggtcggggcgcactctgatatcacataggcgctcagcatgttgccgccttccgggcgtttaaagaatttcacgcggtaggttaaatcataattgctgttgctggcggacatgtcggtatagaccagcgaccactgcgcggcggcaataaacagcggttgtttgtacgcatagccgttgccgtttttattcagccagtcgcggatttttaattccgctttcgggccgaaatacgcggcagtcggctccggcatggtgtcaatggacgtgcctttatagccatctttgtcaaacgagttaccgccaatcccgccaccgagggcagccgtcagcaccgccagccccatgcccgcgccggagtgcgctggcgtgacttcgcgcagtttcacgtccgggtaccggttatcgttcatatcaacgggtgcaaaaatggtggcaacctcgagcgaactgccgtttgtcgcctgcactttgtgtgagttgaggttccctgcgcagccggttaaaaaggttaaagacagtgcgcctgccactactactttattcatcattggttttattccctgtaagtaaattgcccttgcccggacatggttatctgaacttacaacggacaaagcaggaaaacctttagggatttttgaggatgcttctgcgggggcttaatgcagagcgcatagtgttaagacgataaaatttcacgcttttgccagtcatacggtctgtacaggacgttacgatacaactgtaacgtcctgcagcattgtcggcgaatgcggcaagttacagctcagttacagcactaccttctacaaaggttttacgggcaacgttaccaacgacattcgttgaaatgccatcaaatgccccgcctattacaccgcctaccagtgggatcattttgcccaggttgatcgcccctttttcaccaaacttggttaataatctaaaaccaaccagtttgttaatagcaaaaattgtttctttcgaaatgctcttaattaactgggtagacatcttcgagccaatgactatgccggttcctttaaggatatcttttgcggcattaccggcaaggcaggtataaaccagtgctttaacacgatcgtcttttacatcgtacccgcccatgatagcgatagcggtgatcatacggatctgaacataaattacggtcgcgatgctcgccgggatggcgaccggcatggtaataattccgccaagcccggatacaaagccggtagtgacggattttgtattttgccatctaatcagagaattcactttctctgttaaatcgccctctcctttcaggtagttttcggccatttcataggctgaatctgtacccggaatacttccgtctaaggctttatcgtaagcccagttaagggcttgcatgatttttccttcactaagcttttctgccattcccctgaccctttaaaaagtgaaaacctaatctgtatcgacactgataaaattttctttaaggttaagggcggttttataagattacctaccagaaaagggggtattgtttttgctgcctgtcccgcttcccgaatacgatggcgtttttcaggcgatgctgcggaaaatctcaggcattcaggccgtggcgtcagctcactttccgcacttcggtatcttccggcgataccgccgcaccatccttgccctgcaccttcatcggcggcaggggtttacctgtgcgcctgtcgataagcgttgaatgcggttcgccaggcgcaaacagatgctgctcgccccactgacgcagcgccaccaccaccggaaacaggctttgcccctgcggcgtcagcacatagtgctggtaagccgatccgtccggggcgtcttcacgggccagaatgcccgcctccaccagcctgtacagccgatcggtaagaatgttttttgccaccccgaggctgcgctggaaatcgctgaaccggcgcataccatcaaacgcgtcgcggacgatcagcagcgaccagcgatcgccaatcagatcaacggtgcgcgccaccgggcaaggggcgctgttcagcgcagtactggatttcatgattactcctgaaatgggtgggacttgcattggttgcattttaaaactactttagctgacacacaatcggttttgttttgcaaccagaataggaaaatcctgtgaccgcaaatgcctgtactgctcctcccggagtcgcccccctgtcacgcagcctggtatggcttttcgccatcgccagcggcctgagcgtggcgaatgtttattacgcccagccgttgcttgatgccctggcgcgggatttcagcatcagccacgcggcggtgggcggcgtgatcaccgccacgcagatcggctgcgcgctggcgctgctgtttctggtgccgctgggggatttgctggagcgccgccgcctgatggcgatccagctgctggcgctgcttatcgcgctggtggtggtcggccttgcgcgttcggccccggtgctgctggcggggatgctggccgtcgggatgctcggcacggcaatgacgcaggggctgatcgcctgtgccgccagcgccgccgcgcccggtgagcagggccgcgtggtgggggcggcgcagggtggcgtctttatcgggctgttgctggcgcgggtgttttccggggcggtgagcgatctggcgggctggcgcggcgtctatttcagtgccgcgctgctgatgctgctgatcgcccttcccctgtggcgacggctacccgtgctgttaccggctacgcatggcttaggttatctgcccctgctggcctcaatgctgacgctgctgcgcgaggaaaaggttctgcgcgtgagaggtatgctggcgctgctgatgtttgccgcgtttaacattttctggagcgcactggtgctgccgctgagtgcgccgccgttcagcttttcgcacacggttatcggcgcgttcgggctggtgggggtggtcggcgcgctggcagcgtcccgggccgggaaatgggcggatcagggacatgcccggcgcaccagcgcaatggcgctggtggtgctggtgctagcctgggggccgttgtcgatgatggaaagttcgctgctgacgctggtgatcggcatcgtcctgctggacctgggcggccaggcgctgcacgtcaccagccagagcctgattttccgtctgcgtccggaagcgcacagccgtctggtcgggatttatatgctgttttacgccgtcggcagcgggctgggggcgatcagcaccactctcacctgggctggcgctggctgggcgggcgtgtgcctgctgggtgcggcggtcagcctgctggcgctggggttctggtggataacagacaaagcggccgcggcatgaaaccgcgccgcgagatttacacgcgatccaccggctccgggccgcgaaaggccctgcgccattcgcttgggctgacgctgaatcttgctttaaagctttgccggaacgagatcggcgactgaaagcctgccatcgccgcgacgctttcaatgctcttgtcggtggtttccagtaattcctggctgcgttgcaggcgctcggcggtcagccattcgccaatagtggtgccggtggctttgaaaaaatgacgcgtcagggtgcgtcggctcatgctgacaaaccccgccagcgcgtcgagatcgtgcggcttatccagattgcgacgcaggtagtccatcagttcgttcattttgctgtcgcgcgtggaccccggcaccgggcgctcaataaactgcgcctgaccgccttcccggtgcggcggcacaaccatacggcgcgccacgcggttggcaatcgccgagccataatggtcgcgaatgatattcagacagcagtcaatcccggcggcggtacccgccgaggtgatcaggcgctcatcactggtgtacagcgagttgcggtccagatgaacgtcgggaaagcgttcggtgaaatctttttcgaactcccagtgcgttgcggcgcgatggtgatccagtaaccctgcgtaagccagcacataagtgcctaaacagagcccgaccacttcagcgccacgctgccaggcgctgataagtttatccagcaattcctgagcgggtttttcgtcgggtttattccagaagggaacaataatgatgtctgccctgtccagttgctcaaggccgtgctcaacgttaatcgacagcccgatatcagacagcactacgccaggtttttccgcacaaatttctacgcggaagagatccggctgcggcatcgcctgtccgaataaaatacagggtaccgaaaaatggaagggactgaagccggccgtggcaatcacggcaaccgtaagagcagacataacctttatcctgtgatcagaaagtcagcgtttcaccgtcggcgggaataagtaccttatcctgaatcccctgttcaagcgtaaattcacgcagttcggcacgggtcagcagacagtgatttatggattccatgtgcgaggccacaatagtcgcagcaggcaacatcttatgcgtgcgcagcgtgtcttctttgcccatgataatcggcccgtaaagatcgttaacagcataaccggtattcagtaccaccacatccggctggaagcgctgcaaactgcggacatagggtttgacccacacggtatcccctgcgatgtagagcgttttttcatggtgatgcgtgaacaccagcccgcacgcatcgcccagtaaatcaccccacagcggatcggcatacagatcgttgctgccgtgctgaccgtcggttttataaatggtcaggccatcaacaaaagcgttttcttcccgtaatacccgcacgttcaggaaaccctgggagcgtaccagcgcggcgtcactctcattctgtgtatagataatcatctctttaggtacgagctgttgtgcggcttcatcccagtggtcggtatgagtatgcgtcaggatcacagcatctaccgccagcaattcttcaaccggtaccggcaactccaccatcggattgcgcaggtgcggacgcgcgttcccggcaaagccttcccaggcctctttttccgccagcatgggatcgatgaggaattttttcccggcatagtccagcacgagggtggcattacggatttgcgttaatttcatttatggctccagtgattagtcagattcaggcttactatacgaggagcagtaaaggatacgtgacaggctctggggtcattcgccgatgaaattaggtcaatatcaaccggcgtatcccgcctacggcagcggaataatcgccttttccttcgcgagccggcgacgcttattgtgcaaggcaagcaggcgggtgccaccgatacatgaagctggagcaccaatgcaatctgtgagagatcaaaaccataatgtttcatggcaacggggggggcggtaagacccagcaccattattccaaatccggaagcgccacacagtaaagcgacaagagcagcaggccgaccgacgccattatgtccataaagagaaatgaacctacatagggcaccgtaaacaggggtatcagaacaggtgaacgtgagccgaccgccagccaataagcaatgacattaggccaatttatccgcgaccatgctggcgggaggccagaaacgtcatcgcacccgcagacagcagtaatacgccgctcagcccgaaagcgctttgccatccgaggctgtcaaacaccagaccacctgccgttgagccaagcgcaatcgaaagctgtatgacggcgaccatcagaccaccgcctgcttcggcatcctcgggcagcgttcgtgccagccacgtccaccagcccgtcggcgcggctgtcgcaagcaggccccacaggcttaacagcacagcgacagtccaggtctgttgtccggtcagcagtaacgctccggcgataatggccatcagcaatgggatcataattaacgtcaggtaaaaccgccgattcaggaggattgttacggtcagcgtgccaataaaccccgcgatccccatggcgagcagaataaaagacagccccgatgcgtccactcgggtgacggtttcaaggaagggtcgcacataggtaaacaacgtaaactggcccataaagaacacgccgcaagccagcagtcctgttgcgacgacagcgcgtctgagcaggcgaagcacagaaccgccggatttttgcgctttgctggcttccatcgtgggcaaactgacgcattgccagataaaagcggcgaccgcaaggggcaccaggcataaaaaagcccctcgccagcctacggttgcccccagataactgccgagcggagccgccaccaccgtggccagtgcgtttccgccgttaaagatagccagcgcccggggtacctgatgttgaggaaccagacggatggcggtcgccgccgacattgaccagaagccaccaaaggtgatgccaatcagcgatcttcccgccatataagcccagtagctggacgcgagggcgataatcacgccggatacggccatcaggaaggtcagccccagcagcagatattttcgattcagatcaccggcaagcctggaaatagtcaggctggtcaatactgcaaaagcacctgaaatagcgatcccctgaccggccagcccctcggaaacctgcaaatcttttgctagcggcgtcagcagagtgacaggtaaaaattcagaggcaataagcacaaaaatgcacagcgtcatggcaaagacaccgccccagtgcgcggatgatgttgtgtgtgaggcatcagaattcagtacagacatgacaatatctcttaatcttttcccggccagacggaaacagataaaagccacctgcgcatcgcaggtggcttttctggaataactggctcagcgtgttactttaaattggttttgaagaactgctcgaatttcgcgaagggtatttttccggccgcgttgtcatataaatcaacgtgatttgcccccggaacaatcactaactctttcgctttactgccaacggcgttaaaggcatcttccgcaaaatagcgtgagtgtgctttttcacccgtaacaattagtgcaggaatggtaatttccccggcataactcagcagcggcagattcataaacgacaacggcattgtcgcattccatgcaccggttgaattgacagagcgactatggaaaccacgcggcatccggtaatagtcataaaactctttcagtaccggatgtggatcggcgggtaaagcctccggcaggatccgcccggcggcactggctttgccattctcatcgacataaatatcatgcccgcccggcgcggcagtaccgctttccgcatccttccagcgctgttcgttcaaatactgcaagacggcacggcggtcggcggttgaatagcggtctttgccctcgcccacaccatgacccatggcgcgactcatgtcgtacatgacactggttgcaaccgccttaacgcgggtatccatcgctgcgtcactcaacgccatgccgccccagccacagatcccgagcagaccaatacggttgcgatctacctctttttgtaagcccagaaaatcgaccgccgcgctgaaatcctcggtattgatatcaggagacgcgacattacgcgggtagccgccactttcgccggtataagagggatcgaatgccagagtgacaaatcccttttcagccagcgtctgcgcatacaggccgctggattgttctttgaccgcaccgaaagggccgctaactgcaatggccgccagtttgcgatctccccgatcttttggaatataaagatccccgactaaagtgatcccataacggttctgaaaggtcactttgcggtgatcaaccttcgcgctttccgcaaaagttttatcccacttttcaaccatcgacacgggcgcattgggattcgttgtttgtgcatagctcatggtcgtgactccgcttaatgatgcgcatagcagcatggcaggtatggagagtgacagttttctggtgaaagccttcatgacatgtttcccctaacaataaggtgtggtttgtagtggtctgatacgggcaatgctgctgtgctttattgccatgcgctcattgtaatgagctgttattgtgatgattagaggggtataaatgctaagattaatatcatattgttataaatagcgacgaggcagaccggtggcgaaacgggaaaactataacgatctctatctgtttatgctggtggtgcaggaagggagttttaccgctgcggcacagcgacttggactggcgcagtccgggatcagtcgttcaatacgtgagcttgaagagagactgggcgtccagcttctggttcgtaccacgcgcaaattatccttaacccaggctggcgaacaactctaccggacggtgcagtccgggtttgacgcgctggacaaagggctttccaccctggcctattatcgcaatacgccttccggcacggtgcgtatcaatgccagtctgcacgctattgataaagtgctgcttccgaagcttgcgatatttaaagagcgctatcctgatatcaggctcgaactcatcaatgaaagccggtttgtcgatattatcgcggaaaggtttgatgcgggaatacgactggggccggaggtcgccagcggcatggttgcagtgaggatcacacctgacatggagatggcggtagtaggtacaccggagcattttcgtcgctacggtttcccgcaaacgcccgcggatttggtgatacatccctgcatcgcttaccagtttggcgatggcaatctttatgcctgggaactgattcaggacgggaaaaaaatcacccacaggccgcaggggcagtgggcgtttgcagacagctatatggaagcaaaagcggccaggcttggtctgggcctggcatatgtcccggaggaactggtggccgaagacttagcgcgaggcacgcttatcagagtcatgcagcggtacagcctgcgcctggacggttcgtttctttattaccctcaccgcaaggtgtcccctgctttgcgggcagtgatcgatacgcttaaaatgtaagcgtggttttgctgcactacacgtaaaagcggggaaaaaacgcctccccgcttttcagcactatttctgctgctcgttacccagcacattacgaatagcgtcagcgccacagcgatcgtccgagtctccgccgccggtgcccgcaaggccaatggccccgatcacctggccgtggtatttcaccggtacaccgccgccgagcagcaatagctcattcacggtgttcaggttaaccgtatccggagaggactgcgcttttctggcaaactctttggtcggcgttttggtggacagcgccgtgaaggccttacgccacgccgcctgggtattatgcggcccgacgttgtcatcccgcatcagcgataccaggttgccgccgcgatccaccacggccaccacgccctggcgatccatgccgtgacagaccgccagcgcctccgttgccagtttattactcagcgcctgtgtcatgtcgtaaaccgtggcaggcccggcggcaaaggccatgaccggccccgtcgccagcgccagggcaagcataagacgtttcatttatgctcagctcccgcggtaggtggagtaaccgtactggctcagcaacagcggaacgtggtaggtggtggtggtattgctgatatggaattccaccgggatttccgggaagaagctttcctgtttctgatccgcgaagtatttgccggttttaaaggtcacgcgatagtcgcccgcttcgaacggtttgcccggccacagcgccgccacgcggccatcgtcatcggtgctggcggtgttcagtaccttccagttttcaccctgtttctgctcaagcgtcaccgccacgtgcggcgccggcaggccggtttgctggttcagcacgtgcacgctgatcgggttcttactggcagcaaaggtcacgcctggtgcggccagcagcattgcgagggataaagcagcgatggaatttttcatggttgatctccttgttaatcaccctgctgttatacccccgtggtcgcgccgattgcctgtcagaaagatgaccatattgtcatctgcggctgaaacgctggggcgacctgaaatttcgtggcaaactgatttcatgaaactgttactgattgaagataaccagaaagccagcgcctgggtgcgcaaagggcttgaggaagcgggctatattgtggatcacgcggcggacgggcgggacggcctgcacctggcgctggagcactcttacagccttgtcattctggacattatgctgccgggcatggatggctggcaggtactgaaaaccctgcgcaccgccagcaacacgccggtgatttgccttaccgcccgggattcggtggaggatcgcgtgaaaggcctggagctgggggcgaacgattaccttgtcaaacccttctccttcgctgagctgctggcgcgggtcaaaaatcagctgcgccagcatcagccgcacagcaccacgctgcgcgtggcggatctggtgatggactcggcgcgctttcaggtaacgcgcgacggcataccggtatcgctgacacgcaaggagttcatgctgctgtggctgctcgccagccgccacggtgaaattctgccccgcacgctgctcgccagtgaaatctggggggtgaattttgacagcgaaaccaacattgtggatgtcgccatccgccgcctgcgccgtaaagttgacgatcccttcccacagaagctcatcaccacggtaaggggcatgggctattgtttgtccgatcaggagccaggccgtgtatagcccttccctcaccctgcggctgaccgccattttcacgctgatcatggcgctggcctgcggcggtatcagcctgatcctgtataacgcgttacgcagcgaactggtgtggcgcgacgatcagacgctgatcaaccgcgccgcccagttacggcaactgctggaagacggcgcgcatccggcgtctctgccgctctatttcaaccgtatggtggatattcgtcaggatattctcagtatccgcacacagcatgagcagaacgtcagcattaaccataccggcgtgacgctgccggagatgtcccccaccccggtcagcaccccccctggcgagcagcagctacaccgctgggtcaacgcggatcagaccgaagcctcggcgctgagcctgcaggcccgttcgcaggaagggccggtgaccattacgctggcgcgggtggcgcgggagcgggcgatgatgctggagcagtatcgccagaaaagtattctggtgtcgctggcggcgattttactctgcgctgccatcagcccgttgctgatccgccgcgggctgcgggccattggccgcctgagtcaaatcatggcggaaaccggcagcgatcgcttaacccacaccgtgccgcttcaggcgatccccaaagagctgttgccccttggcgaggcgctgaatgccatgcgccagcgcctgtcgacggactttatccgtctgacccagtttgccgacgacctggcccatgagatacgcacgcccattaacgtgttattaggccagaatcaggtggcgctgggccatgcgcgctccacagaggaatatgaggcgttgctggaagggaatattgaagagctggaaggcctgtcgcggctgacggaaaacattctttttctggcgcgcgctacccaccacaatattaaactcaataaagaaaccttcttactgcatgacgcactggaaaccataatcgatttcctggagccgctggcagaagaaagggaaatggtgatcgaactccacgctgaaggcagcctcaccgccgataagatgctgttccagcgggcaatcacaaacctgctggtcaatgccatccgctatgcgccggacaggggcacgataaccattaacaccgttcatcgcggcgatgtcatcgctatcgaagtggcaaacacgggcgaagagctggccgagccggagaaagtattcgaacggttctggcgcggcgataacgtccgccacaccgccggcagcggcctggggctgtcgctggtgagcgctatcgccgcattacacggcggcagcgcgtattaccgtcacgagcatgggaagaatatttttggggtacgactgggtggctgaataagagctaatagcggacgttctgtccctgtgctaagggttgaatgctgaaataagggtatgagaatgagcattacagcgatacgtgaatggcatatgaatgactatacgattagcacagacccggaaaaactggatgtgcaggcggtgcatcagtatttaacgagatccacatgggctaaaggaatcgatctggaaaccgttgtggcctccatcggcaacagccttaactttggcatttatcataatgactcccagacaggctttgctcgtctgataacagattatgccactttcgcctatctgtgcgatgtctatgtacttgagcaataccagggcgaaggtctgggaaaatggctgatggcgtgtattcatgaccacccggttttcgaaaaattacgcagaattatgttgttcactaccactgcaccctggctttatgaaaaatttggctatgaacccgttaacagggaaaattacgcgtggaccattacacgacctgatatctaccttcaccgataacagtggaaccggcatgacattagccagtgttcaggcgttgcatagcgtgtcggcatcagggacaaaagagaaaaacaggcaggctgcgtatccacggtaaagcgcgcctgtttgtattattttagaaaccacgtgttataagcccggacctgatattagaaaaattccatctggtcgcagggatgttctctgcacgcgcccatttcgccgcaggagtaaagccaggcgttttcacataaaaatcaaagcttctggatacattactcaccgcgagcgtgatgtgattgagggcttgcagcataacggatctcctcagcagggtgcatggagttataacgccagcataaaagcgcgtcgcgcaacgaatgagcgagaagcggttatgttagcgatggaatactatctgtatgaaaacaaacgtatagcttgatcgcccttgttcatgattgtgccccggcgctaaacacgcgaggtaaaatccttaagatcggggcgtcagatgtctgcttagagcgagaagcggacgtttgcacctcatgaacggacttcaatataaaatttttccagttatgcactggctatgagggtatctattgacatgaaatctatgccaaaatgaattaaattaatcatttatggagtattgtaaatcatggctattgtgtttattcctgcccttgttgcgctacttgaagccaaagagaaggacttcggacgagaattgacccgagaggatgttgagtcgatacgagataatgctactgctattgagttacctgcagagattgccagagacatgatcaaaagccgaggctatctcgatattgatgcgcaaaatgcttgggatgagtggttactccataaaaaactatgaatttttaagagcattgatatgctgcgaatagaagttctctaaatcggcaaactactctgtaaaggaattttatgattttcggtgatccctatcgctttgcaatcaggattgaatatattccgcagtagggcgattctataaagaatggtttcttttatttctttttgaacgggagtatgtaccctaatgacatccgcacatcgaccttattcgttgattatgatgacattattgatcctgaaaatgctcttatagctatgccatgtgatgatgaaatatttaatgcatcaacagataaagcttttgaatatctgtatacaatagcttacccacagcccacgccagaggatgaatatcctgatggaatttgtaagttcaatgcttcacccacgatcattatagaatctggagcatgtttttttgccgtttcgaacaaagacttcgttagaatcttaggcggtaaggtatcagaattagttgatcatggagagaggcgcgtttggcaagacataaagtgccctattatagaagatataactatagaaaaaattgaaatgaataaaataatttcaagcttcagggagtataccaattctttattacagatagatcgttaatgacgttcaagggccaagagttttgaatttaaaacatttatatcctcatcttagaaaattacaacaagggcgtttgtaacgtccagcattcagcttaactatgcaagaatttctcctactcaataagcataaaacatgttgcaaacttccgcttttggcacaaagcggacattcttattgagtcgaaggtccgctatgagcgaaaaacggaccttctcgttcttacaagctagtaaagtaatgttatttacttctgctttgcttgttcctctcctgacaagccatttaaaacagtggagtcaattctaaatatggtggtagtgctctctaccttgtcgcgttagtctgcctgtctctaatgaatacaagcaagaaaattacacacaggagaaaaacggtgatttcaaaagacaatgctgagcattatacctggggtgatgattgcgacggttggtatctggtaaaccggcaggatatgctaattattcacgaaaaaatgcctccaggtacgcacgagaagcgacactttcactctgtttccagacagtttttttatgtccttgagggtactctgatgatggaactggaaggtgataaacatgaaatcacctcccggcagggaattgaaatcccgccgggggcaaaacatcaggcccggaacgacagccatcaacccgtcgaatttattgtcatctctcatccgacaacccggggcgatcgttctgatctctcttcctgttgataaaagctctccgacagcggttttgaaggaatacccataattatcccgcacctgcccggctcggctggcgggcctgaccagatgtgaaggcctgtttgatatctatcaggacgttcagtcgcaaggggtaaagcctgaaaccaggtgcttaccggggcgccgctggcggtgtggtgtccagcgccattttcagggctgatatcaggaaactgaccggttcatccggcggaacatcctgacgcaggatgatgtgtaaaggcgtgacccggcgagtgccgtggctgaggggcaatggtttcagtatacctgccgccagttgttgctgaatataggcctgcggcagccagccatatcccagaccggccacgacagcgcctgccgccgcatccagagtagagaaatcccagttgtggctatcccctgcggcagtgtcaccgccatctgttatttgtatgcgtggccaattaccaagcagtgcttcggtcagggggccggataccgacagcagcggatgatcgcgatgggccacggctataaaatccacgttcatcagccactctccccggccagcaatattttgccggtcagtcacgatcatcacatcagcatcgtccaccgcaggcatggaggggaacatgctttccgtgacttccgtcagcttcacccgaatatgcggccagcgttgttggaattgttgcagggcagagaaaaggcgctcccggggatagataacgtccaccaccacattaagctgcgaccgcatcccatcctgcaaagtcgcagcctgtgcctccacataactaaacgttttcaggagtgggcgtacctggctcagcagcgtggccccggttggggttaatacagtacggcgcccttccggcaccagcaacgtcacgcccagtagcgtctggagttgcgcgagattgtagctaatcgaagactggctgcggtgtagcgtttcggcggcgcgggcaaagctgccggtggtgaagacacaatccagtattgcccattgttccagggtggttctgttcataatgattcaattattagattaaattcatcataatttagcgctattcatccaaatattaaagcattagactggctttatcgaacagaggagacctgatatgagcaactttgataaacatgatttaagcggttttgtcggtaaacatctggtgtacacctacgataacggctggaactacgaaatttatgtcaaaaacgaacaaactctggactaccgtattcacagcggcctggtaggaaatcgttgggtcaaagatcagcgtgcttatattgtccgcgtgggtgagaatatttataaaatctcctggaccgagccaaccgggacggatgtaagcttaattgccaacctgggcgataaactcttccatggcactattttcttcccgcgctgggtaatgaataaccctgaaaaaacggtttgtttccagaatgaccatatcccgcggatgaaccagtaccgtgatgccggtccggcttatccgacggaagttattgatgaatttgccaccatcacctttattcgtgactgcggtgcgaataatgacagtgtgattgcctgcgcggcgagtgaactgccggaaaatttccccgataacctgcgttaaataagaaagcgttacatttaaaagaaaccggtcacgacgacggtttcttttttttctgctaaaccacaacattgccattaaaacgtaagtttgaccgccgttctcccactgcttactcagcatgaagcagagccggatgcccccaaatccttttcccgctcctctctgagaaaatcaatgaaggcgcgtaacggcgcagacatgaacctgctggaaaaatagagccaggggccttcaaacggctgccaccattgcggtaacacgggttcaagatcccgcgagttgaaatggggctgtagccagttttcaaacatggcgataacgcccttgccgcgtcgtgcaaggtcgatggccgcagaggcaccgtcaacgccaatagtgatatagcccggcggatcaacagtgatggtttcaccctggcgctcaaactgccagggaaccagcgcaccgctcgaaaatttcatgcgtatacagttatgctcaaggagatcggcaggatgagcgatcgcgccctttgatgcgagatacgcgggggcggccgccagggctaatcgctgtaatctgggacctatggggacggcaatgacatctttcgccagatgttcgccatagcgtatacccgcatcgcagcccgcggctatggcatccaccagacggtcttcgaccataatttctacccgtatttgcggatgttgcgagagaaaacggtcaagcaaaggcggcagaatgtccaccatgacggcccccgtcacgttcagcttaagctcaccgcgcacacattgccgggtactggtgacatcattgagggccgctctcatttccatcagtaagggcgcgatacgcccggccagcgcctgacctgcctctgtcgccgtgacgcttcgcgtgctgcgggtaaaaagcggtacgccaaggctcatttccagcgcggatattttttcgctgactgtcgatggcgataagccaagttgcttcgccgccgtgcgaaaactcctctccttaaataccgccataaaaaccgacagattatccatccccgtcgcactgctattgttcgccatgtcgatcagcctgttctcattatgcctgattatcaaacactatcaggcaggctataaatgcaaaacacaaaaaccgctttttactaaaaaagccacacacaaccgatcatcaggaagcgaacatgaaaaacaaaaacgttcttatcactggcgcaaacaaaagtattggttttgagaccgccagggagctgggtttactgggatataaggtctggctgggcagtcgtgaccaggatcggggccaactggctgtgaacagtttgacgaaagacggtatcgacgcacagcttattattatcgacgtgacaaatatgctgagcataaaagaggccgctcagcggatacaacatgaagacggtaaactggatgtactgattaacaatgccggtattttaggctcgcatgatgttgcccctggcgagcaacctattgatgacattatggccgtctatgatacgaatgtatttggtcttatcagagtgacccaggcgtttattcccctgcttaaatgcgcgcagaatgccagaatcatcatggtcagcagtggtctgggttcgctggaatgggtgtctgatttaaatcatccctactcccgggtgcaggcaatggggtataccagctctaaaagtgccgttaatgccattacggtcgctttcgctaaagggttgatggctgagggtatcagcgtaaatgccgttgatcccggttataccgccacggattttaacggccatacgggctacagaacggtggcggaagcggccaggggaattgtctggctggcagaggaggcaaatgcagacatcactgcgggcttctattttgatcaaaacagagccccatggtaacaggaacttacggttacttgcctggtacgctcatagcatcccgttattgccatggcgtaaaaacgccggacgttcattgagccgcgcgaaccaggcttcaatggctggcacatcaggctttgcgaacggcgtcattttccagcggtttaccgacagcccgagcaccacatcggccagggtaaaggtctcgcccgtcacccagtgatgagtgcgctgtaattgctgttcaagaatgccgatacagtggttccactggttaatgcctgcggcaatggctgccggatcgttaaaggccggatccctgcgccccagcgccgggaagacatagcgccaggcgttattaaactccgtcgcctgccagtccatccagcgctcgacatccgcgctggcacgcggttcgccgggcaacaggtcgtcacgcccggctttgcgcaccagataacggcagatggaatttgattcccacagcacaaaatcgtcgtcaatgatcaccggcaccatggcattcgggttcagggcgcggaactcatccgtttccgtcggggtaaatccgctgccgtaatcttcctgcagatagtccattttgatttcttcgcaggtccacagcactttgcgcacgttaatggatgtcgttttgcccagtattttcagcatgcctggcaccgttcagtaagaggttattatccgggctactttttacaaaatagcttagtggcggccgcggccatcagcccgataaacggcatggtggcggcaccggagatgaaattatgctgatcgatctccttttcccggcgaatatctgcaagacgtgccagcgcatggttttgatcggtggcactgacttcttcaaactgcttttcatatccctgctcagacaacggtaacgcgccccgggcgtccgttctttccagcaccacaatatgtttacccttctgataaaaacagtattccggcatgagatatctcccagacaagtgaaggcaataatacagcataattaaaatgcggcagatggaaaagtcttacttgcaccagactgtaaatataaggtttttgttttattcaaaataatatgctgcattaagttaaattttcagtaaaagaaaagaagtatgcaataacacctgtcttgctgtattaaagccagtatgcactgctgactatgcaaattttcttgtgaaagtgttatctactgcttagagatttatacaatatagcccatagattttgccattaacccattgtaattcattaacatttgcaagatactagcagtataatatttacatgctaaaaaagtgtcttcatcctggatgcctaacaagattctggcacttttaataaaataaaatacaaccaaccttcatattgacaatattcaaagcatcaataatgcataccagcaaaggataactcatggaaaacattgataatattttgaaagaggccatcaataaagctaccactgaaagagggaaaatttctatactcattgctggtcgatcaggggtggggaaaagcacgctaataaactctgtttttcagcaaaaaatggcagaaacaggacagggacgaccagttacccaaaatacaagagaaataacaaaagagggtgttccacttacaatttttgataccagggggctggaaatgtcgcagttccaggaaacacaatctgatcttgaaaagctgattaaagagcgagcctcagacagagatacaaaccggcatattcatgttgcatggctatgcatacaagaagatggacgtcgcgttgagcaggctgaagtcgatttgcataatatgctgtcccaacatatgccagttattgcagtgattacgaaagcaagaagtgataatgggttcaaaaatgaagtgcagagcttacttccggaagtgaaaaacgttatccgtgtcagagctattgaggaagagatggatgatgggcatatcatcaaggctatggggctagaaagcctgatagaactgacctcagaggttattcctgagggaaagcgaagggctctggcggcggcacaaagagccaacatcaattacaggaaaactcaggcacataaaatagtagctggtgctgctacggcagccgctgctgcaggcgcaagcccaataccgttttcagatgctgccattcttgcccctattcagattggcatgatagcgggcattacatccgtcttcggtctggagctatcgaaaggaacacttagcactctggttgcttctgcaataggtgtaggcggagcaacgtttttaggacgtactgttgtggttaacattttaaaatgctttccagggtttggaaccattgctggtggcgcaatctctgcagccactgccagcgcaataactattgcactgggagaagcctacattgctgtactcgttgagattttttcaaaggatccagatgctgaaccttcagccagtgaaattggagaaaagctcaaagataagatgataaaagccggagcataattcaggaaaaggatccgctgacgacgccatatgtgtgctatcagcggttttttatcatgtttgttcgagtagattgtcctggggatgaatttcataattaaccatttaacttcgcccctctaattcatgttcctaatttattaaatctaagaatacccgccaccccaccaccgccatcggcaggatgagtaataccgtccatcacttgcacggtttcaaaatcaaagggagataccccctccagacaggcaacgttgatgccatactgctcaggattagatcgccgttgatggaaggtataaatgccacagatggagcaaaaataatgcgccgcttgtcgggtattaaaacggtattcggttaagacgtctttgccgcttaatatctccagtcctgcgagctgagcggagacagccaccgccccccgcatccggcataaagagcagttgcaccggcgaatcgtattaaagccatcggataattcaacggcgaatcgcactgttccgcaatgacaacgccctgcaattttatcagtcataaagcccccgtgaggcaaacatagtctgccgcgaatgaaaaaacgataaaagggacgccatatgtgtgccaacaaaccctgacaaatcgttagtgaaatctgtttccggagcggtgctcataacccatccttttcacagtggaggagctttaacagtaaaagacaattatggatgctgccaggtggcgttgtaacaagtattaagacgtttcgcagataacgtacggacggcagagcacagcgaaaaatccccgccatggtgcatggcggggatttattttacggcttaagcgccatcacttcgcgcggctggcgataatcgcctccgccacgttgcgcggcgcttcagcatagtggtggaactccatgctgtaagtcgcccgtccctgtgacattgagcgcagcgtggtggcgtagccgaacatttccgccagcggcacatcggcgcggatgatctggctgccgaaacgctcttccatgccctgcaccagaccgcgccgggagctgagatcgcccatgatattaccggcgtactcttccggcgtttccacctcgacatgcatcatcggttcgaggatcgccggatcagcgcgtttcgccccctccttaaagccgaaaatcgccgccatgcggaacgccatctccgaagagtcgacgtcgtgataggagccaaaggtcagcgtcactttcacgtccaccaccggatagcccgccagcaccccattattcagcgcttcacggatgcccttttccaccgacggaatgtattcccgtggtaccacgccgcctttggtggcgtcttcaaaaacgaagcccttgcccgcttcctggggttccagcgtcagcaccacatgaccatactggcctttgccgccggactggcgcacaaacttgccttccacctctttcaccgttttgcgcagcgtttcgcggtaggtcacctgcgggcgaccgatgttcgcctcaacgccgaattcacgtttcatgcggtcaacaatgatctcgagatgcagctcgcccataccggaaataatggtctgcccggactcttcgtcggtgtgcagacggaacgacggatcttccgaagccagtcgttgcagggcaatacccattttttcctgatccgctttggtcttcggctcaatggccagcgagatcaccgggtccgggaactccatgcgctcaagagtgatcaccgccgccggatcggtcagggtatcgccggtggtcacgtctttaagcccgacgcaggcggcgatatcgcctgcccgcagctcgtccacttccagccggtcattggcctgcatctgcacgatgcggccgatgcgctcttttttgcctttcaccgggttgtacaccgcgtcgccttttttcagcacgccggaatagacgcggataaaggtcaactgcccgacgtaggggtcagtcatcagcttgaacgccagcgccgagaagggttcattgtcgtccgcatgacgttcgatggtgtcgcccttctcatccacgcctttgatggcgggaatatccagcggcgatggcatcagttcaaccaccgcatcaagcatgcgctgtacgcctttgtttttaaaggcgctgccgcagagcatcggctggatctcacctgcgacggtgcgggcgcgcaacccgacgatgatctccgcttcgctgagatcgccgctttccagatagcgatccatcagggtttcggtggcttctgccgccgccgagaccattttttcccgccactgctgcgcggttgccagtaaatcgtccggtaccggcgcatagctgaaggtcatgccctgggtagcgtcgtcccatacaatggcgcgcattttgatcaaatcgaccacgccgctgaagtgctcttcgctgccgatggggatgacaatcggcaccggattcgctttcaggcggtcgatcatcatctgcaccacgcggaagaaatctgcgccggggcgatccattttgttcacaaaggcaagacgcggcacatggtatttgttggcctgccgccagacggtttccgattgcggctgtacgccgcccaccgagtcatagaccataaccgcaccgtcgagcacgcgcatggatcgctccacttctatcgtgaaatcaacgtgccccggggtgtcgataatattgatgcggtgcggttcaaagctgtgatccatgccgggccagaaacagctgacggccgctgaggtaatggtgatcccgcgctcctgctcctgcgccatccagtccgtaattgcagcgccatcgtgaacctcacccagtttgtggctcacgccggtgtaaaacaggatacgttcggtagtggtggttttccccgcatcgatatgggcagaaataccaatattacgatagcgttcaagggggatgggtcggggcatgatgcgtccttagtcagtttgacagtaagcgaccggcatggtcgcgggagttaaccaggatcatcatagtccaattgtacgagtatattcgaactattttagctatagttatagttgataatctggtgcgcctggcgcgtggtattgcccgcagccttccagtatattatccggcctgctgtaccctttgtctgaccattacggagcgctatgatcgccaatcaccctgaacgtgaacaaatccgccttgaaaatgtgcttttcgcgctgggcaatcccctgcggctggacattgtgaaaaccctggctgatgagggcgaacaggcgtgcggcgcgctgcgcagggatgtggccaagtccaccatgactcaccactggcgcgtactgcgcgacagcggcgtgatctggcagcgcccgcaggggcgggagaatttaatttccctgcgccgcgaggatctggatgcgcgctttcccggcctgatggatattttgctgaacgtgatgcatacggaataaacaatcatgacgggcacagacgcccgtcggcaggccggtaatcagagactgaagccataatgagaaccgtcgggcagctcaatatccagacgcagcttaccgcccgccgcctcaacgtagcgttttaacgatgaaagttttaaatcgcgacctggtttctccatgccagccaccgttggctgtttgacgcccagcgcctgcgccatgtcattctgggttttgcgcactttttcacgcagctcggcaagatgaatattaagcagaatgtccgccgcctgcgcttcggcgtttgccacgacgtcaggattttcctgcgccagaatttgcgtcagcgttcttcccatcagattaccccttacggttaatttttttcagatgttcggcatactcttgttcggcaagcggcagcatcacatcataaaagcgtttctcattgcccaccttactgcctgcgcacaggacgatcccggtgcgcataacatcgaaggcaaaaaaagcacggatcggatcgccgcgactctggatacgcagctccttcatattggcgtagcgtgaacctttgatggtgtctgcataaggcctggccagctgcggccctttcgccctcaacaccagcagcgacgccagaatgcattcccgatcggtttcattttgcatgctgtaccaggtatcgaatctgtccgttgtttcaattacccacatctgcgcccctcaataatataggtcaaaagttatataggtgcaaacctataaaagagaatgtgcacaataaaatgccgcattacagccagacagttgtcacgccggaaggcgccttcagaaaaatcgatggttgttgcagagcatgcggaataaatgcggtgaggatcggaaagacggatgccgggcggcatatgcccggcgctcgtatatcaggtttccggcagctcaatatggctgtcagcgagcgtacccatctggtgatgcatggcacaggcggcgtcgataaggggcatcgccagcgccgcgccgctgccttcgccgagccgcattcccatattcagatacggcacaagccccagctgcgcgagggcgattttcgcgcccttctccgccgataaatgtgagggaatgagatagggcttcaccgctggtgcgatacggcaggccgccagcgccgaggcgtaagagagataaccgtcgagcaccaccggcaggccgcaggaggccgcgccgagcatgacgccggtcatgcccagcagatcgtagccccccagtttcgccagcacgtccagtccgtcctgcgcatcaggctgattcactgctattgcccgcctgaccacctccgctttatggggcaacttcgagggcggcagattcgcgcctatgccgaccacgtcttcaggctgcgcgccggtaaatacgctgaccatcgccgcggctggcgtggtattcgccatacccagctcgccgacgccgaacaccgtcacgccccgggccgccagttcgcgggtataacggatgatgtcaagcagcagcgcctgcgcctgttcgcggggcattgccgggccaaccgcgatgttgccgctgccgcgcgccattttcatattgaggatgccgggaatgggatcgctgtcgatccccacgtccaccaccagcacttgtgcccccgcctgcgctgccagtacgcagacgccggtattgttgcgtgtcatgttggcggcctggattgcggtgacaaactgcggcgagacggtcaccccttcctgccagaccccgtgatcggcgcacatcaccacaatggctttatccggcagcgcggttttgcctttcagccccggcagaccggcgagctgtaccgccagcgcttccagccgcccgaggctgcccggtggtttaagcagcccgtcgatatgccgttgtgcggcgaccatggccgcgtcatcaggagccgggatcggcgggaatagatcgatcagtgtctgcatgatggttctcagtgtgcgggctagcgaagcagcgccagcataaaaatgacttcacccagttcgatggcggcaccgagcgtgtccccggtctgcccgccaagcgtgcgtttgagcatcaggccgagcaggtaaatggcgacgagcgttatcgccagcgccagcagtcccgttatgcccaacagcatcgccgccagtaaagcggtgatacccagcgtgaacaacgtctgcgccagactgattttgccgataaacaggttgccgagtccctcctcgcgggcatagcgatgcccgtacatcagcagcacggaaccaccgcgtccggcggcgcaggcggcgatcagcaccgtcagcaccggcatatcgcgcagggccagttcggcgatgaccagcactttcgccagcagcacgacgatcagcgccaggccgccgtgggtgcccagccgactgtcgcgcatgatcgccagcatccgctcccgcgtacgggcggaaaatacgccgtcacaggtgtccgccagcccgtcgagatggaaaccgccggtcagcagcgccagcgccagcacgctgaacagcgccgccagcgggaagccgcaccagccgtctagcaggataaacaccagcccgccaagcgcgccgagcaccacgcccaccagcggaaaggtgacgataccgcgcacgtactgctctaccgccagtccctgcataaagcgttccggcaccgggatgcggctcataaaggcaagcgttgccagaaagagtttcatttgattttgactccaataccggacaccaccagccagacgtcatcggcggcctgcgccagccgctgattcacccgcccggcgatatcgcgaaaatgcctcgccagccggttttccggcacaattcccatccccacttcgttagtgaccagaaccaccggcgacgggcaacgctgacaggcggcaatcagcgcctcgagctgctgctgcacgctggcttccagcgcctgataatcccagccgttgggattgctgtcgccgcccagggcaaacagctggttggtgatgagcgtggtgatgcactccagcaaaatcgcctcctgcggatcgttatccggggtgatgatgtcgtccagctgctgccagcgctcctcggtgcgccagtgcgccgggcggctatcacggtgatgctggatccgggcggccatctcctcatcaaaaatctgcgaagtggcgatatacagcacccgtggtgatgcgctgaccagcgtttccgcatgacggctcttaccgctgcgcgcgccgccggtgacaagggtgatcatgctggctccttatgctcgcgcataatccggtagattttttcgatgtcgatatggctgcgcatggcctccgccagccggtcaaactgctgcgctttgtgatcctgccagctgaagcctgacgccagcggcggcagatttttgcgctggcgcaggccgttgatcaccgcgcgggtgaaggcatcgctgtcgaacaggccgtgcaggtaagtgccaaacaccagaccgtcgtcgctcaccgcgccatctgccacgcgttgcccctgtttttccagccacagcgccgggcggcagccttcgtgccgcgtggtgtcgcccatatggatttcatagccgctgagcggcatatcgcgggctcccgccagccagccgggaagcgttgtgccgctgcgcgccgtcacttttgtggtggttttctgcggcgcaaagatcgtctccaccggcaggaagcctaagcccggttgcctgcccatgtgtgactccacgtcatcggtgatggtttcgccgagcatctgatagccgccgcagatgccgaacaccggcaccccggcgtgatgtaactgcaccaccgcctgcgccagcccacactcccgcagccagtgcagatcgcccagggtatttttactgcccggcaggatcagcagatcgcaattttccagttcatcggaatgacgcacgtaccgcagccgcacgtccggctgcgcggccagcgcgttaaaatcagtgaagttagagatatgcggcagttgcaccacggcgatggtgatctcccgttcgccggtatgccggtatttgccgcgttgcagggccacgccatcttcatcttccagatcgatgtccagccacggcatcacccccagcacaggcacgccggttaacgcttcaatttgccgcaggccggaggtgagcagcgccacgtcgccgcgaaatttattgatgatcaccccttttacgcgccagcgttcgtgctcctgcaacagcgcgagggtgccgtagatggcggcaaatacgccgccgcgatcgatgtccgccaccaggatcaccgggcatgcggccatttccgccatacccatgttgacgatatcacggtcgcgcaggttgatctccgccgggctgcccgcgccttccagcaccagcacctcgtactcctgcgccaggctctgataaacctcgataatctgctcacgcagctgcggcttgaagtcgtgatagctgacggcgtccatgtggctggcgactttacccatcagcacgatctgcgcatggcggtcgccggtgggttttaacagcaccgggttcatgcgcacatcaggctcgatacctgccgcctccgcctgaaaaatctgcgcgcgacccatttcgtggccgtccggcgtgatgccggaattaagcgccatgttctgcgatttgaacggcgcggtgcgcaggccgtcctgccagaaaatccggcacagcccggcgaccagcatacttttacccacatccgaggcggtgccctgcaccataatggctaagggttgcggtgattgattcataattgccatccggagaacgccagatgcaccagcgcgaacagtaccagcgccagggtagaggcgacccacatcagttgtacggcgcggggaatgtcatccacatggatctcacgacgcgcgtcgccaatccagggtttgtctacccgctgaccaaaatagttattcggaccgcccaggcgaatacccagcgcaccggcgaccgtggcttccggccaggcgcagttggggctgctgtgattacggcgatcccggaaaccaatccgcagggcgctggcggcatcctgacggcacagccaggccgcaaggctgaacagcagccaactgagcctggcgggaataaaattcgccacatcgtccatgcgcgcgctgaccataccgatggcgcggtatttttcgtgcttgtagccgaccatcgaatccagggtgttcaccgctttaaaggccatcgccagcggcgcgccgccgagcagtaaaaagaacagcggggctatcacgccatcgacggtattttccgccacggtttccaccaccgcgcgctggatttgcgcaggctgaagtgcggaggtgtcgcgcccgacgatccatgacagtttttcccggctttcttccagcgtgccgtgacggagggccttttccacggcgcgggcgctgtcgtcgaggcaacgcgtcgccagaatggtgtagatcatccatacctccaccagccagccgacccacgggtgcagcgccgttgccagcgtgatgacgccagaggcaacgccccaacttatccccaccaccagcagccacatgatgccgccgccgatgcgcagggtaatatcctgcctgcaaaggcggcgcacctgccgctggacgatcgtaatgagcgtgccgatccagcgtaccggatgcggccagtgcggcggatcgccaagccagcggtcaagcagccaggcggcacaccaggcaagcagcgtcatggcctttgccttagggaaagggaaaactgaacgatcatagatagccggtaaaagtggaggtttgtcatcactttacacggatgcgcgacgggggaacagaacggtgagggagagtccctcaccgcaaaggaattactcggctttaggttcgtgggttttcatttcacccatggtcttgagctttttggagatctcgcgacgctctttggagatctcggcgtttttgatgatgtagtcatcaacgcgatcttcgtaatcgcttttcatgctggcgatgatgccctggatggcttcaacgctcatgcccggcttgatgtaatcgctcaggttatccagcagcagcacgcgtttctggttatcacggatctttttctcaacgtcctggatttcacgctggagtttgtttttacgacggaacagacgaacaaattccagaacatcctgaaacgaaggcttagtagtttccatttttacacccctgctaatataagattcggattcgtaaaagcacccaccccggctcaacactactttcagcggctgctaatgacaatgcttttgtgcctgcgggtatcataaccctaatttatgctgaatcgaaacaacacgcacgcatcccctgcacaggtggagcttatttgcgcagtgcgcgacaaatcaaatgcgacagcagttcaagctgacgcgccagttccatacttaaccatacatagccgtgcatcggcgtttccgccagggtttctccctgatgcgcctgaataagctcccgcagttcacgggtgatgtcgttaagcttttcgctgttcgccactatcggctgcgggttaccctcgtagagcgcatgggcaatggtcagcagagtctgctgcgtcatgttttgcatgtcacgcagggtatgggcattcagcatcaccatatggctggcgcgcgaggcccagtgggcattgatttgcagctccagtatgcacaccatattgcggctcaccgtctggatcgcctcaaagatggatttttgaatacgcgtctctttgctggcgggcgtgataagcccgcgcattttcaccacgtcgttaaggatggtttgcaggtgcttttccagccgcggacgttccaccaggttcggtgaaaaccccgcctgatagactcggttaaaggcggtaacataattcgccatctgaatgcgccagtggataaaggcgcgctgaggccagatactggtaaaaagcatcgccagcagggaaccgagaatgacatcgcccccgcgccacagcgccgtgtgcatatcccccgcgggggcacccaccaccaccgccagggtgatgccaatcagcagcgcctgatagggctttttgccgagcgccagccagccgcagaggaacatggccgccgcgcaccacagcaacatcaccggcagcgaaatcaactccagctttaacgccaccagccccagcgccgagccaaaaatagtgccgccgatgcgctcccaggcgcgcggtaccacgttgcccagaaaagagatcggccccatgatcaccaccagcgtgatcagcggccatgtgccttcgggaacctgaagtaagcgcaccagtaagaacgtcagaataaacgccagcgcgatccgcaccccgtggacaatacgatagtgacggtagagacgaatttcaaaagggctgagtgatttgtcggggcgcacacccgttctccggctaaaacaacaaaggcgcaattgtagcggctttttaccaggcgatttccgcgttatggcctgaatgatggcaaaaatgacgatttactcgccagtcgcgccataaacgcctccaggatcaattctgaaggctgggccaaaacgccgtcagagcacttttggctcgacggggatatgcatgtcgatctcccagtgcccttcgccgctgtcgacattaagatagatctcaaagcacggaccccgtgcaatctggtaattctgatccgctaacagcgtgtcgaagaatccgtcccaggcctgctggaaatcctcgttttcaacgcgcgcgcgggctaccgcataagcgccgccgggcagttcggtgagcatcacaccttcgctgttttccggcaggacaaagtcttcatccaccgcgatcaccacatcggcacgcagcttttcagctggtacttcatcgggattgtcgtaataggccgcgatccactccaggggctgcagctgcttactcttcacccacagggtcagctgttcgaagccctgctttacggttttttcccacggccccaccagatgaaaaccggcaatcttacgcgaatcaacgtctttgatttgatagtccattgctgcctccgacgaatttaactgtatggatacacactataaatgatgcaaaatcactctacacccaccagtttgtcagtatgcgagcaggctcgcatactcgccagtcagtcagctgaatgcttaagattaatgatggaaccagtcgtttatgcgcgagaataccccgcccttacccacgctctccagggtgtacagcggccagtgggcgatgactttgtcgcgatcgtaaagcgcgatctcccccacctgctgatgcgccgctatcggcgcctgtaaatctttgttggtcagggtgtattttgccttaatgtaaggcacttccgatttgggcagcgccagccagaaatcctgtccggtgccgaccgccacctgtttcttatcgccgaaccagatgcgctcgctgccgaccttctgcccctggcgcagcacctgcaccgtatcaaaattctgctggccccagtgcagcagtttacgcgcctggtcttcgcgtcctttcggactgtcggcacccatgatcactgaaatcaggcggcgctggccgtcaacggcagaggcgacaatgttgaagcctgcgccggaagtgtggccggttttcaggccatccacgttaagggatttatcccacaacaggccgttgcggttctgctgggtgatcccgttccacgtcaggcttttctcactgtacatatgataaaactgcggttcgccgtggataatagcgcgggagagcaccgccagatcccaggcggagctgtgctgccccggcgcatcgaggccgtgcacggtttcaaaatgggtgtcgcgcaggtgcagcttctgcacgtaatcgttcatcatcttcacaaactgcggctggccgcccgccacatgatccgccagcgccacgcaggcgtcattgccggaatcgacgatcagcccgcggctgagatcgcgcaccgtgacgcggtcgcccggtttgataaacatcagcgaggagccgtcaaacaccggattgcctttcgcccaggcgtccggaccgaccgttaccacctcgtccggggtgatgcggtggctgtcaatggcgcgatcgacaacgtagccggtcatcagcttggtcaggctggccgggttgcgctgttgatgttcattgcccgcggttaatacctggccggtggtgtaatccattaaaacccaggacgcggcctggatttgcggtggctgaggggtgacgggtaaatcggcagccagcgcagaattcacgcaaacagcaatacatgatgcggcaataaacaaacggcgtttcaacgggagatcctctgattcaggtaaatggctgacctttttacggaatttcttatgtcgttactccgtttaattgcaaagaaatgtgacagtggcgcgcggagtctggatgattgctcgcaaaatcagcagccggatggcatttatgtcggaagaagcggcgggatggtttaccatagacaggtcacttcaaaacaggatgaactcactggtgtctgattccgctccgcagccaacttttttatttcacgattacgaaaccttcggcaccagcccggcgctggatcgccccgcgcagttcgccgctttgcgaaccgatgcggattttaacgttatcggcgagccggaggtcttttactgcaagccggctgatgattacctgccccagccgcaggcggtgctgatcaccgggatcacaccgcagatcgcgctggcgaaaggcgataacgaagccaccttcgccaggcgtatccacgccctttttacggtgccggaaacctgtgtggtgggctacaacaatgtgcgcttcgacgatgaagtgacgcgcaatattttctatcgcaacttttacgatccctatgcctggagctggcagaatcacaattcccgctgggatctgctggatgtgatgcgcgcctgctatgccctgcgtcccgacggcatcaactggccggaaaacgacgacgggctgccgagcttccgcctggagcacctgacccgcgccaacggcattgagcacagtaatgcccatgacgcgatggcggacgtctacgcgaccatcgccatggcgcagctggtgaaggcgaagcagccgaagctgttccagtatctttatgagcatcgcagtaaacataaactgacggcgctgattgatgtgccgcagatgacgccgctggtgcatgtctccgggatgtttggcgcgtggcgcggcaataccagctgggtggccccgctggcctggcatcctgagaaccgcaatgcggtgattatggttgatctcgccggggatatgtcgccgctgttaacccttgaggccgatgcgctgcgtgagcggctttacaccgcgaaagacgatcttggcgatgacgccgccgtgccggtgaagctggtgcatctgaataagtgcccggtgctggcgcaggccaatacgctgcgcgccgccgacgctgaccgactggggattaaccgccagcactgtctcgacaaccttaaactactgcgtgaaaacccgcaggtgcgggaaaaagtggtggcgattttcgccgacgccgagccttttgtgccgtcggaaaacgtcgatacccagttgtataacgggtttttcagcgatgccgatcgcgccgcgatgaagattgtgctggaaaccgatccgcgtaatctgccggcgctggatattacttttgctgataaacgcatcgaaaagctgctgtttaactaccgggcgcgtaactaccccggcacgctggatgaggcggagcagcagcgctggcatgcgcaccggcagagtatcttcacagaggaatttttgcaggcgtgggtgcaggagctggaaatgctctacagccagcatgaaggagacgctgagaagcaggcgttactgaaagcgctgttccagtatgtgcaggacattgtctgacctccctcttctgagggcggtacagaaagcaaaaaaccggaggcgttaacctccggtttttttatacgtcatttagcgggtgctgcttttactgcgggatatcttcgtactgcggaaccggattgcggaagcttttagtcacgcaggccagatacagcagaccgatagcgccccagatgaggccaaggatcatggagctttcttccagattcagccacagtgcgcctaccgtcagcgcgccacacattggcagcaccaggtagttgaagtgatctttcagcgttttgttacgcttttcacggatccagaactgggagatcaccgacaggttaacgaaggtgaaggccaccagcgcaccaaagttaatcagcgccgtcgcggtcaccaggtcgaagttaatcgccagcagcgcaatcgcgcccaccagcagcacgttccatgccggagtacgccatttcggatgcacgtaaccgaagaaacgggtcgggaacacgccgtcacggcccatcacgtacatcagacgggatacgccagcatgcgctgccataccggatgccagtacggtgatggtggagaaaatcagcacgccgaactggaaggttttacccgccacgtagagcatgatttccggctgtgacgcatccggatctttaaagcgcgagatgtccgggaagtacagttgcaggaagtaagaggccacgataaacaccaggccgccaatcagcgcggtcaggaagatggcacgcgggatcacgcgctcggcgtctttcgtttcttcagacagcgaagagataccatcgaagcccaggaacgagaagcacaggatggttgcgccggtgatcatcggcaccacgtgcgcgccttcggaccagaacggacgggtgctggtcagcgtacctgcgccttcaccgtgcgccacgccatagacgatcaggccaatgatagccgccacaatccccatctgcaggatcacgatcagggtgttgaagttcgccactgatttgatgctgcgcagattggagatagtcataaaggctaccagcgcgactacgaatatccaggatggcacgctcggcaccagcgcttcgaaatagattttcgccagcaggatgttgatcatcggcatgaacaggtagtccagcagcgatgaccagcccaccataaagccaacagccgggctgatggatttctgggcgtaagtataggcggagcccgcagacgggaaacggcgaaccagtttaccgtagctgagcgcagtgaacaggatcgccaccagcgcaaaggcgtaagccgtcgcgacgtgaccatcagtcaatccagagacaatgccgaacgtatcgaacagcgtcatcggctgcatataggcaagacccatcataacaaccggaatcagcgtaagggttttacgcaattccacgcgagaggtttttggagtaacgttatgcgacatggtgaacccccattacggcagatgccatcgcaaatgcaaaaaattgccccatctgttttctttcctcagcgacaacgactgtcgttttttaaatgtgtatctatccggtacgaagcccggcctctttgattaaatgacgtttttattgcaaaaaaaataaccgacgcgtttaacgtcggttaatctcattttttgcaggcggcgtattttgccccaaatccgggcgcgatgacaagactgtgaaaggcctgtcatgcgaatatttttacgattgcccgccgtgacgggcatcagcaaaattgtaaacgccggtaatagcactatttgccactatttccctgcaccaccacgcgctggcgaggcctgcggtttgctcattccagcccagccagacgggttccccagacacctcgtcagtgacgcgtttttcaatcagcgcgccgctgtcgagaaagcgctgcgccagatagcgcggtacccagccaaagccgaggccgccccgtagcaactcaagtttagtcttaaaatcgaaaaccgcgatcgcttcatgatcgtccggcatggcctgcttaccgctggtcaccacaatggcgcgatggcgtttgatgtcatgacggggtatgggctctgctgctttcgccagcggatgatgcggggcaacggcgaaaacctgttcaaggctgcccagtcgggtaaagccaaagccgctgagatgaggaggttcatgcagcgcgccgacgatgatatcggcctcgccgttaatgagcgcctgccaggagcctgacagcacgccattgataaacttcagacgggtgacactatgatcccgataaaaggcgtcaataagcggtaacaacaaggaaaacgggaaggtgtcgtcaacgcctatcaccagctggctttcccagccctgatgaagcttcaccgcctgcttttccagttcccggacggcgtgtagtacgtcgcgccctttctccagcagcatctgtccggtgcgggtgaatttcgcccggtgcccgctgcggtcgagcaactgaatattcagatcgctctccagcttatgcacggtgtaactcagcgcagagggcgttttatagagctttgcggaggctgctgcaaagctgccctctttttccagcgcatccaggatcaccagcacatccagcaatggtttcatgctcgccccctcagggtgtgcgaccagtcaatccctgccagtcgccgtgtccatcggcatgagcagcggatcggggtattgatagtcaaatcccagctctttggtgatgcggctgccgtcaacgattttgcctttgtcagcagtcggcgcatcatgaaactgcggcaccggcagatccagctgccgtgccatggcgggataaaatgtcgatcgcgccgggtgggcaggcgcacagatattatagatgtgcccgccttttggagcctgcaacaaaagggtgattgcggcgacgacatcatccagatggacgagattgacgccatgctgaccgttgggcgcggttttaccggcaaagaagcggcccggatgacgccccggccccaccagccccgccagacgaaggatgtccaccgaggtgcccggcagattatgcagccagtcttccagatctttgagaacgcgcccgctggcggtcaccggctggcgaggactgtcctcttttaccgtaccggcaacgtcgccgtagaccgaggtggagctggtaaagataatacgcgggatgcggtgcgccagcgcgctgtcgacaatttcctgcatcgcctgcatatagaattcgtcccctggcccgctgcggcgggcaggtagtgtaataaccagcgcgtcgacgttcatcagggcgtcgagatcgtcggtgtcgcacatcagctccggggtgagttgcagcagatagctgtcaatgccgcacatgcgcgcggcctcaacgccgtcctgagttgttttactgccggttacctgccagccccgcgccgacagcgctaatgccagcggcatccccagccagcccagtccgacaattgccaccttcttcatgcctttctcctgacgttcacgcatctgcagtaaggctacgccagggtgagagaactgacaattcatagaatcaatatgaaatgatttaatgatggaaaaaagcccttgccttacagggctaaactggtttaggttaatcgcaagcagttgaatattcattcatcgagaaaatttatgacacgcgttcaatttaaccaccaccatcaccatcatcctgactagtctttcaggcgatgtgtgctggaagacattcagatcttccagtggtgcatgaacgtatgaaaaagcccccggaagatcatcttccgggggcttttttttgaaccaaattcaggcaggaacagaggataatccgaatgttagacaatacccgtttacgcatagctattcagaagtccgggcgcttaagtgatgattcacgcgaactgctcgcccgctgcggcattaaaattaacctgcacacgcagcgtctgatcgcgctggcagaaaacatgccgatcgatattctgcgtgtgcgtgacgacgacattccgggcctggtaatggacggcgtggtcgatctgggcattatcggcgagaacgtgctggaagaagagctgctgacccgccgcgcccagggcgaagatccgcgttacttcaccctgcgtcgtctggatttcggcggctgtcgtctgtcgctggcgaccgcggtggatgaggtctgggacggcccggcggcgctcaacggtaaacgcatcgccacctcttatccgcacctgctgaagcgctatctggatcagaaaggcgtttcctttaaatcctgtctgctcaatggttctgttgaagtggcgccccgcgccggtctggccgatgcgatttgtgacctggtctccaccggcgccaccctggaagctaacggcctgcgcgaagtggaagtgatttaccgctccaaagcctgtctcatccagcgtgatggtgagatggacgatgccaaacagcagttgatcgacaaactgctgacccgtattcagggcgtgatccaggcccgtgaatccaagtacatcatgatgcacgcgccaaccgagcgtcttgatgaagtgatcgccctgctgccaggtgcggaacgtccgaccattttaccgctggcaggcgatcagcagcgcgtggcgatgcacatggtgagcagcgagacgctgttttgggaaaccatggaaaaactgaaagcgctgggcgccagttcgatcctggtactaccgattgagaagatgatggagtgacggcgatgagcttcaatactgtaatcgactggaacagctgtagcccggagcagcaacgtgaactgttgcagcgcccggcgatctccgcctcggaaagcatcagccgcacggtcgctgagatcctggataacgtgaaagcccggggtgacgatgcgctgcgtgagtacagcgcgaagtttgataaaaccgaggttggcgcgctgaaagtcaccgcgcaggaaattgacgacgccagcgcccgactgggagagacgctgaagcaggcgatggccgtggcggtcaaaaatatcgacaccttccacatggcgcagcagctgcaaaccgtggatgtcgaaaccctgccgggcgtgcgctgccagcaggtgacccgtccgatcgattcggtcggcctgtatattcccggcggctccgctccgctgttctcgacagtattgatgctggcgacaccggcgcgcatcgccggttgccggaaagtggtgctctgctcaccgccgccgattgccgatgaaattctttatgccgcgaagctgtgcggtgtgcaggacgtctataaagtgggcggcgcgcaggcgattgcggccatggctttcggcaccgattccatcccgcacgtggataaaattttcggccccggcaacgcgtatgtgaccgaagccaagcgtcaggtcagccagcgtcttgatggcgcggccattgatatgcctgccgggccttctgaagtgctggtgatcgccgacagcggcgcgacgccggatttcgtggcctccgatctgctttcccaggccgaacacggcccggactcgcaggttattctgctgacgccggacaacgccatggcagaagcggtggcgcaggccgttgagcgtcagctggcggatttaccccgtgctgataccgcccgccaggcgctggcggccagccgtctgattgtggcgcgggacctggcgcagtgcgtggccatctccaatgcctacggtccggagcacctgatcatccagacccgcgaagcgcgtgcgctggttgacgacatcaccagcgccggttcggtatttctgggtgactggtcaccggaatcggcgggggattacgcctccggcaccaatcacgtgctgccgacctacggttataccgccacctgctccagcctcgggctggcggatttccagaaacgcatgaccgtgcaggagttgtcccgcgacgggttcgccgccctcgcctccaccattgaaaccctcgccgccgccgaacgcctgcacgcgcacaaaaatgccgtgacgctgcgcgttaacgcccttaaggagcaagcatgagcatcaccgaactcgcacgcgaaaatgtgcgcaacctgacgccttatcagtctgcgcgccgtctgggcggtaagggcgatgtctggctgaatgccaatgaattcccgacgccggtagcgtttcaatttacacagcagacgctgaaccgttacccggagtgtcagccgaaagcggtgattgacggctatgccacttacgccgggttgaaaccggagcaggtgctggtgagtcggggcgctgatgaaggtatcgaactgttgatccgcgccttttgcgagccgggcaaggatgcggtgctgttctgccccccaacctacggcatgtacagcgtcagcgccgaaacctttggggtggaaacgcgtaccgtgcaggcgctggacgactggcagcttaacgtgcccgccattgctgaaaagctcgacggcgttaagctggtatacgtgtgcagcccgaacaacccgaccgggcagatcgtcaacccggcggatctgcgggcgctgctggagatgacccgcggtaaagcgctggttgtcgccgatgaagcctatattgagttttgcccgcaggcgacgctcaccggctggctggcggagtatccgcatctggtagtgctgcgtaccctgtcgaaagccttcgcgctggcgggtctgcgctgtggctttacgctcgccaatgaagaagtcatcagcctgctgatgaaggtgatcgccccctacccgctttccacgccggtggcggacatcgccgcgcaggcgctgaccccgcagggtattgccgcaatgcgcgagcgcgtggcgcagatcctggcggaacgtcagtatctggtggcgaatctgcgcgatattccctgcgtcgagcaggtttttgattcggaaaccaactatattctggtgcgcctcaccgcctccagcgcggtatttaaatcgctctgggatcagggcattatcttacgcgatcaaaataaacaacccactttaagcggctgcctgcgcatcactatcggcacccgggaagaaagccagcgcgtcattgacgccttacgtgcggagcaagtatgagccagaagtacctctttattgaccgtgatggcacgctgattagcgagccgccgagcgactttcaggtcgatcgttttgacaagctggccttcgagccggatgccattccggttttgctagccttacaaaaagccggtttcaaattggtgatgatcaccaatcaggacggactgggcacgtcaagcttcccgcaggctgatttcgacggcccgcacaatctgatgatgcagatttttacctctcagggcgtggtctttgacgaggtgctgatttgcccgcacctgccggcggacgagtgcgactgccgcaaaccgaaaacccgccttgtggagcactatctggcggaacaggcgctggataaagccaacagctatgtcattggcgatcgcgagacagatattcagcttgccgacaatatgggcatcaccggcctgcgctataaccgcgagacgctgaactggacgatgatcggcgagcagctgacccgccgcgatcgctacgcgcacattgaacgcaataccaaagagacgcagatcgacgttaaggtgtggctggatcgcgaaggcagcagcaagattaatactggcgtcggcttcttcgaccacatgctggatcagatcgccacccatggcggcttccgcatggaaatagccgtgaaaggcgatctctatattgacgatcaccacacggtggaagataccggcctcgcgctgggcgaagcgctgaagctggcgctgggggacaagcgcggcatcaaccgtttcggctttgtgctgccgatggacgaatgcctggcgcgctgcgcgctggatatttccggccgcccgcacctcgaataccgcgcggactttacctatcagcgcgtgggcgatctgagcactgagatggtcgagcacttcttccgctccctctcctataccatggcggtgacgctgcacctgaaaaccaaaggcaagaacgatcaccaccgcgtggagagcctgttcaaagcctttggccgcacgctgcgccaggcgatccgtgtggaaggcgatacccttccctcctctaaaggggtgctgtgatgaacgtggtgatccttgataccggctgcgccaacctgaattcggtgaaatccgcagtgatgcgccacggttatacgccgctggtgagccgcgatccggatgtggttctgcgcgccgacaaactgtttctgccaggcgtgggcaccgcccaggcagcgatggatcagatccacgaacgcgagctgagcgatttgatcaaagcctgtacccagccggtgctggggatctgtctgggcatgcagctgcttggcagccgcagcgaggagaataacggcgtcgatctgctgggcatcattgagcaggacgtgccgaaaatgaaagatgtcgggctgccgctgccgcatatgggctggaaccgcatttatccaaaagcgggcaatcgcctgttccagggcattgaagacggatcttatttctacttcgtgcacagctatgccatgccggtgaatacctggactattgcccagtgccattatggcgaggcctttaccgccgcggtgcagaaagataacttttatggcgtgcagttccacccggaacgctccggtgccgcaggcgcgcagctgctgaaaaacttcctggagatgtaatgattattccggcattagatttgatcgacggcacggtagtgcgtctgcatcagggtgattacggccagcagcgcgactacggtaacgatccgctgcctcgtttgcaggagtatgccgcgcagggggcagaggtgctgcatctggtggatttaaccggcgcaaaagatccgcaaaaaagacagatcccgctgattaaatcgctggtggcgggcgtgaacgtccctgtgcaggtgggcggcggcgtgcgaagcgaagatgacgtggcggcgctgctggaggccggcgtggcgcgggtggtggttggctccacggcggtaaaatccccgcagctggttaaacagtggttcagccgttttggcgctgatgcgctggtgctggcgctggatgtgcgcattgacgaggcgggcaacaaacaggtggcggtcagcggctggcaggaagactccggcgtgtcgctggaagcgctggtggagaagtatctgccgtcaggccttaagcatgtgctgtgcaccgatatttcccgtgacggtacgctggcaggctcgaacgtctctttatataaagaagtctgcgcccgttatccgcaggtggcgttccagtcatccggcggcattggcgatctggaagatattgccgccctgcgcggcacgggcgtgcgcggcgtgattgtcgggcgtgcgctgctggaaggtaaatttaacgtaacggaggccatccaatgctggcaaaacggataataccctgcctggacgtacgtgacggccaggtggtgaagggcgtgcagttccgtaatcatgagattatcggcgacatcgtcccgctggcaaaacgctatgccgaggaaggcgcggatgagctggtgttctacgatattaccgcctccagcgatggccgcgtggtggataaaagctgggtgacgcgcgtggcggaagtgatcgacatccccttctgcgtggcgggcgggattaaatccgcagaagatgcggcgcgcattctcaccttcggcgcggataagatttccattaactccccggcgctggcggatccggagctgatcacccgtctggcggatcgctttggcgtgcagtgtattgtggtgggtattgatacctggtttgatgacgccagcggcaaatatcacgttaatcagtataccggcgatgaaagccgcacgcgcgtgacacagtgggaaaccctcgactgggtgcaggaagtgcagaagcgcggcgcgggggaaatcgtccttaatatgatgaaccaggacggcgtgcgtaacggctacgatcttgcgcagctgaaaaaagtccgcgaggtctgccacgtaccgctcattgcctcgggcggcgcgggcaccatggaacatttcctcgaagccttccgcgacgccgatgtggatggcgcgctggcagcctcggtgttccacaaacagattattaatattggtgaattaaaagcgtacctggcagcccagggcgtggagatcagggtatgttaacagagcaacaactggcccgactggactgggaaaaaaccgacggactgctgcccgccgtggtgcagcatgcggtatccggcgaagtgctgatgctgggctatatggataaagcggcgctggcgaaaacgcaggagagcagcaaagtgacgttttattcacgcactaagcagcgcttatggaccaaaggcgagacctccggacatttcctgaacgtagtcagcattacccctgactgtgataacgataccctgctggtgctggccaatcccatcggccctacctgtcataagggcacctcaagctgcttcggcgaagcgagccatcagtggctatttctgtaccagctggaacaattgctggcggagcgtaagacagcggatcctgaaagttcatataccgcgaagctgtacgccagcggcaccaagcgcatcgcgcaaaaagtcggtgaagaaggcgtggagacggcccttgccgccacggttaacgatcgtgaggaattaaccaatgaagcgtccgatctgatgtatcacctgatggtactgttgcaggatcaggaactggatatgacgacagtgattgagaacctgcgtaagcggcatcaataagacgaaaaaaaaccgggctgctaagtgcccggtttttttgtgcctgaattttagtatttaggctggtagttacggatggcgttgcgggccaggacggcgccagcgccaaccatggcacccaacaatgccgcgatcaataccgtcagagagcgtttcgggctgtcgcggaacaggggttccgttggtttcatgacataacgataggcatgcatatttgccggatcgggtttgatacgctgaatatctaacagattttgtcgtgtacgataataatccccggagaacaccagcggtcgtgaggcttcattcttaatcatggactccagcgcatcactacccagcaggaataaagtatcctgggtgacatcctgggtttgctgcacctggggttggttaacaccagcatctttagcaaaagtcagcgcctgcgtgatctgcttgatgcgcagatttttttgctcctgagccactttttcctgagtcgccagcgagtcctgcagctctgtaagacgtgatttgatgttgattgccagatcctgatccagctcatccgctatttgctcatcaacctgttgaatatatttcgccagttgctgctgcgcatgtttggctgaatcgccctgataggtgaccttaagcggtaagggctgaccttttaccgcagagtcaatggtcagggcctcaggcgccgactgatttttaagcgtttcagccagtgcagaaaacgccccgctaaaacgagtgatcactcgctgttgaatgtcaggattgtcgacttttccatcaccataaatcagcgccattgcattggtgtaacctgctatctgaccggcatctggcatggtgataacagccgttgaagtccatttctcttttacaaaggacacatagattccggcgaccacaactgcaatcataatgaaaatggcaataagccacttcccacgccacagctgcataaaaatatcaattagatcaatttgttcagaattattattacttctgacaaaattattatcgttgtgcgtcatagcaaccttaagaagaagattccagtctaagattaaaaattcagtgtagtgtacactttccataaaatcctggaatcagaatccgtttaattttgttactgtctgaaactacagataaaggtcacctgcaccggtagccttgctgatggcatcagcatacaatagcgggcatgttgcaccgcaggtgaaaaggacaagtatgaaatttttagtgactggcgctgccggttttattggttaccacgttagcgagcgcctgttgcaggcgggtcatcaggttgtcggtattgataatctcaatgattattacgatgtcagcctcaagcaggcacgtctggatcgactacaggtgccgggctttcagtttaaaaagctggatcttgccgatcgggaaggtatggcgcaactctttgccgacgagaaattcgatcgcgtgatccatctcggcgcccaggctggcgtacgttactcgctggataatcccctcgcctacgctgattctaatttgatcggtcatgtcaacgtgctggaaggctgtcgtcataacaaggtgaaacatttgttatatgcatcctcaagctcagtgtatggcctgaaccgcaagatgccattttcaacggacgattccgtggatcatccggtgtcgctctacgccgcgacgaaaaaagccaatgagctgatgtctcatacttattcacacctgtatggtttgccgactaccggcctgcgcttctttacggtatatggcccatggggtcgtccggatatggcgctgtttaaattcaccaaagcgatggtggaaggtaaaagcatcgacgtttataactacggcaagatgaagcgtgatttcacttatattgacgatatcgccgaagccatcatccgtttacaggacgtgatcccggaagctgataccagctggacagtggaatcaggttcaccggcgaccagttctgcgccgtatcgcgtttataatatcggcaacagctcacctgttgaactgatggattacatcactgctctggaagaggctcttggcatcgaagcgcaaaaaaatatgctgccgatccagccgggtgacgtgctggaaaccagcgcggataccaaagcgttatatgatgttatcggcttccgtccgcaaacctcggttaaacagggcgtgaagaactttgttgactggtataaagcattttataaagtgtaaaaaaaaggccctcatctgagggccttttttatcagtcgctgccgaacaggtcgcgggtatatactttatccgccacatccgccagttcttccgccatgcggtttgaaatgatgacatccgcttctttcttgaatgcatccagatcgcgcacaacgcgggaatggaagaattcatcttctttcatgaccggttcgtaaataataacctgcacgcctttcgctttaatacgcttcataatcccctgaatagaagaggcgcggaaattatctgagccgctcttcataatcagacgatagacaccgacgactttaggcttgcgggaaagaatggaatccgcgatgaaatctttacgcgtacggtttgcatcaacgatggctgagatcaggttgttgggaacggactgatagtttgccagcaattgtttggtatctttcggcaggcaataaccgccatagccaaatgacggattgttgtaatggctgccgatacgcggatcgaggcagacaccttcaatgatctgacgggaatccagaccaaggctttcggcatagctgtccagttcgttgaaataggccacgcgcattgccagataggtattagcgaaaagcttaatggcttcggcttcagtcgagtccgtaaacagcactttaatatcttttttgatggcgccttcctgcaacagggacgcaaaacgcttcgcgcgttctgaacgctcgccaatgacaatacgtgacgggtgcagattgtcgtaaagtgccttcccttcacggaggaactccggagagaaaataacgttatcaatacccagttcatcccggattgactgcgtaaagccaaccggcaccgtggatttaatgatcatcacggcctgcgggttgatttccagcacgtcgcggatcaccgcttctacgcttgaggtattaaagtaattcgttttcggatcatagtcagttggcgtggcaataatcacaaaatccgcatcgcgataggcatcctgcttgtcggtggttgcacgaaaattaagcggttttgtctgcagatattcctgaatctctttatcaacaatgggagagattttctggttaagcatatcgactttggcctggatgatatccagcgcgaccacttcgtgatgttgagcgatcaaaataccgtttgaaagaccaacgtaacctgtaccggagattgttattttcattcgctaagtaacttcttcaagtttaagtgtctggagatggcaataccaccaccactgaaatttgttaactgagggggttttacctcttacctttatcgcctgtcaagacgactactggaacctggttttgtccggaaaaaagcttttaggaaattactcaccccttcaaacgtgactacgcccgtaacaggtgcattccgcataaaaaaacgcccggtgttgcagaccgggcgtttagtagttttcaggttaaatcagattaatccagccattccgtatggaatacgccatctttatcggtgcgcttataggtatgtgcgccgaagtagtcacgctgtgcctggatcaggtttgcaggcagtacggcagcacggtagctgtcgtaataagccacagccgcgccgaaagtcggcaccggaatgccgttttgtacggcataagcaaccacatcacgcagtgcctgctgatagtcatcggcgatttgtttgaaatacggtgccagcagcaggtttgcgatggccggggtttccgcataagcatcggtaatcttctgcaggaactgtgcgcgaataatgcagcctgcacggaaaatcttggcgatttcaccgtagttcagatcccagttgtactcttcggaagccgcgcgcagctgtgagaatccctgagcataagagacgattttaccgagatacagtgcacgacgtactttctcaataaattctgctttatcgccagccggtttagcctgcgggccagacagcactttggaggctgcaacacgctgttctttcagagaggaaatgtaacgcgcgaacacggattcagtgatcagcgacagcggctcaccaagatccaacgagctctggctggtccatttcccggtacctttgttggctgcttcgtccaggatcacatcaaccaggtatttaccctcttcatcttttttcgtgaagatgtctttagtgatgtcgatcaggtagctactcagttcacctttgttccattcggtaaaggtctgcgccagctcttcgttggacagattcagaccgcctttcagcagcgagtaagcttcagcgataagctgcatgtcgccgtattcgatgccgttatgaaccatcttaacgtagtgacctgcgccatcggcaccgatgtaagtcacacaaggctcgccatcttcagcaacggcagcgattttagtcaggatcggcgcaaccagctcatacgcttctttttgaccaccaggcatgattgacgggcctttcagtgcgccctcttcaccgccagacacaccggtaccgatgaagttgaaaccttctgcagagagttcgcggttacgacgaatagtgtcgtggaagaaggtattaccgccatcaataatgatgtcgcctttgtccagatacggtttcagggagttgatagcagcatctgtacccgcgcctgcttgcaccattaacaggatacgacgaggcgtttcaagggattcaacaaactcctcaacgctgtaaaaaggaaccagatttttgcccggattttcagcaatgacttcctcagtcttttcgcgggagcggttgaaaacggaaacggtatagccacggctttcgatgttcagcgccaggttgcgccccatcacggccataccaacaacgccgatctgctgtttggacattacatactcctgtcaggtgtggtcaccgcgtcatgtgcgcggcttgaaaatgtgtcttagatgttaactcaaaaatattaaaaacaatagttcatgaattgtcaggtctttacacagcaaataagcattttttgataaaatctcataaacctgaaaatagtttctatttatgaaaaaataactactaacaaaagtatttttaacgactataacgtctattaaaagaaattaagggccagcgccatggctaagagcacccgatcccgggagcgtcttcttaacctgcaaacatggaacattaatttcaagttaccgacataacctgaatggatatttttgtgtaaaaatctgtcattacttaaagggaatagctcaattattttttcgatttcagcccgataccatttgtttttcaccaggctaagtcttttgaatattgagcgtaagctattgttagcgccaacctggttacttgcatgctgacgataaagcatcccagaattgttgtcgatgtaccatttgtaatttctggaacgagcgaaagcatatataaaccaatcatgcaaagcaatattacaaaccggcccctggttatcaattataaactttctaagttcaagataggccgctttttttataacataagtacatccagggccagcagcctcgaaataataatcgtaatcaacaaaaggctgtgatttgacaatttcacattgcatgccattttcccagaatgctgtcacattactggaataaaaatcattcttgtccaggttagcaatagcgcgacataacttgtcatttttccagatatcatcctgatctgacaacgcaatatactcgtcgtctttaatatcggcatccataatgagacgataaaagtttctggccgcgccaccaaacttcttacccattggtaaaaattcaacattggggtgtttagcggccatggactgaacaagttcttcagtaccatcggttgaaacgtcaacgctgataacaattcttacatcgacgttagactgttttaatattgactcaacctgctcttcaatccattgtttgccattgtaagcagctaacaagacgagaactttatctttcattacggtcaccattcttcatgcgtaacttgtatatttttgaaatgaataaacgcctaaagaactttaatagtgaaaaagctaccagaaagaaatactttggcattgttataagctttttatccattaattcagtatagttacttaattcgcctgattccattttccatagctttgagccaagtcctgcaccagaggcatatggatgtttatcatctgcataattgattacattatcacgtaatacagcgcttttaaattgatgtgttacgtaataaaaaaagagggcatcctcactgtaccttcgaccttcagaaaaaccatcaatgtggctgaatacttcttttcgcagaatcacagtcgaaggctggaagtactgtttcattaactgcatttgatacgtgacatgtatatgatcgtcacgaccatcagcactaataaatctattctgatacccgccaccaacaacaaaatagtcactgtttgccagaaaaatcatttgcttacgagttttatcactacgccactcgtcatcagcatccagaaaagcaatatattgcccgctactacgcctgatgccggcatttcttgccgacgctacccctgcattcgcttgcctgaccaggtcaatatcgatattctgttcatgagcaaatctcgaaactttatcggctgtgctatcagatgagccatcatcaatgacaattatttcaaaattgaatgcaccttcttgtcggataacggaaagcaaggctcgttcaatagtaccctccgcattataagccggaatgatgacgcttattttattcataatgatatattcttataataaccaggtcatgcataataaatacaattcaaattttatgagtgcatggagaatacttttttccaggaacttaccactgcatctggataatattttttactgctagcgacagcgttcttcgaaatagactcgcaaagctgctcatcatctaataacgccagacatttttcctgaagcgcctctagatttccattttcaatcaaaaatccattcacagcattctcaataagttcagcaggaccagtaggacagtcataactcactactacacacccggctgccatggcctctataataaccattgaaaaactttcacgctcagacgtcacaataagaaattttgacttttgaaaatccttgaaaatatcacttgatttaccgcacaatatctctgtggcagacggagaagatgataataaactctcatattcttcgccgtggccaaataattttgacgtaatgtttcggtgactcttgatataatcgtgcaacttcaaaaaatgggtaaatcttttgatttcgtgtagtctgccggctgcaacaaagtcaacaggacgggttgcaattggttcattaactgcgcccgttgcaaaattaacatctaaaatgttagggattgtatataccttagtaaaccattttctgtagtattcattatcttgttttgtcagacagactatggcgtcacatcctaaacggtaagagtatttacgtaacaatcttactcgtgatctatgggcataataatcagcgtgctgatgagcaattagcatgaatttctttttactgaatttccttagcagcgaaaggaaaaacgaaatgcgatcataagctgatataagtacggcatcagggggaagtgatttcaagaagttccataacttatgaatttcatttttacccgtcagtaatcgatactgctcatttgcatcaatatgaatttcagcattttcatgtaatgaaacaatttcagcatcatagccagaatgcttgagagtattcactaaggtaaaagaacttctttctattccacctaaatcacaagcattaagtaccagtacatatattttcatagatcgcagaatctctttgcatactaaattttaatgatcaacttttatgaccagcactaaagtatgttatggtagatataaccttccatggtcgtataaccattaatcttataagctgtcaccaggagtaacacattgaagaacgctattttctgtattaaatgtttgcagttataaaggattagcccataaataatcatatcatagactaaaaagtataaacttaaccgaacagcgatatccgggaaagagggataaagtgcaaggtagcaaaacatacctactaaataaagtttcaagaaaatgttatcgcgtacttgtcgtaatggaacaaccattagcaaaagtattactggcaataccctttttatacacccaagcagatagtccatagctgagtatgttgagttgtacgcactgtcagtataaagctcaacattacggaaatatcctaaaccactcagatactctgacaatgttaaaaatgagccagcaatgataaatgaacaaagagaagcaattaatatatttctgtatccaactttgaaatagttaactatatatgctaaagaaaatacaatcgcggttttatggaataagcaggcgatgaaaatagtaatggcaaagaaaaaaagttgttttcttacaacaaagaatattgaaatcagcgagattgataaagcaatactttgacgcatcccacttaaattcagataaaaaaacaaatccgaaaagaagactaataaggcgacattcttataatatgaaaacttatcaagaaagcatatcaataaagtaaaattaaggatattaattatcattaatacccaaggataacttaatccatccaatagtcgatagatactcgcaaatccaatctcaatattttgactaacaagttcatactggttgatatacatattttcataagcataccaatcaaggcctacattgctgcgtgttgccgcaaaaatcacaagcactactacaataaagaaggtcagaagatcttggtaggcttttcggtgataaaaagcatctgaaaaagctattatcgccagcaaaagatatagtaaaaaatacatttagcaccttaatcaggttattacgcaatataccaattgccgtagcacttgtgaaaactacttagtagtaaaatacttagagattatttttaaatatgaatcaccattcacattgcaaggctcaatataattaccttcagcccattcgttccatgattttaccatcaacatttttcttttcattctactaactatgttagcagtatttttaacatgttcttcaaataattcaggggagttatttttcagtatgaccccttttttaccatgcctgatactcgaatcccatcccggaaaaataacaggtatttgtaacgaattaggatcaatatccatgttcatttttcttgcacatcgttcgtatttgtagatgcgaggtataaaaatattataccgttgaagtttaacgatcagcaaatcgaaacatttccttataaaggttctatgtttcataaaatcacaactattcaaatactggtttaccaatttagtttctggatccccaggcaacatgttttcgccaataaagtagatgccatcaaaaccttctgcctgcgcccttgcagtaaaatactcgataagctctttgccatttaatgcatttttaagatcataaataaagaacactggcttgttatcgattttggtatatcgcttatctttaaaaaatggcagcaaataattaaaatatgactccaaagaaaaatcataatgttgttctttgaggagtttattttctgttttattccaccaggtgtggtttgcccacgcaaaacagaatttaacgtcaatatcactttttaacaataactctgctggtttctcaagcaacatatcatgatcgttaaaccagtaatgccaaaaacaaaaggacgtaatgccattttctttagcaattttatattgtttctcaatcaccgaaacgtcattcaaatcatagtaacccaaaggctctatgggttgagggattacgtggtccttataaattttcttagcacttttgagcttgacccattccgtaaaaccctttccccaccactgatcgttttcgggaatagcatggaactgtggtaaatagtaagtaaaaatctcttcaacttcagttttcataaaaatccaggaataaaatgaatgacttggaaacggccaaaattgtttttaatttttgaacacacgctgattaatggcggaaagcacttcttcgtccggacgtgtataaaataaactgacatcatcatcagcgatgttatttaaatcaagtttggaaaaatcaatttgtttagcatattcaatttcttgaggtgataatctcatactaattgtctttgccggatttccccctgcgaccgcataaggagctacatcttttgttaccacagaaccagcagcgatgaccgctccacggccaatctcgactcctgaaagaatggttacattgcaccctatccacacatcatcgttgatgattatgggtcccttggtaccagcatcaatatttttatttaaattcttttttgctgatacagggaatgaagtcattcctatagtcgaatggttaccacctaaaacaaaagtgacatttcctgcaattgaaacataatgaccaatttcaagccgttcaagcggattaccccattccagtacatatagggaaccataggtcattttaccgacctgaactttatcaaaatcaaaatcgtttataatggctgtatcattgtgtttatttctttttcgccatgcatgcttacgcattaataatttcagatttctttttacaaaagctactagcatttctttttcctgacggttgaaatcttttcatttatattatgctgaaggagattgattgcttaccagtgactcgatagctttaacctggcattgtgaagtacatcgctgtaaagccatttgacggctactttcttttagagcggctaaagaaggatcgtccaattttaaaaattccatgatggaattggctaaagcttgtgtagtaatactatccgccaggaaaccgctgattctgtcgacgatgagatcctctgcaactccgactttgaaagccatgactggaacacctgacatcagtgcttcgtttatcatcataggcccggcatcctctatcgaagggcaaataaaaccatctgccagattgtagagataaggatacttatctttgtcatgaataaaaccaatattcacaaaggaaatcccttcagggagagtagcctgggcttgatcaccgaccgttaaaatcgatacgcctgttagcagattgggaaagttctttctgataaacgccaaagcatcaagtacatactttacacctttcctcgggtcacttaaggattgcgcgcctaagaagataaccctattcccggcaggtatttgcacatcaataatatcgttggcgactacctttgtacggggtttgaaaatctgctcatcaataccgattatagctttcttgatgcccagtttcgctttaatcccacttgactcgcaacggtcatctaaccatttacttgccgaaagaaaaaaacaatccatttgcatgtaatacttcttacgcttatggaaaatatttttcggtagtttgatcaactcagggtatttcattgcagggcagttgtcacaatcaaccttataaccctcacaatgccatggataatgacaaccgccggtaaacatagctgcatccattaaatagaacgcaacaggacatccataatgcttttgtatttttaaaatatcatgatcagaaagataatcggcaacgaaataaactataatcagatcaggtttagttctgtattttttaaaaatttcgctgacactgaaagtagtattgtaaattaaataaattttatcttccgggccacctcgacgcacaaaaaatcgtcgcatcagtcttccaaaaatactaaatatctttcgcttattttgtgaaagctcaattacatctttatcgtgtgatgttttttccactacacacatgcttgattcgtgtccgtactttttaagattagtatgtgtacgatacgcaccaaagaaagcacccttactatcgccagtggacaaatgtaaaattttcatattttttctaccatttttttattttaaaattatggatagctgttaagaattgatttttgaacatatatataaaaccacaaataatcaccaggttaattattggcgggcacaaaatataaaggaatttattgcctgaaaataattcatagctttgcgtgattttgaaaaccacataagaaaccataaggatcagcatcgtcaataaggggatgatccggacatagcctgtcatctccttatgtacacagtaaccgccccataacaacataaacataagcgtctgaataaaatagaatatgcaggaccagtgtggcccaaaatacttggcaataagcactgttaagggaattgttaatgcggaatataatgcataggcgtaaaagtgaaacttcaactggccagtagaatataaaaggataaagacaaaattcatcatcccagcaaaaaaggcagcggaaaccagccatttagcatattcattaacagtgaaaccaagttctctgttttttagccacaatgaaattaaatcacctccgtataaatacatatacggaaccagaggcgcgagacatactatataacctattgaactaaggctaaatagttcaacaaatttggtatgatctttctctttaaccagcgcgctcattcttggcaaaagcaactgtgataaaggcgcagctaatgtaagcactaccgtactcagctgtgcaccaatctgatattgcgtatagcttgtgagatcggtataggttgagagagatatcttatctacctggctagctataacccatatcattgacaggccagataattgcagggaaaacttaattacgcttctgaaagaaataatctcatgaaccgcttgatcattattatcatgatattcattcaagctttttcgctgcatcatgatgacgtatgcgacacctcccgcagtggcaataatatcaacaattgctaaagccagaagagaagtaaagaaagcaatcaatgtattagaataataaactaatacgagatacgaaccgccataaaagaacgtagtatagaacatactccatatggctattaaatcctgacgctccatgccattaacaaaactctggaggtacgagcgtagatataataatgccagtattacaccagtaagtttaatacatattattgtttcatcgttcgacaggttggtcttcaaccagtcattagctatatagtctgcatagttgttaaagatgaaaacaagaataccggcgactacaacaaaaccacaaaaaaccttgagaaataaatttacaactcttgtgaaattaacaagctgatttttattggttgcaattaatttaatgaacgtaccgctaatgcctgcatctaacagacccattagcatgataagcatagtaaagaatgatactagtccataacgttccgttcccagcatgccaataattaacggtactaatagcagtggaaatgcggctctgtacaactgcgaggcatataatactattactttcttaaacataaccgctcacaataaaaaccagccaatcctgacattacatgtttttgaagaagtcagatattttggagcaaattgagtctacctgttccagactgagctcataatacataggtagtctgagtaaacaatctgtaaagcggtcactgtattcaagatctacaggctcatttttctcaaggaaaaaatcactcttattaagtgataaataatggaatacagagtggataccattttctttcagataagcaataagcgatgaacgggtttctatgtcgttacaaacaatataatacatatgagcattgtttgtagcataagacggaacatctggtaatttaataaggttttcagcctctaagctggcaagattcgcattataacgattccacagcgccttacgtttaccctgaatgtcatctaagctttcaagctgtgcatacaagtaagctgcaataatgtctgaaggtaagaaagaagaaccgatgtcaacccaaccgtatttatttacttcacctctaaagaatgaagcgcggttagtacccttttcacgaatgatctctgcgcgttgaatatattgctcatcatttatgacaagcattccgccttcaccagaaataatattttttgtttcatgaaatgaaaacgtgccaaaagtgccaatactacctaatggtttatctttgtagtatgagtcaattgcctgagcagcatcttctacaaccggtatattatactccctggatatagacataatctcatccatatcacaggcaatacccgcataatgcacaattacaatagctctggttttatctgtaatgctgttacggatagcaactggatcaatatttggattgtcgctgcaactatcgacaaatactaattttgcaccgcgtaatgaaaatgcattaacagtagaaacaaaagtataggatggagcaatcacctcatcccctggctggatatcaagtaaaatagcagccatttcgagagcatccgtgcacgacgtagtcagaaggacttttttgaaaccgtattttttctcaaaaaactcatggcactttttagtaaatgcaccgtcacctgaaattttaccgttactcactgcctggccaatataatttagctcatttccctgcatatacggcttattaaacggaatcattttgctgccttatttaagatcattaaaatagttagcatccgcatccttcgcggaaaggatcactttttctgccgatattggccaggtaatgttgagcgttggatcattccagacgatgctacgctccgctgaggggttatagtaatttgtcgttttgtataaaaactctgctgtttcgcttagcactacgaaaccgtgagcaaaaccctcggggatccataactgacgtttattttcggctgaaagcgtgacgcccacccatttaccaaaagtggcagagtcacgtcgtatatccaccgcaacatcaaatacttctcctactgcacagcgtactaacttaccttgcgcatagggttcggcctggtaatgtaatccacgcaatacgccttgcgtagattttgaatgattatcctgaacaaatgacagcgttgtaccaacatgctcctcaagtgctttctggttaaagctctcgaagaaaaaaccccgctcatcgctgaaaacttttggttcaataattaagacatcagggatttcagttttaattatattcattattaataacctttaatcattttcagcaaatattgcccataagcatttttcgagagcggcgcagccagttttttcacttgttctgcatcgataaaacctttgcggaaagcaatttcttcagggcaagatactttcagaccctgtcgttcttctattgtttcgataaaattactggcttcaataaggctctgatgcgttcctgtatccagccacgcgaacccacgtcccatcatggcgacagaaagtttgcctttttccagatagaggcggttaatatctgtaatctccagctcaccacgtgctgatggcttaagatttttagccatttctatgacatcgttgtcataaaaatataacccggtaaccgcataattactttttggttcagcaggtttttcttcaaggctaattgcggtgccttgtgaatcaaattctacaacgccgtaacgttcagggtcgttgacatgataagcgaagacagttgcaccgttttccctggaaactgcgccatcaagcagtttcggtaaatcgtgaccatagaaaatattatcgcccagaaccagcgcgcagttatcatcgccgatgaaatcttcaccaataatgaaagcctgcgctaatccatcagggcttggctgcactttatactgcaggtttaatccccactggctgccgtcgccgagtaactgctcgaagcgcggggtatcttgtggcgtgctgatgatcagaatatcgcggatacccgccagcattaacgttgacaatggataataaatcatcggcttgtcatagattggtaacagctgtttactcactaccatcgttacgggataaagacgtgtcccggaaccgccagctaaaataatgcctttccgtgttttcattttactatctcagacaatgagttaatgtgcagttgtggtaaacaactctgcgagcatacgcttaacgccctcttcccatttcggaagcaccagactaaaggtgtgctgaaatttttcggtatttagtcgcgaattcagaggacgctttgccggtgtggggaaactctcggtggataccgcagccagttcattaagagaaagctcgatgcccgctttacgcgcctcttcaaacaccagcgccgcatagtcatgccaggtcgtggtgcctgaagccaccagatgatacaagcccgcgacttccggcttttgcagcgcaacgcgaatggcatgtgccgtgcaatcggccagcaattcagcgccggtcggcgcaccaaactgatcgttaattaccgacagcgtctcacgctctttcgccagtcgcagcatggttttcgcgaagttgttgcctttgccggcatatacccagctggtgcggaagataagatgtttttcgcagttctctgcaacagccttctcccctgccagcttggtttcgccataaacattcagcggcgccgtttcgtcagtctctttccacggcgtctcgccggtgcccgggaagacataatcggtggaataatggactacccatgcgcccagtgcctgcgcttctttagcaatagcggctacgctggtcgcattcagtaattcggcgaaatcgcgttcggattccgctttatcgacggcagtatgcgccgccgcgttaacgatcacatccggacgcacacggcgcacggtttcagccacgccttcaggattactgaaatcgccgcaatactcctgcgaatgcacatcgactgccgtaagtttgcccagcggcgccagcgcgcgttgcagttcccagcccacctgacctgttttaccgaacagaagaatattcatgattaacggctctcgtagttctgttcaatccagctctgataagcgccgcttttgacgttcgccacccactgctggttatccagataccattgaacggttttacggatcccggatttaaaggtttcctgtggtttccagcccagctcgcggctgattttatccgcatcgatagcataacggcgatcgtgtcccggacggtcagccacgtaagtgatctgatcgcggtaagaggagtcttttggcacgatttcatctaacagatcgcagatggtgtgcaccacatcgaggttctgtttttcgttatgaccgccgatgttgtaggtttcgcccggctgaccttgtgttaccacggtgtagagcgcgcgagcatgatcttcaacatacagccagtcgcggatctgatcgcctttgccatagaccggtaagtttttaccttccagcgcattgaggatcaccaacgggatcagcttctcggggaagtgataaggaccgtagttgttggagcagttagtcaccagcgtcggcataccataggtacgacgccacgcacgcaccagatgatcgctggaggctttggacgcggagtacgggctgcttggcgcataggccgtttgctcggtaaagagcggcaatgcctcgccttgtggatgctcgtccggatgcggcaggtcgccatagacttcatcagttgaaatgtgatggaagcgaaacgcggattttgccgcgtccgaaagagctgaccagtacgcgcgggcagcttccagcagcacataggtgccaacaatgttggtttcgataaaagcggcagggccagtgattgaacgatccacgtggctttcggctgccaggtgcatgacggcatccggcttatgctgatcaaaaatacgcgccatcgctgcggcatcgcaaatatcagcatgttcaaaatgatagcgctcgctgtcagcgacatcactgagcgattcaagattaccggcgtacgttaatttatcaacattcacaactgaatcttgagtgtttttaataatatgtcggacaactgcagagccaataaagccagcgccaccggtaacaagaattttcacgctatccattccgtttagtaaattgagaggaagttcgacacgacagaattgtcgcggctttagcccgcaggcacgctaccgcccctggctcaacagctaccagtggactgagtaaggtcattttgtagggcaactgcgaaatgtagcgggcgtacgcccgttttcaaccgctaattgtcatccttatttcacattgaaacaaggaaaattcttatggatcaccggccttcgcatattttttaagccgttgatctacaagaacttgtagttgaaaataaaaaaagcagcagataatcatcagaggcaaatattcgcctctgagatcatctactgctctgtgttcacttactcgtaaaccgtccggaacatcagccaaccgttaacgtaatagtttagcaatgctttcgcggaatttttgaccttctttcagattacgcagaccatagctgacaaatgcctgcatatagcccatttttttgccgcaatcgaagctgtcgccggtcatcagcatcgcgtctaccgactgtttttctgccagtttagcaatggcatcggtcagctggatacgctcccaggcgcccggttcggttttttccagttccggccagatgtcggcagacagaacatagcgacccacggccatcagatcggtatccagcgtttgcggctgatccggtttttcgacgaagttaataatgcggctgactttaccttcgctgtccagcggctctttggtctggatcacaccgtattcagacagatcgcccttcatacgtttcgccagcacctggctgcggccggtttctttaaaacgtgccaccatagcggcgaggttataacgcagcggatcggcgctggcgttatcaagaataatatccggcagcacaaccacaaacggattatcgcccacgataggacgcgcgcagagaatggagtgacccagacccagcggctgcgcctgccggacgttcataatggttacgcccggcggacaaatagactgtacttccgccagcagctgacgcttaacacgctgttcaagcagcgcttccagttcgtacgaggtgtcgaaatggttctcaacggcgttttttgaagagtgggttaccagaacgatttctttgatccctgcagcaacaacctcgtcaacgatgtactgaatcattggcttgtcgacgatcggcagcatttcttttggaatggccttggtggcaggcaacatgtgcatcccaagtccggctaccggaataactgctttcaaattaatcattattaattccacctataaatggttgatgaattatagctatttagcctgctttatccagcaggttttcaccctctggttgaggcaaatcatgttacgccggttaatatccgtatgcagtagatgtaatccgaagctgcctcctggcgcaccaggaatgttcgcaaacttgtttttatgtgcgtttatcaggcagacggaagttcagtttatcggtattgaccacatgctgatccacccggtcgatgtccaccgagctttggcctttttcatttaccgcatgaatgttggccagggaaagcagcgtgtcctgcttcgccataaagcgaccgcgcacgtctttgcgcagatcaaactgcattttcagcgccggtccggtggcggcttcctgcatgatattaatgttacgcaagaacaggtgctgcggcttattgtgcagggcaagggtcgcgcgcttcatggtcagattggtgatcgccacaaaggatgtcgcgttgccggatgagatctgtataccacgcagtttcagttcactgttgctgttatcgagatgcacgtcgttgagcttgaaattttgcgggatagagaggtaattgcctttgattacgccataaccaatcagcataccggcgctgttggtcatgttgacgttatcaatcacgaaattatcgcagccgtaaatcgccacggtggcgttatcaatgccagctttcttactgtactccggcgtaatatcggtggctttgatattgcggatcacgaagtgcttgccgttctccacatgcaccagctggcggcagtggctgccggtaatgttcgccacgacaaagttttttaccgcctgatgttccgggtaatcattgtcataggtgctgcccgcgaggccaataccaatcccccagttgatcttgccgttggtgcagtcaatatggtcgatgacatgatcggaaataagaatattgctgtcgttgatcgccacgttccactcgatggcgtcgccctgcagatagctgaagcggctgttggtgatacgcgcgccgtcaatacgattatggaagccctggcgcaggatcgcgtagttggctctggtgaccgtgatgtcatcaatcagcaggttacgcattacacgtttatttttgccgccgatgtagatttgcgtcaccggcccgaagccgctcattgccagccccttgatcacacagtccgatccgcgcacgtcgagggtaatgttatacaggctaccgcccttctcacctatgaccttactgccatcctgtaacacaaagcgtccgcggccattccccttcagggcaccacgcaccagcagggttttcccttccgggatgaaaatgccggtattgatgttttcacaaacgagatcggcgggtacttccaccgtctcgccatcggcgaacgcctgtttaaacgcggcgatccagtcatttttctggtagtcgcgcacatcaacggtggatttactgccctgcgcgaaggcggcggcaggcagaagcggaagcgaggccagtacggaaccggccttaataaagtgtcgacgggaaaatgctgtcataaaacctcagttcagagcgtctggagcagcgtcgccagacgctgattgattttctgctgattaaagtccgtttcgactttttcacgggcgcgggtcaccaccggcaccagctgctggctctgcatgctgctgaaggcggccagtttgtcagccagcgcctggggatcgttctccggcaccagccagccggactggtcagcgtcgatcagctcaggaataccgctgtgtacggtagagacgaccggaatgcctaccgccatggcttccatcagcgccaccggaatgccctccatgtcgccgtcagcgccggtcacggacggcagcaggaagacgtcagcctcatcgagcattgcctttacttcatggctgggcttaaagcccggcatctcgatcacgtcctcaagctggaactgttcgatcagagtgcgcagacggcgctcccagggtccgatgccgagaatgcgatagtggaaattaacaccgcgcgccttcagcagacgacaggcttcgatggcgacatgcagcccttttttctcggtcaggcgcgccacggagattatctgcaagggttgtccgggcgctttcacctcgcgcagggtaaagcgcgacatatccacgcccatacgcgaaacggcgatcttctccggcgggcagcccatattttgcaggcgaccggcccacagatcgctgatgggcaacatcagatcgccgcggcggaacagctgctgatactccggcgtatagtgcgccagtacgtcccggtgcgagacgtcgataccgtggaagacggtggcgattttgccgcggatcacccccagttcacgcagttttgctgccgtcacgcctgccggaccaaagtgggcgataaacacatcggcgctgaaagtgcgtggtgccaggccacaaatggcggcgaggatcaggttacgggcttcatcgccgtagcggcgcatattcagcgccttccaggtggatgcgcgccccgcgccccgcaggatcgcctgcgcccggtagcgcagttttgcggctttgccctgcggctcatccagcagccagtgggtcttctccgccagcttgtattcggtataggccgcatgggtattgctgagatcgcccttatgcagggcgataatctccacgtcaaaccccatatcgataaacgccgtgatctggttcaacacgaaggtttcggacgacagcggaaacttcagcaggaaaaaactgaccttcattgcttaccccgcactctgtccatcaccgatttcaccatctgcaatccattattgcgttctgcggccaccgccgttgaaagttgctgattaatggcgggcagctggccgagggtatccgccaccatcgcggcgagcgagccgtcgagcaaatgacgaatatcaatggccatctccggcatgccaagctgctgcatgatgcctgcggatttgtgctcgtagttaatggcgatggccggtgtgccgaagttcatggagatgatcgccgaatgcagacgggtgccgacggtcagatcacaggcggcaaaaattttgcccatctccagatcgttaagctcatccatcaccacgtgatagcgggacggatcgctgacatgctgacgcagattgagcgccaccatgcggtcatctttgttatagctgtcgatgccggtgcaggtggagagcgccattacctgccagcccgcatccagaatacggctaaccacttcggcgaaggctttttcgtaggcctgctgcgtggtgccgaggcgtttatcgaagggcgccagttcgcgcaacgtaatggcgacggttttctgcgaggccgccacgtccagccagtgctgcaccgcatagctgggggtaaaatcgctatcgtgatgatccaccagccacgcggtgtcgacgccctgctccaccttatcagtgttgatctggctctttttcatcagatcaagacttacgcgctcacgcaggatcaaggcatcgcagtgcccgaacgcatagttcgccagctggttaaactgcgcgtcctggaatggcccgacgctgtggccgatcatgtacagcggttttttcgccataaaggtgcagagcgcatgctcaaactgcggcacgccgtaaagatcgacaaagaaagatccgcccacctggataatggcgtcatagcctgacagcaggcgaacgaaatcggtaaagccctgggcaatggcgatattgcgcagcttgccgctgtcggtcacgcgggataacagcacctgatgctgataacggcgacgcaggactttcttcacccgcccgaccagaccggcggcggtattgtgctgtttcatctggctgtacagcggatcgcccatcaccggacgatttaatagccaggaggagctcaccggatagcggctcatgacatccacttcagcgtcaggctcaagcaccgtaatggcatccagtaagccgcgtaaaatcgcgctgtccccacggtttccacaggtatggttacctaaaataagtagtttcattacagtttcacctgaattattgatgtcgtaaatttgtgaataaaatcaacctgcgcgcagcagcattcttaatttttcattgcggcaaaactgacgtttcagctccaccaccagcgcattacgcgacagcacaatcatcaccgcgaacgccagcccaccggccaggatctgcaccgccagcagcgtggcaagggacaaatgcccgtccagcgccagccccaggccgtagctcaccaccagcgtcggcagcgacaggtaaaacggcagccacaggctcagaatgtactggcgatagctggaaccgagcaccggcttaatcattacgaaatagctcagaatggtgttgatgatctgcaccagcaggaagcccagcgtcacgcccagcgcgccgcccatgtgcccgcctgcgataatcgccgggacgaacaggcaggttttaaagacgttaaatttgaagctgatatcgacacgggctttcgccatcagcagcgatccaatggggttccccaccgcgcgcagcaggccgacgatgcacagcaattgcagaatggggatgatgctgttccacttctcgccaaacaccagcggcaccacgttatcggacaccaccatcagaccgagcaggatcgggaagttgataatgcccaccaccgacagcagtttgtagaagttgagccgcagcttttgcgtgtcgtcctgaattttggcgaaggccgggaagagcactcgggtgataatggggttaagcttcatcggcggcaccaccgcgacgttgtacgccaggttatagccgcccgcgacgctggcgccgagaatacgcgccagcaccagcgtggagaggttagtgttgacgtagttgatcacgctatccgccgtcagccatgcgccaaagcgcaggttggagttgacggaagccagcgaaaagcgcagacccggacggtaaattttgcggccgaagaagccgaacagcagcgtacgcaccgcggtgttgaccagataaccaaggatcgcggtcatcgccagcggccagtaccaggcgctgatcaccgtaaaggtgaagcccgccatcaccgatacggtttcaatcatgccgatcttgctgaactccagctctttctgcatcagggcgcggaactgctgaccgtgggggatcagcacaaaagccaccgacagcgttttgatcagcggcgccagatccgggttattcagtaccccggcaatcacgtcgcttaacaaaaacatcgccgcgcagaccaccagccccagcccgacgttcagccagtagagggtggtcagttcgagatggccgatctctttgcgctgaataatggagttggcgatgccaaaatccgacagcgtatccgccagggcgatgatcaccagcgacacggtgagcaggccgaactggtgattatcgatgatgcgcgccagccaggtcatctgcaccagcccaaggccgatgatgatcagggtggccatggctgaccactttgcgccgctgatggttttctctctcaggctcatgatgtgctcgcttaatacgccgctttgttcacaaagcctttaaagatggtgagaaaaacaatcttgatatcgaaccagaggctccattcacggatgtactccagatcgaattcaatacgtttttccattttttccagcgtgtccgtctcgccgcgccagccgttgatttgcgcccagccggtgatgcccggtttcactttatgacgcagcatgtagccctggatcagggtgcgatactgttcattgtgcgccaccgcgtggggacgcgggccgacaatcgacatgccgccggtcagcacgttgataaactgcggcagttcgtcaagtgaggtacggcgcaggaagttgcccactttggtgacgcggggatcgttctgcgtcgcctgggtgaccacttcggcgttttccatcaccttcatggaacggaatttccacaccttgatcggcttaccgtccataccgtagcgggtttgacggaaaataatcgggccaggagaactgattttcaccgccgccgcgatgcacagcagcaccggggagataagcagcaggatcagtgaggagagcacaatgtcttccagacgcttcagcacgcggttcatgccggagagcggtgtgtcatacagcggcaccaccggcacgccgttcatctcttcgatgcgcgaatgcaggatattaaaggtaaacacatcagggatgaggatcaccgagcaggtggtgtccgccagctcacgcaccaggcgttttatgccggactcttcgctcatcggcatggcgatgtaaacgttatgaattttgcccgctttcgcgtcttccagcagttggtcgtaattgcccgcccagtcagcggtcacgccgcccggtctggcatcgtgatagacgcccaccacttcaaagcccagccagggctcatggcggaaactgtccagcagcacctggcctaccggcagatcgcccgccaccgccacacggcgggtgttatagccatgatgacgcagccagcccgcgaaaaagcggatcagcgtgcggcaggtcaccagccccacgctgcttaatacgtaccaggcaaagaaaacgctgaaggtattatcaaaatcggcgttgaaggccatcagtccggcgctgaaaatcaggctcagcgtccagttttgcagcagcagcgccagctcggtcgagatcttcacgccacgccaggaacggtagaaatcggtcataccaccgatcatctggaacaccaccagcgtgatcagggccatcagcagatgcaggtaaaaaaagggtaacgcgtgtagcttgcagacgatccatagcccaccgaacatgatggtgatgtctgaaaaacgctgcaccatagagattaacgatgcattcgttttagctcgctcgcgcttttttagatttatcatcgttgttcctgttcttaagtcccctcgccccttcccgcgggcgaggggaaaccaagctcgactactggttcaacagcgccaggatgtcctgtgttcgtgcctccatcagcgccacgtcaccccgcgattcgacgttcagacgcaccaccggctcggtattggacgagcgcaggttgaagcgccattccgggaacgccatgctgatgccgtcggtatggtcgacttccagcgcgctggcggcatagtgctgctccacgcgggcaatagcggtggccggatccgccagcttgctgttgatttcgccgctggccgggaacgccgtcatgcgatcgcgaaccagttccgacagagactgccctttcacacacagcagttccgccaccagcagccaggggatcatgccgctgtcgcagtaggcaaaatcgcggaaatagtgatgggcgctcatttcgccgccgtagatggcgtcttcttcgcgcatacgctctttgatgaacgcatgaccggttttcgacatcaccggcttaccgccagcagccgtcaccacatccacggtgttccaggacagacgcgggtcgtgaatgatcttcgcgccagggtgtttttcgaggaaggcttcggccagcaggccaacaatgtaataaccttcgataaactgaccgttgccgtcgaacaggaagcagcggtcaaagtcaccgtcgaaggcgatccccatgtcggctttatgctcgatcaccgcattgcgggtatcgtcgcggcactccggcagcagcgggttaggaataccgttcgggaagttgccgtccggggtgttgtgtaccttgataaaggttaccggcacgttcagcgccttaaagcgcgcttcgatagcgtccaccaccgggcctgccgcgccgttaccggagttaatcactaacttcagcggcgtgatgttggtggtgtcgatgtaaccgagcaggtggtcgatataagcatcgcgcagatcgatctgcttatagctgccgcgtttatccgggttcaccggcgggaaatcattggcttccgccagacgctgcacgtcgcgcaggccggtatcgccgctgatggggcgcgcgcccttgcgcaccagcttcataccgttatagtccatcgggttatggctggcggtcacttcgataccgccgtccacgccgagatggaaagtcgcaaaatagatctcttcggtgccggaaagaccgatgtccagcacgtcaacgccagcgtcctgtaaccctttcgccagcgcaagcttaagtgcttcgctggtcagacgcacatcaccgccgagcacaatggtctgcggcttcaggtattcgccgtaggcgcgaccaatgcgccaggcgatgtcttcgttcagctcttctccgagcttgccgcgaatatcgtaggctttgaaacaggttaatttttccatgattacctcgttttcaggcgacacacagcctggagcccgttggggcaaatttgttatttgttccagcccggtggcgttttgcttaccgggcccggtgatgcgaactttccttgcccggtggcgcttcgcttaccgggcctacaatcattcacctgtaggcccggcaagcctgcgccgccgggcaacgttcattcactacacccgaccgtaacgatcctcaaaccgcacgatgtcatcttcttcaagatacgaaccggagcggacttcaatcagatccagcgggatcttgcccgggttttccaggcagtgcgtggcaccgagtgggatatagatcgactcgttttcgcccagtaacttgatctcgtcgttaatggtcactttggcggtgcccgccaccacgatccagtgctcggcgcggtgatgatgcatctgcaaggacagcccttcccccggcttcacggtgatgcgtttcacctgatagcgttcgccggaatcaatggagtcatacttaccccacggacggtacacttcccggtgaatgtgatgctcgtgacgaccctcggctttaatttgctcgaccacttttttcacgtcctgcaccgcattacgatcggcgatcagcaccgcgtctttggtctgcaccaccaccagatccttcacccctacggtggtgacaagaccggattcggcatagacatagctgttttcggttttatggctgatcacatcgccgtgatgcacattgccctccggcgtatgggcgctgatttcccacagggacgaccaggagccgacatcgctccagcccgcgtccatcggcaccactaccgcatcggcggttttttccatcaccgcgtaatccaccgactcttccgggcaagcgagaaaggcttcttcatccacgcggataaaatcgagatccggatcgacggcgtccatggctttggtgcaggcctgcaaaatatccggacggaattttttcagctcttccaggtagcgaccggcgcggaacaggaacatgccgctgttccagtaatactcgccgctggcgacgtaagcctgagcggtatcgagatccggtttttcaacgaactgcgccacttcgaaagccactgcgtccacctgcccctggctgaccgcgccacgacggatatagccataaccggtttccggcagatccggcacgatgccgaaggtcaccagtttgccgctctcggcgtacggcatggctgcacgcaccgcctcgcggaaggcttcttcgttctggatcacatgatccgccgccagcaccagcatcagcggatcgctgtccgggctgttgcgctgcgccgcaagggcagccagggcgatggccggggcggtgttacgcccggcgggttcaagaatgatgttctccgtcagcttgttgagctggcgcagctgttcggccacgataaagcggtgctgctcgttacagatcactaccgggctttcgcactgcacgccgttcagacgacacaccgtcgtctgcaacatcgtcagttcgcccttcaggcacagaaactgttttggatagagtacgcgggacagcggccacaggcggctgccggagccaccggccattactaccggatagagcgttggttgactcattgtttaatcccgaatatctgcaataaattggcttaacacgttctctttttcgagcgtgcgttcggcatattcacgtgccaccgtgttgaatttgggcatcagcagggcctggccgatgccgtcgatcagcgcgtccaccgattccggctccacgcagaccgcgatccccggacaggtgtcgcacagttgtcccagttcggtgtggcgctcggctgtgatcaccgcattgccccccaccgcaagaatattggtcagcttcgacggcagtaccgcgtcagcagcgccgcgcttctggatcaccagatgacaatccgccagcttcagcagcgcgggcagcgcgtcataggactgcaacggatgaaaaatcacgttgctcaggccgcgctcgcgggccattttttccagtcgcgctttgccgccgccctggccgacaatcacgaacagccacggctggtcgcgcagacgatctgcggcttcaatcacgctctccagcccctgcttttcgccaatgttgccggagtaaagaatgatttttttatccgccggcagggcgagttgctggcgaagcgttgatgcatcggcatcggtaacgtcgcgaaaacgcgccacttccgaccagttggggaagaaaatcacccgctcagccggtacgcctttttcctgcgctttattcatcatcgagcgcgaaatcgtcgatacgttatcgacgttgtgcaggccgctgcgctcaaaggcgctggcaagccgggccactcgcccgcccttacctttgccggccatgccgaggccaagcatggcatcgacttcgtaatcctgaatgtgcagtacggtacgggcgccggacagttttgccagcaggcgcatgcccggcgtacaaaacagcgtcggcaccacgccgataatgcgatccggcttccagcggcgctgcgccatcagcgggaaaaagctgctcagcgcaaagctgccgagatggatcaggcgctttaaggtggtcggggttttgggcacatatagaggacagcgccagacggtcgccgccccctcttcccgacgccagcgccaggccgagtaaggctcgcccactttccactccggatagtacggcggcgcggtaatgacgcgaacgtcatggccctgacgggccatccattccaccatctcgccggtgtacttaccgatcccggtcagctccggcgagtagttaattccgtacaccagaattctcataagcccggcactccggacttatcagtacggaaataggcgcggctgttgtcgtgcacgttctcgctgttcacgatggcgtcaggcgtcatccagcgccacgccccgtgctgctcggcgggcagcgtcagggtgctttcatccacacggacacggaaacccagcacgatgtagtgcgtggaaaaatcgcgtccggagaagttgtcgtcatagaagtgctgccagacgccgtaaaactcgcctgccgacatcggcagacgggttcccagttccgccagggtcaggcgctcgaaggcgctggccagcggctcatccttttgtacgcgtccgccagggacaaaccagtatccctgtgccggacggttggtgcgttctcccagcagaaactcaccgcgcgaattttccacgatgagatcgatggagatcagcggcgttgagcgcactaccgtggcgaagtcttcttgactcaaaaacatgcttacccccggaaccggtgctggttttcaaggaaccactgataggtgcttgccagcccctgctccagtgacacctcgtgataccagccaagctgatgcagacgcgtcacatcaagcagcttgcgcggagtaccgtcgggtttgctggcgtcgaacaccacgcggcctttaaagccggtgacctgcgcgagggtttgcgccagttcgcgaatggtgcagtccacgccggtgccgacgttaatatgcgacagcatcggttcggtgttttcctgccacacttccggatccagctccatcacgtgaatgctggcagccgccatatcatccacatgcaggaattcgcgcatcggcgtaccgctgccccataccaccacatccgtggcgttttcctgggccgcttcatggaagcgacgcagcagcgccgggatcacatgggagttgctcgggtggaagttatcgttcgggccgtacagattggtcggcatcaccgaacgataatcacgtccgtactggcggttgtaagattcacacagcttgataccggcaatcttggcaatcgcgtaaggctcgttagtcgcttcaagcgtgccctgcaacagctcgctttccgccatcggctgcttcgccattttcgggtagatgcaggatgagccgaggaacagcagcttattcacgttgtgcgtatgcgccgcgtgaatgatgttgctctcgatcatcaggttctcgaaaatgaactccgccgggtaggtattgttcgccacaataccgcccactttcgccgccgccagatacacctgatcgatggattcggtggcgaagaaatcatttaccgcacgggcatccagcagattgagttcatcacgggtacgcaggacgagctcaacgtccccgcgttgctcaagctgtcgtacgatggccgaacccaccattccacgatggccggccacaaagatacgttgtttgctcatgcttacgactccagcgcgatggcgacctcgaagccatgagctttcagcagcgagtgtttcttagccgcttccagatctttggctaccatttcagagaccatctcctgcagggtggtttccggtttccagcccagtttttcgtgcgctttggtcgggtcgcccagcagggtttccacttccgccggacggaagtaacgcgggtcaacagaaacaatcacatcccctggcttcacgcccggtgcatcgtgaccggttacggacaccacaatgcctttctcgtcaacgccttcgccttcaaagcgcagtttgataccgagctgagccgctgccatttctacgaactgacgcacggagtactgcacgccggtggcgataacgaaatcttccgggtgatcctgttgcagcatcatccactgcattttcacgtagtctttcgcatggccccagtcacgcagggagtccatgttgccgaggtacaggcaggattccaggccctgagcgatgttggcgatagcacgggtaattttacgggtcacgaaggtttcgccgcgacgcggggattcgtggttgaacaggatgccgttacaggcatacatgccataggattcgcggtagttaacggtgatccagtaagcgtacagtttggcaacggcatacggagaacgcggatagaacggcgtggtctctttctgcgggatttcctgcaccagaccatagagttcagaggtggatgcctgatagaaacgggttttcttttccaggccgaggaagcggatcgcttccagcagacgcagggtacccatggcatcaacgtcggcggtgtattccggcgattcaaaagaaaccgcaacgtggctcatcgcgcccaggttgtacacttcatccggctgcacttcctgaagaatacgcgtcaggttggagctgtcggtcagatcgccatagtgcaggtggaatttcgggttgctggtatgcggatcctgatagatatggtccacacgctcggtgttaaaagaggaagcacgacgtttgatgccgtgaacttcataacccttctccagcagcagttccgccagataagaaccatcctgtccggttacgccggtgatgagagcgactttactcataatttattttcctcaaaaagtgccgtttcgacgcgtttgcgcgtcaccactgcgggattaccccggcaaatcacattcgccggaagcgtcttaaaaacactgctacgggcaccaacgacggtgccatcgccgatttttacgccgggggcgacgaaaacatccgttgccagccagcatttatcgccaattactatcggggcggcattaatatcgaaatgcgcgctctgataatcgtgactaccggtacataaataacacttttgtgacaccacagaattcgagccgatggtgatgtcgcccagcgtatataacaccgcgtcatcacccacccagctataatcaccgagcgttaatttccatgggtacgtaattttcaccgacgggcggatcaccacgcctttaccaatttttgcgccaaaaagacgcaataaaaatgcgcgccagcggtacataacctgtggggaccaggcaaataatgttgcctgtactgcccaccagagctgaactttgagcgcactggccccgcggaagccggcgggtaccgtgaatccgtttaattcctgcatcgtatttccttatattcaggctttgttatataaggcttttgttttaccggttgtgcgtttgcgcagcaggtaagaaagctctgcccagaatgccggcacgcgtaatattttgcgctgcacatttttagcatcctggcataattccagattattcgaggttgacacgccacccatcgaaaattcagaaaccagtcctttcaggcgcttaaaggcatagcctgctttaaacatgcgggcggcaagcgcgtaatcggaagagactttatattgtaaatcgtaggggtaggttttcagaccgcttaccgggaagaatatggcctgatggctggccggtaagctgtggtagatataccatccatgtttcgcactgcggcgaatttttttcccgtcaccaaaatcgagtaatgcatcgccaatatacatggcgctttccggggcgttctccagctggcgcacgacatccgcggcgtcagcatggaaaatatcgccagaattcaggaataatgcgaagcgcccttctgccatcgcaatgcctttattcatggcatcgtagatgcctttatctttttcgctgatataacgtaagttgtactgtccgttgaggttttccaggaattctgcggtgccgtcctgggagccgccgtccaccacgatccattcgaaggtgatgtcctgtgcctgtgccagatgcgccagggacgcataagttttcgccacgccgtcataattccgaaacgcgaccgtaatgacacttagaagcatgtgaaccacctcatcttgaatgcgtaatattcagcgctttgcgcaaaataaaagggcagacgattaaaaaagcatattcgggactaaaaatcgaaccggtaaaaaacaatgacaccggggtaaaaagaaagagttgaacgcgataattctgattattaccaaacgcgttgatcatcatttttaccactttcgacatgtaccatatcgtcagtaacactgcgaaccatgagaaataaatgattagcagatacaacccattgtctattgtttttccgacgtccgcaccgttaaagattccgaatgatgcaacatattcgtaaagtgaaccgaagcgcaccacgccgtcgatattggttaatgaataacccaccatcgccagcggcccgatgatacggtaataagaagacgatccttccgtacctaaatcacccaggcgttccgaaatataaggaaaagcgaataccacaccgacgagaaagactgcgagcgaaattatcgctaaaggcagctttttcttaatcgcctctttattcagatactggaatgcccattccagcaggtaaaaaaggataaatgtcattactccagagaaggaaccggagaggactatccctgccagaatcatagcatcggtcttgggcgttttgataccaaactgtttgatgctgagccaaattgagattaatgccagagcaaaaaatgcgggttcgaaatacatggcagtggttcgcttaccaccaaacttaatgaaattcagaacatagctgttactgtaaatcagatatttcgaaatattctccatcaggctactgccgccggtaagaataatctgcgccatttcggcggcggcgagtattaccacaaaacccaccaccagccagaagaaacgtaaaatcttgcgatagttgtgcggcgaaatggttttaaaacgaatactccataccatgccgatgatgatcaccaggtagacaaacagcagcgtcgaggtgacatactttccggcattcagcgactgaccgaagatgtagttaaagatcgtcaggcccgcgccgatgcccagcgctatcatcagctttttcacgctgatcttatcgacgtacagcagcagcagtaccggcaaaaaggtcactatggttatcgggaagctctcacctatctgggcgatcttcacgttcaccagcagatagatgagcggcagcagcagataactacagactctgatagaacgagacatactcctccagcatctgttcgccactgtaggcctggcggctgcgggcgcggaacgcgtccagcgtggtgccaaacaccgcccgggcaatctccgctttcggacgctgcaccagggaaaccacctccgattcggcaaaagttttgccgccggatttatgcagcacttcctgcgccgcgtcgctatgtgtcgcaattaccggtacgccgatagacaatgcttcgcagaggatcagcggatagttatccacccgcgaactgaacaccagcgcgtccatttgattcagctcgctcatcagctggcgcttatcggtcataaacccatggttcactacgttcgcgccctcaaaaggcgaaaacttgccgaaggtgtgcagctcgattttgtcgccgagcgccatcatatcgcgcaccagccgctgattggttttgccgtcgtagcgtaagtcgtgcgccacaatggcgattttcggtacgcctgcggtttcgctcaccggggtcagttccgcaaggatcgcttcggtcgccacatcaataccattgttgataatgcggcagcgcccttgtccataaatactgttaaaggcatcggcgacgtgctggcttggggagataaaggtacagcccagtgccagcatggctttaaacagctggcgtttgccttccaccagctgatgcgcgcggtcgattttcaccggcggatagttgctcagcgtcgggcatttctggcagttggttttccagccttcgcagccgtcggtaaaggcgcagcgaccggttacgctccagtgatcgtgcagcgtccagacaaaggtgacgtccggcttgtgggctttcactttctggcagaaggccaccagatcgttaagcttcagccagtagctgtgcatgacatgaaagtgcagcaccaccgggcccggcgtacgggtgacggtgcggtacaaattattcaggttgccaaaaacatcgcggttaaacagacgaaacagcgccagattggccatcgacgtcagacgcggcgtctgtttgatcacctgcggatagtggtcgtggctgacgctttttttgccgcccttgccatagccgtacacaaaacgggaaggcagtcctttttgcagcgcgcgctggtgtaaatccagcgccacgcccgctgcgccgccctcggcgagacgcacattaaattgcagaatgttcatttaattaccttcacgcgcgctttctcacccaccaccagcgcgttatccggcacgctgtccagcaccacgctgcccgcgccgatggtcacgttattgccgatagtaatatcgccgatcatcaccacgttggcgcccagttccacgccattgccaatcaccgggcaggccaggctgtccgcgccgcggttgccgatggtgacgccgtgacggatagtgaaatcatcacccgccacgacgtttttattgatcaccaccgcatagccatgatgaatagtgaaacgtcgcccgatggtggctgccgcctgaatttcgtaaccgaacaggcattcggtaataaagcggtacagcaccagcaccggggcggcccagatattgttaagcacatgttttttacgccacaccgagcaaaaatgcgcgatgcggtaggccattaccatgcagcacggacgcaggctccagtggttggcacgaaaatcttccagtcgcattatttcccccgcagcccgtcagcaaggcgtttgccgttacgcacggaaagcagcgttaacaacgtgcgccagttcatgcgcttgttgcggatctggtagagcgtgaacagctgatactttttgctggcccggtcaaacttgtctttgtgcttgcggtagaaatgaaaataccctgagaactttttcggcgatgcagtgatctgcatctcgccgtgattcacgtgcaggatctgcgtggcttcttccactttccacggctcgccatactccaccaccatgcgcaggaaaatgtcgtaatcctgagcggctttcagttcggtatcgaacaggcactctttgaaacgccaggcaaaggtaaacacctgattgccgatgatattgcgtttgtagaacagcgtgcgggagtacggggatttcgggtacagcggcaggctggcaggctgggcatagacttcgccttcgcagatataatcgttggcatataaaaatgcgtgcgtcaccagctgctgtttatgggccaggaagaccgacaggcggttcggcgtccattcgtcatcatcgtcaatgccggtaataaattcgccgctggcctgtaaaatggcctgattacgtaccgcgcaggcaccggtattgatctcgttgtgggtatagcgcacgcgcggatcgttaagtccctcgacaaactgctgcagctgctcataagacgaagagcagtcatccacaatgatcatctcccagttgctgtagtcctggcgcaggaccgacttaatcgcccggatcgccagctgttgcctgttccaggttggcatgtaaattgagatcagcggattatctgttgtcattcttatttccccggatagtaccgactcatttgccggatggcggtgcgggcaccttatccggcctacatggaagcaggtcggataagcgcagcgccatcaggcacctttcggtgatttattttgaatcagacttgtactcgtactcgtagtagccgtagtcctgatagcctgtcgcgcggcggaagatggagttgaggatcacccctttcacctcgataccgttctgttgcagacggttcaggctggtttccacctctttaagcgtgttcaccgcgtaacgcgccaccatcagcgtggtgcccgcatggcggcccacgatggcggcgtcggtgaccgcgaggattggcggcgtatcgatcagcaccaggtcatagttcttgctcgcccaggccagcagctgggtgaagcgttcgctcatcagtagttctgacgggttcggcggcacctgcccacgcggcaccaggtcaaagttcggcaccgaggtcggtttggcgcaggcggcaatgtcgccagtgctggagagcacattcgacagaccgttcacgttgtccgtgccgagcagttcgtgggcgtaacctttacgcatatcacagtcaatcagcagcacgcgcttgttggtctggctgaccaccgccgcaaggttggcgcagacaaaggttttaccgatggacggactgaccccggtcatcatcagcacattattgttggcctgcatcatggcgaagtgcagactggtacgcagactacgaatagcttcgatagcgagatcggtcgggttacccaccgccagcagctggctctgcttgtaacgcttagcccctttgacggttttgacgtggtcgcgggatttctgccattcggacagcggaatgctggcgtagacgttgatgccatgctcttccagcacctgcgggctttcgataccgcgattaaacagcgagcgcagcagcacgccgacaatcgacagcatcaggccgaggataatgctgcccagaatgatcagcgctttcttcggtttcagcacgccaggctgggtgatcgccgggtcaacgatacgcacatcgccgacggtactggcttcggtgatcttcagctcctgctgtttgttgagcagcgccatgtacacctgctggccggattccacatcgcgggtcagacgcacaatttcctgctgggttttcggcatcgcggtaacgcggccgttcagcttggctttttcatcttccagcgctttacgtttttccagcagcgtgcggtaggccgggtgcgctttggtataaagcttggaaatttccgcttctttaaaggtcagctcgttcagctgggcgtcgatattgaccatcgaatccagcaccgctttcgcttccagcggtaaatccacggagtctttatcctggcggaaggcgttcagtttgttttccgcttcatccagattacggcgcacttccggcagctgtttggcgaggaaggcgaggcttttggccgcttcttccgatttacgcgccacgttctgctcaagatagttgcgggtaatgctgttgaggatggcacggatctgctcgcgatcttcaccggtaaaggacaggctcagcacgccggtgtctttaccgttttcggtgacggtcaggttgttttgcagattgttgatcatgccgagggtggaaaacttagtaatggtgaactcgctgtcggtagaggagtggatctcgctcacctcaagcgtgacgccatctttttccagcagcttacccacttcacctctggcgctgaaacccgcgtcgctggtcaactggtactgcgtcgggctgagcacgcgcagcgtgaaaacctgctcccctgcccctttcggaatagtaaaggtcgtcaccttcaccgtttcgttctggcgacccatcagccgttcccagccagccccgatgatcggcatggtgtttttggtgacggcaatatctaaatcgagatcgtcaacggtttttcccagcaccagacgggatttgatcagctgaatttccgcgtcagacgcagggggcttgttcgacagcgcgctgttaatgttctgtaccagcgagttgccggtatcctgctcgatctggaccagcgcatcggcgctgtagatcggcgtggcgaacagggtatagatcaccgccgccaccgcaaaggctgcggtaaccccgagcacccaccagcgggcttcaatcaccgtcccaataaggcggccgatgtcgatttcatcgctgcctgtctgggaggcggcagaatgctgtagtttttctgtcattgttatccctgctgaacgttcaatgcctgcgcccactggcgggcagacctttcgagtaaggtgtaaacggcctcaaaagcttcacggcttttacggtatggatcgggaatttcccgctcattatcccagtgaccaaacagcatcactttgccgcgcatttccggtgcgatttcacacagcgaggcaatgtgacgcttttccatcaccaggatcagatcgtattcgcggcacatgcgcgcggtgatctggcgggcgctgtggcccgcaagcgagatgtcatgctgttccgccacgctggttgccgtggcgtcagcccctttccccaccagcgcgcccaatcctgccgattcaacggtcagggcgggattaaacgctttcagcaaccgttccgccgtcggggagcggcagatattgcctacgcaaaccacgagaattttattaaacatcgcttattcccagttccgtaagtcgctggccgtgtcggtcatgtagcgaacgccactgatggtcggcaacagctggttgatcagacggttccagcgggcaaccggtgcggttgtaacgtagaccacgtcgtacggctggaggcggaattccgtcgccattaccagagaggtggcgtcagacatatcaagctggtaaatgttggcgatcttgccgccgcgtccaccctcgcctttcagcggacggatcacgaagataccgctggcgttggaggtgttcagatccagaccttctgcctgaccaagcgcttcggtcagcgtcatgccgctgaagtccattttgagcgtgctctgttttttcacttcgcccatcacgaacactttcagatcgtcattgcgcggcacaaagagaatgtcgcccggataaagcaggcggttctggctcaaatcgccgttttgcatcagcgcctgcaaagagatgcgttgttcgcggccttcgtgggtcaacacgacgttgcgccagtcggcgttatcggtcagcccgccggcggcgttaatggcgtccagcaccgtcagcggcacgttagtgatcgcctgctgaccggatttattcacctgcccggagatataggctttttgcgagcggaagccagcgatattaacgtccacctgcgggtcagcaatgtactgcgctaaacggctggtaatatcactacggatttctgccagggttttgcccaccacgtggactttaccgatatagggatagaacatggtgccgtccggctgtacccagttaccggcttcgctggaactacgatactggcctgctggcgtcgtcagttccgggtgatcccagacggtcacgttcaggacatcgccaggaccgacacggtactgataactggcgatttcctgatccagcgacatattgggttgggcgacatttggacggggacgtaactgctcgaccagtcggggggtcaaaggataaacattcaccatgcggtcaagatcgaagtcagcatcttgctgcttaatgacatcctttcccatggttgacatattgctgccgggaaaaaccgtgcaaccactcatcaaggtcacagacaccaataatggcatcaatttcattttggatttcatcattgattatttatcactttggcagagtaattatcctgtgcggtataaataagcgcgtagcctgttcacattcagcatgcagttaattgccgctaaatataactggcatcagtcctaaaaatcgcttattcaaacgcggtttgttgacagaataatcggagctgattcacacgcttccgggcacgctaccgcccctggcttccagttaccaattcactgataaaacagtaagttattgattacagcctgactctttacattatttacaggaaataatgtaaacctcggcagtggctgtcagaaaaagaagaacataacccatcatgacgttagaaatatgacatacaaaagaacgccatgatgcgctggaggaattgttgcagctaacggaataccaggcaaggtaacttgtccggggtaaggtctttttaagattaatattaacctcaaaaatatcggcttttaggagtttcttcatattgacaaaatttatatatagatttacgcgtacgataattcctaatttacagtataaaaaagcccataatatataagcgcattacagtcatgaggagcgcgaaatatcacttaaacctatggtgcgattattcggataaatcgcagaggaatattgcattttgggcgcaatgtacccatgatcaaaacgtgacaatcgtcatattacacaaggtacgacatttactatggaatggattgccgatccctctatctgggcgggactgtttaccctgatcgttatcgagctggtgctcggcattgataacctggtctttattgccatactcgcggaaaaacttccgcctgcgcagcgcgaccgcgcgcgcgtcacgggcctcatcctggcgatgctgatgcgtctggttctgctggcctcaatttcctggctggtgaccctcaccaccccgctgttcagcgtgcgcagcctgagcttcagcgcccgcgatctgatcatgctgtttggcggtttcttcctgctgtttaaagccacggtggaactgaacgagcggctggaggggaaagacagcgataacccgacgcagcggcgcggggcaaaattctgggcggtggtgacgcaaatcgttattcttgacgccgtcttctcgctggattccgtgatcaccgccgtcggtatggtggagcatctggcggtaatgatggcggcggtgatcatcgccatttccctgatgctgctggcgagcaaagccctgacccgctttgtgaataatcacccgactatcgtcatcctctgcctcagcttcctgctgatgataggctttagcctcatcgccgaaggctttggctaccacatcccgaaagggtatctgtatgccgccatcggcttctcggtgatgatcgaagcgcttaatcagctggcgattttcaaccgccgccgcttcctgttcgctgacaataccctgcgtcagcgcaccaccgaggcggtgatgcgcctgctcagcggccgcaaagaagatgccgagctggatgttgaaaccgcctccatgctggccgaccatgataatgcgcagatctttaaaccgcaggagcggctgatgatcgagcgtgtgctcaacctgaaccagcgcaccgtcagcagtatcatgacctcccgccatgacatcgaacatatcgatctcaccgcgccggaagaggtgatccgcgagctgctggacaagaaccagcatacccgcgtggtggtcaccggcggcgatgcgcaggaagatctgctgggcgtggtgcatatacttgatctgctgcaacaggcgctgcgcggtgagccgctgaacctgaacgtgctggtgcgtcagccgctggtgttcccggaagggttgccgctgttacaggcgctggagcagttccgcaacgcccgcacgcactttgcctttgtggtggatgaatttggttccgtggaaggggcggtcacgctcagcgacgtgatggaaaccatcgccggtaatctgccgaacgaagtggaagagatcgacgcccgccacgatattcagaaaaacgccgacggcagctggacggcgaacggccatatgccgctggaagatctggtgcagtttgtgccgctgccgctggacgagaagcgcgaatatcacactatcgccgggctgctgatggagtatctgcaacgtattccgcaggtcggggaggaagttgaggtgggcgattatcgggtgatcactttgcaggtggaaagccatcgcgtacagaaagtgcagatcgtgccgttacgcacaaaaagcgagctggattacgaagtctgatcccgtttctgccctctccctgccggagagggctaatcactgggccgttacatcttttccagcagcttcttcacatcttcgctgtatttactgtccttattgcgatccgcccacttgttaaggcggcgcttcgcctcgccctgtaaatggtcgcgcagcacctgatcgactttcaggctgtattgcagcgcatcccatttgccgtatacccgcagcgggatcggcgtctcgcgcaggaaggcgatcagctcgctgttgccaccgttccagccggagagtacgcgcacgttaaactgggtgtcgctctcttctttgatcagatccagggttcccttgccgtccagcgccagcagcggcgactgcccctgcatatcgctcagcgttacgctgccgtgatccagttccagatcggtgctcagcgcatccagacgggtgctgttgtcataatcctgctccaccttcacatcgctgctgcgcgccacggcctgctggatcagctgctggaagttaagcccttccatgcgtacattcgccatttccagatgcgcgttgccctgccagtcgcggcggaacgcctccgcatccaccagaccaccggaaaaatcaccgctcatggagagcgcgccggtcagggcaataggataattaaaggctttcaggatggtgccgatctccacgttctcaagctttggctggaacaggcttttcggcgttctgccccgcacgtcgagacggccgggcagcgaaagcgtaccgttgcccattttgccctctaaggtggtgagggttaacagtcccgcctggttggtcatttggcttttgacgtcggtgaaatccatcccgcgccagcggatctgcccggcgctgagcgcaacctgagcgctgaacccgcgcagactgttgtactccggctcgctgctgtcgcgggcgatcaccggacgcggcaacagcttaggctgcgcctgggctttctgcgccgtatcgctgctggcggcggccatagtcgcgccgctgaataagttttccagattaagcttgtcaaaatgcaaatcgagcgcccagtccggggcgtcgttaagcaccacgctgccctgcccgctcatggcgctgtcgttggcagtgacattaaggttgctgaaagacaggcgtttttgcgcctcctgccactgggcgtttagcgtcgccgtaccgctgatcccctgcggggacacatcaccgcccttcagctgccagtcgaactgctcaatggcggcggtcaggctgtgcgggtaatccgcggcgtcaatttttgctttcatcgccagcgtcagatcgcgctgatcgcggttgatacgcccggaaaaatcgagcgtggcgtggtaagacgcatcctgatccatcttcagacggatatcgcgcaccgttacctgctcttcgtcttcatgctggaacaccagcacgctgtcggcgacctcaaggcgggaaatggcgtaggaccagcctttatcggcttctgcctgcggcattggattatcatccggcgcaacaggctcgtctggtttgcgcgcggctttggtttgcggcgttaactggatcaccgcccctttcagcatcacctgtttaacgtgcagctgatgcgaaagcagcggccagagttccacgtcaaggcgcatattcgccgccgacaccagcggcgtggtggcccccggcgcggtcaacgacatgcgcccggagagaatgctgagctgcggccagacatgccagcgcagcggctcgtccagctccagctgatagccgcttcgcgcctccacctgttgcaccatataggcacggaaatcgttggggttgaccagcagtaccaacgcagagatgccggcaacaagcacgacaagcagaatcatcagcgtggttaacactcttctcatggcatcctcagcgagcggttaatactcaatctttatcaatacggctggcgaccgcgccctgctggtcacgatatttcgcgtcctggcgacggttgtaaggacgggctgccgggccggagagcggttcaaagctcagcgcgccgataagcatccccggacgcagcgccagcggcagtttgccagaattatagaactccagcacgatacagcctgaccagccgggatcgatacggtgcgcggtaacgtgcaccatcaggcccagacgcgccagcgatgagcgaccgtccagccagcccaccagatcggcaggcagggtcacggattcataggtgaccgccagcgccagttcgcccggatgcaggaaaaaggcatcgccgtccggcagaacgatttcatcgctcatcacgcgctcaagagaggcggcgacttcatccttcggaccgctgagatcgataaaggccgcagtatgaccgcggaaggtgcggaatttattccccagacggacatcgacggtggcaccattgatgcgttcaacgggtggacgcggggtaatagacagacggccttcatccagccaggcttcaatatctcggtcacacaaacgcatgcgttttctccttagatacagcatcccccggcaagtgttctcgccggaggttaagcatactactttgaacggtacacaattcgcgcagattattcaaaagcagactattcaaagaactggctgattttggctttcagaatgtcgatcgcaattcggtttttgccgccgcgcggcacaatgatatcggcgtactgtttggacggctcgataaactgcaggaacatcgggcgcaccgttttctggtactgcgccatcacggaatccatagagcggccgcgctcgttcacgtcacgcttaatacggcgcatcaggcagatgtccagcggggtatcaacgaaaatagagaaattcagcgcgtcgcgcagacgggcgtcggtcagcaacaggatgccttcaaggataatgactttcttcggctgaatatgaatggtttcctgcgtgcgggtatgttctacataactgtagaccggcaattcaatggggctgccgttttttaaggtttgcaggtgctcgaacagcaagctgtgatccatcgcgctcggatggtcataattggtctttacccgttcttccatggacagatgactttgatctttgtaatagctgtcttccgggatgacgccaatatgctcatcaccaacctgttcgcgcagctcgcgatagagggtgctggcgatgagacttttacctgaagcggatgcaccggcaatgccgataatgacgcactgatgagacttatcagtcataaatttttgcgacctggttaacctggatgttaaggaaggacgacgccgaaacgccaaacgcggcaattatagggatttcgccgccgtgataccagttgaataggtcatcgcgcaaatccggcggtcataaagaggaatatcgcctttacgcaaattaaaatgctcacttttgcggcgatgatcggggatttagcatcaggtaagtaattaataacactgtgatgtcaaattatgagcgcccacgataggaattgtaaattgtttgtactagcataatccaaatttcaaatttaactcgccccgtgaatgtatcgggcggctcagggtctgcggataaagcggtaatgaataaacaataccagcgcgttttggtggctaccccgaatcctttactgcgattaatcagtttaggactggtcacctttatctttaccctgttctcccttgagttagcccgcttcggcaacattcttgctccgctgtggttctccacgtccattatgatggtggcgttttatcgtcatgcaggccgcctgtggccggcgattgcgctggcctgttcgctgggcagcattggcgcgtcactggtgttattcccgcccgaggccatcaatctctggtaccccggtattaacgttattgaagcgctgatcggggccatactgctgcgtaaaatgctgccctggtacaacccgctgcaaaacttaaacgactggatccgtctgactatcggcagcgccgtgataccgccggtgattggcggcctgctggtgtctctgctggtcgggaacgacaacccgctgcgcgcctttacgctctggacgctctcggaatccattggcgcgatggcgctgatcccgctgggtctgctgttcaaaatgcattatctgctgcgccaccgtaagccgcagttgctgctggaaacgctgctgacgctggcggttacgctgatgctgagttggctgtcgataaaatatctgccgtggccctttaccgcggtgatcgtgctgctgatgtggagcgcggtacgcctgccgcggcttgaagcctttctgatatttctctccaccgtgatgatggtgtcgctgatgatggcagcggatccctttgcactgacgccgcacaatacgcccgtcatgctcaacgcgccctggctgccctttatgatgatgctgctgccggccaacgtcatgaccatggtgatgtatgcttttcgcacagaacgcaaacacatcaccgagagtgaagcgcgctttcgtaacgccatggaatattccgccatcggcatggcgctggtgggcaccgaaggcgaatggcttcaagctaacaaagcgctgtgtaaattccttggctatacccaggaagagctgcgcgccctcacttttcaacagctgacctggccggaagatctcaacagcgatcttgaacagctggagatgctggtgcgcggcgagatcaacagctattccatggaaaagcgttactacacgcgcaatggcgacgttgtctgggcgctgctggcggtatcgctggtgcggcacggtgacggcaccccgctctatttcatctcgcaaatcgaagacatcaacgatctcaaacagacggaatgggttaacaaacgcctgatggagcgtattaccctcgccaacgaagcggggggcatcggcatctgggagtgggaactggcgacggacatcatcagctgggacaaacggatgtttgagctgtatgagatcccgccgcacgttaaaccgacctggcagctgtggtatgactgcgtgataccggaagaccgcgcgatgaccgagcaggtggtgcgcgattcgctggtgtcgcgcctgccgtttaagctggaattccgcgtgcacgtgaaagagggcgtgcgtcatatccgaaccctcgccaaccgggtgctgaacaaaaatggcgaagtggaacgcctgctcggcatcaatatggacatgaccgaggtgaagcagcttaacgaggcgctgttccaggagaaagagcgtctgcatattacgctggactccatcggcgaagcggtgctctgtaccgatgtgaatatgaacatcacctttatgaacccggtggcggaaaaaatgagcggctggccgcaggagcaggcgatgggccaggcgctgctcaatgtcctgcacattaccttcggcgataacggcccgctgatggaaaacattcacagcggcgatatgtcccgctccgccattgaacaggatgtcgtgctgcactgtcgcaacggcggcagctacgatattcactacagcgtgacgccgctcagcaccctggacgggcaaaacatcggctttgtgctggttattcaggacgtgaccgaatcgcgcaaaatgttgcgccagctcagctacagcgcctcccacgacgccctcacccatctggccaaccgcgtcagctttgaaaatcatcttaaacgcctgttgcagggcgtgcaggaaacccaacagcggcatgcgctggtgtatatcgatctcgatcgctttaaagcggtgaacgactccgccgggcatgcggcgggggatgcgctgctgcgggaaatttcatcgctgatgctcagcatgctgcgcaccaccgatattctggcgcggctgggcggcgatgagtttggcctgctgctgccggactgcaatatcgaaagcgcccgctatatttcggggcggttgattgccgcgatcaacgattaccagtttatgtgggaaggccgtctgcaccgcatcggggccagcgcgggcattacgcttattgacgaaaccaactatctggcgtcagaagtgatgtcgcaggcggatatcgcctgttatgcctcgaaaaacggcggacgcggcatggtcaccgtctatgagccggagcaggacgacatgcatgaaattcgtctgcagatgtccgcggaagagcagtcgcggatgatcaatgacaatccgctgctgctgattgcccgcggcgtggcctcgcctcgtgtaccggaaacctgcaatttctggctgctgtcgctgcgcctgtggaccagcaacggcgacatcatggaagagcacgcttttcgcgcctccctgagcgatcgcaaacttattcgcgcccttgaccgccgcgtgttccaggaatttttccgcaacagcgccgcagccgtcacccgtaaaggcttaggggttgccctgccgctctccaccaccggtcttgccagcaaaaccctggtcagcgaactgctggacagcctggcgcagagccagatgcctgcccgcctgctgcatctggtgatccatgcggatgcgctgatgcgcgacgacgccagcatcaacgacgggttgcacaaactgcgcgaagcgggctgccaggtgatcttaagccacgtgggccgtgacctggagctgttcagccatctcaccccgtacgttgcggattacattctgctcgaccaggaattgatcggtaacgtacacggcaacctgatggatgaaatgatggtcactattgtgcagggccacgcccagcgtctgggcatgaaaagcatcgccgggccaacgcaccagccgatggtgatggacaccctctccggcatcggcatcgattacatctacggcgataccatctctccgccgcagccgctggatttgatgctaaacaccagctatttcgccatcaactgacggctgccagccgtcggtataccagatatgcagcagcgcgtaagagcgccacggctgccagcgggcggcgtagtgacggatttgcgcgggcgtcatgccgctaaaacgctgcttgatcagataatcgtccgccagaaagacatcttttgcctgccagccgcgcagggccagataattggccgtccagcgcccgatgcccggaaaggtctgtaaatgcttcaccccctgttccacatccgccggggcgatgaggggaaagcgcccgtcaagggttgcccgggcaaaatgcacaatggcctccccgcgttttaacggcatgcccagcgtttttaactctgccggatcggcattcaccagcacttccgggcgcggaaaacagacaaaacctggttcgccgttcagcggctcgccgtaacggtttgcgacatagccggtgagctttgccgccatcgccacgctcaccagctggcctaaaatcgcgcggatcccctgctcgaaggcatccatcgatcccggcagccgcagccccggacgcgccgcgcccaaatcgcccagcgcgccattaatcatctgcggatcgcaggccagatcgaacagccgcccgacgcgcgccagacattcatccgccaccggcagcaggccatcgctgagcgtcacccgcagggtatgttcctgctcatccggttcggcggtgataagtccatggtgcccgccgagcgccaggctacgcacatagcgcccctcgctgacgacttccaccccgcttacggcacgggcgcgaagaaagcccagcatccacgcccagtcataaggcggttgccagtgaagtgtgtacatagcctctcctgctgtaattaactttcttataacagactaaccgcccccggcactttttgctttgctttcaaatcccattccgctaaagtcgccccccttctgcaccggcccggggaattcaacatgtttattggttttgactatggcaccgccaactgctctgtggcagtaatgcgtgacggctcgccgcagctgttaaaaatggaaaacaatagctcgctgctgccctccatgctgtgcgccccgacgcgcgaagcggtcagcgaatggctgcaccgtcatcatgccgttccggcgacagagggagaaacccaggcgttgctgcgccgggcgatgaattacaaccgcgacgaagatatcgaggtgctgccgggcagcgtgcagttcggcctcagttccctgcatcagtatgtgcaggatccggaggaggtctattttgttaaatcgcccaaatccttcctcggcgccagcggcctgaagccgcagcagatcgcgctgtttgaagatctggtgtgcgccatgatgctgcacatccgtctccaggcgcagacgcagctgccggagccgattgaccaggcggtgattggccgtccgatcaacttccagggtctcggcggggatgaggctaacgcccaggcgcaggggatacttgcgcgcgcggcaaaacgcgccggattccgcgatgtggtgttccagtatgagccggtagcagcgggtctggactttgaagcgacgctcagcggcgaaaaacgcgtgctggtggtggatattggcggcggtaccaccgactgctcgctgctgctgatggggccgcagtggcatcaccgcagcgaccgcgactccagtctcctcgggcacagcggctgccgcgtcggcggtaacgatctggacatcgcgctggcgtttaaaaacctgatgccgctgctcggcatgggcggccagaccgaaaaaggcattgcgctgccgatcctgccgtggtggaacgctgtggcaattaacgatgttccggcacaaagcgatttctacagcaccgccaatggtcgcctgttaaacgatctggtgcgcgatgcccgcgatggcgataaagtggcgctgctgaccaaagtctggcgtcagcgcctgagctaccggctggtacgcagtgccgaagagagcaaaatcgcgctttcggagacagatgaggtcacggcgcgtctgccgtttatcagcgacgatctggcgaccgccattacccgcgacggcctggaagcggcactcagccagccgctggcgcgtattctggaacaggtgcagctggcgctggacagcagcaatgaaacgccggatgtaatttacctcaccggcggcagcgcccgttcgccgctcatcaaacgcgcgctggcggaaaaactgccgggcattccgattgccggcggcgatgatttcggctcggttaccgccggactggcgcgctgggcgcaggtacagtttggatcaacaaggaaataacgctatgccacggtttcatctgatcgtcatgccattaattattgcgctgggcctgtgcggttttgcccgcgccgacacgctttctgccgtcaaacaggcggaaaccacgctcgcggcgcgtgtgggctatgcggagctggatctggcttccggtaaggtgctgaacagctatcgtcaggatgagcgttttccgatgatgagcacctttaaggtgctgctgtgcggcgcggtgctggcgcgcgttgacgccgggcaggagcagcttaatcgccgcctgacctggcagaaagcggatctcatcacttactcgccggtaacggaaaagcacctggcggacggcatgacggtggcggagctgtgcgatgccgccatcaccctgagcgataacacggcggccaatctgctgctctccacgctgggcggcccgcaaaagctgacagatttcatccgcaaaaccggcgatgggacgacgcgtcttgatcgcgtggagccggaactgaacgaagccctgccgggggacgtgcgtgataccaccaccccgacggcgatggcgaaaaccctgcgtcagctgttaacgggcgataccctgacggcggcttcacggcagcagttagcgcgctggatggaagaggataaggtcgccgggccgctgctgcgctcggtcctgcctgcgggctggtatatcgccgataaaaccggggccggtgagcggggatcgcgtggcattgttgcagccctggggccggacggcacgccgtcgcgcattgtggtgatttatgtgacgggcagcaaggccaccatggatgaacgtaataaagccatcgcggcgattggcgaggcggtgattaagcagtggtgatatgcccattgcccggcggcgctacgcttgccgggcctggaacggcaaattacccaggccgggtaagcgacagcgccacccggcacaaacccactcaggatccaatcactccgccgtccgctttggtgatcaccaccgttgacgagcgcgggcgcccatccggccggttatccggccagttcgacaccgcgcgcggattcgccggatcggtaacatcatctccgccttctcccggatgctgaatattaataaacagcgtgcggttgtccggcgtaaaagcgatgccggtgatctcacagccgcgcggcccggtcaggaaacggcgataatcattggtgccgggaatggtcgccagcatctggttattgcccatcccctcgtaagctttctggttgatggtgctggaggagacgtccgtctggatccacagcacgccctgatggtcgaatgacaggccgtccgggctgccgaaggccgcgccctgcatattgcctttcgcgtccggcttatcgccatcgttacgcccggcgagcaccagaatatcccatttaaagcgcgccgctgccggatcggcgttatcttcgctccagtgcataatatgtccatacacgttattggcgcgcgggttcgccgcatccaccggcgctttgccctctttgccgcgatcgctgttattggtgagcgtgcaataaacgctgccggcagcgtgaggatcgacggcgatccactccgggcgatccattttcgtcgcgcccaccgcgtccgccgccagacgggttttgatcagcacatcgccctggctttcaaagcccttgctttgatccagcccgttctgtccgaagaccagcggcagccagtcgccggtgccatcttcattaaagcgcgcgacatagagcgtgcctgactccagcaattgcatgctggcgtcacggttgcccgcatcatattttttatccgagacaaatttatagatgtactcgaacttctgatcgtcgcccatatagaccacgacgcgtttgtccgccgccagcgtcaccgctgcgccttcgtgcttgaagcgccccagcgcggtgtgtttgcgcggcgtggaggtcggattgtacgggtcgatttcaaccacccagccaaagcggttcggttcgtttggggttttatcgacgttaaagcgttcgtccacttcgctccagcggtaggactcgtcgctgtcggcgatgccataacgtttttccagcgcgttgcggtcggcttgtttaacaaaaatatctgaccagttttcttcacaggtgagataggtgccccagggcgtatggccgttggcgcagttctgcatggtgccgagcacgcgctcgccctgcggatcggcggcggttttcatcagcatgtgatgacgcgccgggccggacagctccatcggcgtattaacggtgatacggcgggcatagtttgacgggcgcaccacctgccagtcgctgccgctctttttcacctcgatcaccgacacgcccatggcgttctgccctttacggactttatcggcgttccagtctgcggtgccgtctttaaacagcatgccgttatcgatgtattcgtggttcatcgccagcaggccgtgggcggcattatcttcaccgcgcggcaggctgaaccaggccatgccgtcatggtgcatacccgcctgcgccgcctgttcttcagtggtgttgctggcgtcgaatttgaattccggcatcatgcctttgatgccggtggcgtcgccccagcgatagaatggacgtgcgatgtagccttccggcaccgttacggtgtccgcagtggaaacaggaatgctggtaaagcccagcgacaccgctttcgccagcgccgtcggctgcgtcatggccgcaaaagcgctttccgcgcgcatcagcgccgggaaagacaccgccgcgcccgcgaccgcccccatctgcaaaaagcgacggcgtgacagaaagacgtccttgacgtccgaaaataccgggttggcgctggtgttgctgatctcttcactgtgttcttgtttgaagacggattttaatggcctgctcataatgacttcctgttaccagaggacgggaaaataacaatgctgagcagtctataaactatttattacatttttataacagtcgcaggcagagcgtccgccccttgtcattcggacaaatccacacagtgtttcatatttcctccatttttctgcggcctggcattactaaactagtatcattctgcttaatgtttcaggaagagatacgaataacgatgaaaggccgtaataatacccgctggatgcttctcgcaggactggtcatcgccgcccttgccgctgcctggtactggcacgctcattctgccgcccccgccggacagcagcgccaggccggagccggacgtcacggcgcgggcatgcgcggcccttcacttgcgccggtacaggcggccaccgccacccgcgaggccgtgccccgttatctgagcggtcttggcaccattacggccgcgaataccgttaccgtgcgcagccgtgtcgacggtcaattgctggcagtgcatttccaggaaggccagcaggtgaaaaaaggcgatctgctcgccgaaatcgatcccagccagtttaaggtcgcccttgcccaggcccaggggcaactggcccgcgataaagcgacgctggcaaacgcccgccgcgatctggcccgctatcagcagctggtgaaaactaatctggtgtcccgtcaggagctggatgcccagcaggcgctggtcagcgaaagcgaaggcaccatcaaggccgatgaagccgccgtcgccagcgcgcagttacagctggactggagccgcatcaccgcgccgatagacggtcgcgttggcttaaaacaggtggatgtcggcaaccagatttccagcggtgataccaccggtattgtggtgatcacccagacgcaccccatcgatctgatcttcaccctgccggaaaacgacatcgccactattgtgaaagcgcgcaacgccgggcagacgctgagcgtcgaagcctgggaccgcaccaacaagcagaagctgagcaccggcaccctgttgagtctggataaccagatcgacgccaccaccggcaccatcaaacttaaagcccgctttgagaatcaggacgacgccctgttccccaaccagttcgtcaatgcgcgcatgctggtggataccgaacaggacgcggtggtgatcccggctgccgccctgcaaatgggtaacgagggcaatttcgtctgggtgctgaacgatcagaacaccgtcagcaaacacaccgtcacgccgggcattcaggacagccagaaagtggtgatcgccgccgggctttccgccggggatcgcgtggtcaccgacggtatcgaccgtctgaccgaaggggcgaaagtggaagtggtggacgcgcacgacgccagcgccgcaccggcaaaaagcaccgctaaaggagcgaaatcctgatgcaggtgttaccgcccagccgcaccggcggcccgtcccgtctgtttattttacgtccggtcgccaccacgctgttgatggtggcgattttactcgccgggatcatcggctatcggtttcttcccgtttccgccctgccggaggtggattacccgaccattcaggtcgtcaccctctaccccggcgccagtccggatgtgatgacctctgcggtgaccgcgccccttgagcgccagttcgggcagatgtccggcttaaaacagatgtcgtcgcaaagctccggcggcgcgtcggtggtgacgttacagttccagctttcgctgccgctggacgtcgccgagcaggaggtgcaggccgcgatcaacgccgccactaacctgctgccgtcggacctgccgaacccgccggtctataacaaagtgaaccctgcggatccgccgatcatgacgctggccgtaacctccagcgccatgccgatgacgcaggtggaagacatggtggaaacccgtgtcgcgcagaaaatttcccaggtggcaggcgtcggtctggtgaccttatccggcgggcagcgtcctgcggtgcgggtaaaacttaacgcccaggccattgcttccctcggcctgaccagcgaaaccattcgcaccgccatcaccagcgctaacgttaactccgccaaaggcagcctcgacggcccgacgcgggcagtgacgctgtcagccaacgaccagatgcagtccgccgaagagtaccgtaagctgattgtcgcgtaccagaacggtgcgccgatccgcctgggtgacgtcgccaccatcgaacagggagcggaaaaccgctggctgggcgcatgggccaacaaagagcaggcgattgtcatgaacgtgcaacgccagccgggggccaatattcttgataccgccgacagcatccgtgccatgctgccgcagttaaccgccagcctgccgaaatccgttgaggtaaaagtcctttccgatcgcaccaccaatattcgcgcctcggtgtctgacacccagtttgagctgatgctggccatcgcgctggtggtgatgatcatctatctgtttttgcgtaacgtcccggcgaccattattcccggcgtcgcggtgccgctgtcattaatcggcacttttgcggtaatggtgttcctcgatttttccatcaataacctgacgctgatggcgctgaccatcgccaccggctttgtggtggatgacgccattgtggtgatcgaaaacatctcccgctatatcgaaaaaggcgaaaagccgctggcggcggcgctgaaaggcgcgggggagatcggctttaccatcatctccttaaccctgtcgctgattgcggtgctgatcccgctgctgtttatgggggacatcgtcgggcggctgttccgcgagtttgccgtcaccctggcggtggcgattctgatttccgccgtggtgtcgctgacgctgacgccgatgatgtgcgcgcgcatgttgagcgccgaatcgctgcgcaagcagaaccgcttctcccgcgcatcggagcgcttttttgaacgggtgatcgccgcttacgggcgcgggctggcgaaagtgctcaaccatccgtggctgacgctgggcgtgaccttcgccaccctgctgctgtcggtgttgctgtgggtgatgatcccgaaaggcttcttcccggtgcaggataatggcattattcagggcaccttacaggcgccgcagtcggcgtcctttgccagcatggccgaacgccagcgccaggtgagcgatattgtgttgaaggatccggcggtggaaagcctgacggcctttgtcggcgttgacggcactaacccgtcgctgaacagttcacgcctgcaaatcaaccttaaaccgctggacgatcgcgacgaccgcgtgccggaggtgatcgagcggctgcaaaacgcggtggcaaaagtgcccggcgtggcgctctacctgcaaccgacccaggatctgactatcgacaccaccgtcagccgcacgcagtatcagtttacgttgcaggcaacgtcgctggaggcgctcagcacctgggtgccgcagctgatgagcaagctgcaaacgcagccgcagctggcggatgtgagcagcgactggcaggacaaaggccttgcggcttatatcaacgtcgatcgcgacagcgccagccgcctgggcatcagcatggcggatgtggataacgccctgtataacgccttcgggcagcggctgatctccaccatctacacccaggcgaatcagtaccgcgtggtgctggagcacgacaccacccaaacgccagggctggcggcgctggacacggtacggctgacggggagcgacggcggcgtggtgccgctcagcgccattgcgaaagtggaacagcgctttaccccgctgtcgatcaaccatctcgaccagttcccgtccaccaccatctcctttaacgtgcaggacggctattcgctgggcgaagcggtgcagtcgattctggacacggaaaaaaccattagcttcccgacggatatcaccacccagttccagggcagtacgctggccttccaggatgccctcggcagtacggtgtggctgatcgtcgcagcggtggtggcgatgtacatcgtgctcggcgtgctgtacgaaagctttatccatccgatcactattctctccacgctgcccacggcaggcgttggtgcgctgatggcgctgatgctggcaggggcggaactggatgtgatcgccattatcggcatcattttgctgatcggtatcgtcaagaaaaacgccatcatgatgatcgactttgcgctggccgccgagcgcgaacagggcatgaccccacgggaggcgatctatcaggcctgcctgctgcgtttccggccgatcctgatgaccaccctcgccgccctgctcggcgcgctgccgctgatgctcagtactggcgtcggcgcggagctgcgtcgtccgctcggtatcggtatggtgggcggtctgctggtgagccaggtgctgacgctctttaccacaccggtgatttacctgctgttcgaccggctggcgctgtcgctgcgccgccgtttcccggcgcgtaatgaggaggcgtaagtgaagtttttcgccctcttcatttatcgtccggtggccaccattctgatttcgctggccatcaccctgtgcggcattctcggtttccgtatgctgccggtcgcgccgctgccgcaggtggattatccggtgatcatggtcagcgcctcgctgccgggcgcgtcgccggaaaccatggcgtcgtcggtggcgacgccgctggagcgggcgctgggccgcattgccggggtcaacgagatgacctcctccagttcgctgggcagcacgcgcatcattctggaattcaaatttgaccgcgacatcaacggcgcggcgcgggatgtgcaggcggcgatcaacgccgcgcagagtctgctgccgagcggaatgccaagccgtcccacctaccgcaaagccaacccgtccgacgcgcctatcatgatcctgacgctgacctcggacacctggtcgcaggggcagctttacgatttcgcctccacccagctggcgcagaatattgcgcagatcgaaggcgtgggggatgtcgacgtcggcggcagctcgctgcccgcggtgcgcgtcggcctcaatccgcaggcgctgtttaatcagggcgtatcgctggatgatgtgcgcagcgccatcagcgatgccaacgtacgccgtccgcagggggcagtggaagacggcacccaccgctggcagttgcagaccaacgatgagctgaaaacggcggcggaataccagccgctgatcgtccattacaacaatggcgcggcggtacggctcggcgatgtcgccagcgtcaccgactcggtggagaacgtgcgcaacgccgggatgaccaacgccaaaccggcgattttgctgatgatccgcaagctgccggaagccaatattatccagaccgtcgacagcatccgcgcgcagctgccggagatgcagaaaagcattcccgccgccattgatttacagatcgcccaggatcgctcgccgaccattcgcgcctcgctggaggaagtggaacagacgctgattatctccgtggcgctggtgatcctcgtggtgttcctgttcctgcgatccggtcgcgcaacgctgatcccggcggtggcggtgccggtatcgctgatcggtaccttcgccgccatgtatctgtgcggattcagccttaacaacctgtcgctgatggcgctgaccatcgccaccggttttgtggtggatgacgccattgtggtgctggaaaatatctcccgccatctggaagcgggcatgaagccgttgcaggcagcgcttcagggcacgcgggaagtgggctttaccgtgctctcgatgagcctgtcgctggtggcggtgttcctgccgctgctgctgatggacgggctgccgggccgtctgctgcgcgagttcgccgtgacgctgtcggtggcgatcgggatttcgctggcggtatcgctgaccctgacgccgatgatgtgcggctggttgctgaaaagcgcgaaaccgcgcagccgcccgcgcgagcggggttttggtcgcctgctggtagccatgcagcagggttatggccgttcgctgaaatgggtgctcaggcacacccggctggtgggcgcggtgctgctcggcactatcgtgctcaacgtctggctctatatctcgatcccgaaaaccttcttcccggagcaggataccggcgtgctgatgggcggcattcaggcggaccagagcatttccttccaggcaatgcgcggcaagctggaggatttcatgaagatcatccgtgacgatccggcggtggataacgtcaccggctttaccggcggttcgcgggtgaacagcggcatgatgtttatcaccctcaaatcccgcgatgagcgccatgaaagcgcccagcagatcatcgaccgtttgcgcgtgaagctggcgaaagagccgggagcgaatctgtttttgatggcggtgcaggatattcgcgtcggcggacgccagtccaacgccagctatcagtacgccctgctgtcggatgatttaagcgccctgcgcgagtgggagccgaagatccgtaaagcgctggcggcgctgccgcagctggcggacgtgaattcggatcagcaggacaacggcgcggaaatgaatctgatctacgatcgcgaaaccatgtcacgcctcggcatcagcgtgcaggccgccaacagcctgctgaataacgccttcggccagcggcaggtctccaccatttatcagccgctgaaccagtataaagtggtgatggaagtcgatccccgctacacccaggacatcagcgcgctggataaaatgtttgtgattaacaacgacggcaaagccattccgctgtcctattttgcgaaatggcagcccgccaatgcgccgctgtcggtgaaccatcagggactgtcggcggcgtcaaccatcgcctttaacctgcccaccggcgtgtcgctgtcggaagcgagcgacgccattaatcgcgccatgacgcagctcggcgtgccctcctcggtgcgcggcagttttgcgggaacggcgcaggtgttccaggacaccatgagctcgcaggtgatcctgatccttgcggccattgccaccgtgtatatcgtgctgggggtgctgtatgagagctatattcatccgctgacgattttgtcgacgctgccgtccgctggcgtcggggcgctgctggcgctggagctgttcggcgcgcccttcagcctgatcgcgctgattggcattatgctgctgattggtatcgtgaagaaaaacgccatcatgatggtggatttcgcccttgaggcgcaacgtaatggcaatatgacgccggacgaagccattttccaggcctgtctgctgcgttttcggccgatcatgatgaccaccctggcggcgctgtttggcgcgctgccgctggtgatctccgccggggatggttcggaactgcgccagccgctgggcatcaccatcgtcggcgggctggtgatgagccagctgctgacgctgtacaccacaccggtggtgtatctgttctttgatcgtctgcggctgcgctttacgcgtaaaaaccaacagctgataagtgagtaaatgaccgacctgtccaggaacgtacgctggcaattgtggatcgtcgccgtgggctttttcatgcaggcgctggataccaccattgtgaataccgccctcccctcgatggcgcaaagcctcggggagagtccgctgcatatgcatatggtgatcgtcgcctatgtgctgacggtggcggtgatgctacccgccagcggctggctggcggataaagttggcgtgcgtaatgtttttttcagcgccatcgtgctgttcacgcttggctcactgttctgcgcccgcgccgccaccctggatgagctggtaatggcccgcgtattacagggcgtcggcggggcgatgatggtgccggtcggacggctgacggtgatgaaaatcgtgccccgcgcgcagtatatggcggcgatgaccttcgtcaccctgcccggccaggtggggccgctgttaggcccggcgctcggcggcgtgctggtggagtatgcctcctggcactggatctttttgattaatctgccggtgggcattctcggcgccatcgccacgctgtggctgatgccgaactacaccctgcaaacccgccgtttcgatatgtgggggtttgtgctgctggcgctgggcatggcggcgctgacgctggcgctggacggacaaaaagcagacggacagtctccgctgttgccgatcctgctggtggcggcaggcgtggtggcgctgctgctctatctgcgtcacgccagaaacaatgagcgcgcgctgttccggttaacgctgtttcgcacccgcagtttttccctcggcctgctcggcagcttcgccggacgcatcggcagcggcatgttgccctttatgacgccggtgtttttgcagattggcctcggtttttcgccgtttcacgccgggctgatgatgatcccgatggtgctcggcagcatgggcatgaagcggattgtggtgcaggtggtcaaccgtttcggttatcgccgggtgctggtgggcagcacgctcgggctggcgctggtcagcctgctgtttatgaccaccgcgctgctcggctggtattatctgctgccggtggtgctgtttatgcagggcatgatcaactcgatgcgcttctcgtcgatgaataccctgacgctgaaagatctgcccgacgagctggcgagcagcggcaacagcctgctgtcgatggtgatgcagctgtcgatgagcatcggggtttccgtggccgggctgctgctcggcctgttcggtcagcaccatctgacggcggacagcggcgtggcgcatcacgtctttatctatacctggctgtgcatggcggcgatcatcgccctgcccgcgctggtgtttgcccgcgtacccaacgacgccagtaaaaatgtactgattgcccggcgcaaaaggagataacaatgaaactgtggcggccgggtattaccggcaaactgttcctcgcgattttcgccacctgtattgtgctgctgatcagcatgcactgggcagtgcgcgtcagctttgagcgcggctttatcgactacatcaagaacggcaatgaacagcggctacagatgctgagcgatgcgctgggggagcagtatcagctgcacggcgactggcgttttttacgaaataatgaccgttttgtgttccagatcctgcgctcgttcgagcacgatgacgacgatgaccggcctgggccgggaatgccgccccacggctggcgcacccagttctgggttgtcgatcaggacagacatgtgctggtcggcccgcgctcgccggtgccgcgggaaggcacgcgccgggcgattgtggtgaacggcgcgaacgtcggctgggtggtggcctcgccggttgaacgcctgacgcgcaataccgacattaactttgatcgccagcagcggcgcaccagctggctgatcgtcggcctggccaccctgctggcggcgctggcgacctttttactggcgcgcggcctgctggcgccggtcaaacgccttgtggaaggtacacataaactcgccgccggggatttctccacccgcgtcacccccaccagccctgatgagctgggcaaactggcgaacgactttaaccagctcgccagcacgctggagaaaaaccagcagatgcggcgggattttatggcggatatttcccatgaactgcgcacgccgctggcggtgctgcgtggcgaactggaggcgatccaggacggcgtgcgccagttcacgccggagtcggtggcctctttgcaggcggaagtgggcaccctgaccaaactggtgaacgatctgcaccagctgtcgatgtccgacgaaggcgcgctggcctatcagaaagcgccggtggacgtcatcaccctgctggagatggccgcgggtgtgttccgtgaacgcttcgccagccgtcagttatccctcaacgcctcgttaaccgaatccgccaccgtgtttggtgaccgcgaccggctgatgcagctgtttaataatctgctggaaaacagcctgcgttataccgacgcgggcgggcagctgctgatcagcgcccgcaccaggggcaacgcggtgctgctgacctttgccgacagcgggccgggcgtcaccgacgaacagctcgcccgactgtttgaacgtttttaccgtaccgaaggctcccgcaaccgcaccagcggcggctcgggactggggctggcgatctgcgtgaacatcgtcgaagcccacggcggcgcccttcatgctgcccattcgccttttggtggggtaagcattacagttgaactaccgctggaacgcgacaaaacgagagatgtatgactgagttaccgatagacgaaaacaccccacgcattctgattgtcgaagacgagccgaagctcggccagttgctgattgattaccttaaagctgcgggctacgcgccgacactgatcggccacggcgaccaggtgctgccttacgtgcgccagtcgccgccggatctgatgctgctggatctaatgctgcccggcaccgacggcctcaccttgtgccgcgagatccgccgcttttccgatctgcccattgtgatggtcaccgcccgcatcgaagagatcgaccgtctgctggggctggaaatcggcgcggatgactatatctgcaaaccctacagcccgcgggaagtggtggcgcgggtaaaaaccattctgcgccgctgcaaaccgcagcgtgaattacagacgctggatgcgcaaagcccgctggtcatcgacgaaggccgttttcaggcgagctggcacggcaaaatgctggatctcaccccggcagaattccgcctgctgaaaaccctctccggcgagccgggaaaagtcttctcccgcgagcagctgctgaaccacctgtatgacgactaccgcgtggtgacagatcgcactatcgacagccatattaaaaatctgcgccgcaagctggaggcgctggacgaagcgcagtcgtttatccgcgcggtgtacggcgtcggctatcgctgggaagcggatatgtgccgcgtggcctgagccttcacggggcggggaaacacaccggtttactcccccgccccacagcgctacaattcccgccctaaaattaagggatctccccgaccgtctcaccccgtgagcggatctgacctgtcatcagaacgagaaaatcatgtttaaaccggaactcctctccccggcgggaacgctgaagaatatgcgttacgcctttgcctatggtgccgatgcggtatacgcgggccagccgcgctactccctgcgcgtgcgtaataacgaattcaaccacgagaatttacagctgggcatcaatgaagcccatgcccttggtaaaaaattctacgtggtggtgaatattgcgccgcacaacgcgaagctgaaaacctttattcgcgatctgacgccggtggtggaaatggggccggacgcgctgattatgtccgatccggggttaatcatgctggtgcgcgagcacttcccgcagatggatattcacctgtcggtgcaggcgaacgccgtcaactgggcgacggtgaagttctggaaaagcatgggcctgacgcgggtgattttatcccgtgagctgtcgctggatgaaatcgccgagatccgcgcccaggtgccggatatggaaatcgaaatctttgtccacggcgcgctgtgcatggcctactccgggcgttgcctgctgtcgggctatatcaacaaacgcgatccgaatcagggcacctgcaccaacgcctgccgctgggaatataacgtccaggaaggcaaagaggacgacgtgggtaatatcgtgcatgtgcatgagccgatcccggtgaaaaacgtcgagccgacgctgggcatcggcgcgccgaccgacagcgtatttatgatcgaggaagccaaacgtccgggggaatacatgaccgccttcgaagacgagcacggcacctacatcatgaactcgaaagatctgcgggcgatcgctcacgtaccgcgcctgacggaaatgggcgtacactcgctgaaaatcgaaggccgcaccaaatcctattactactgcgcgcgcaccgcgcaggtataccgtaaagccattgatgacgccgccgccgggctgccgttcgatgagagcctgatggacacgctggaaggcctggcgcaccgcggctataccgagggtttcctgcgtcgtcatacccatgatgattaccagaattacgaatacggtttttccgtttccgagcgccagcagtttgtcggggaatttaccggcgagcgcaacggccatcttgccgccgtacaggtgaaaaacaaattcagcgtcggcgacagcctggaattgatgacgccgaaagggaacgtcaatttcacgctggagcatatggaaaacagcaaaggcgaagccatgccggtggcgccaggcgacggctataccgtctggctgccggtgccggaagatatggcgctggagtatgcgctcctgatgcgtaatttcaacggcgaaaacacccgcgcgccgcacggtaattagttcagcggggttattttttcgggagattagaatcggatcacataccgcttcgttctttatgggtaatatcgcgcctgctgaaaaacataatccataaatgctagctgtaccaggaaccacctccttagcctgcgtaatctcccttacgcaggcttattttttccccgcctttcagtttcttcttacgcgctctgcttccgcctgagatacactcttctcattggttcttttcgaggtagcaggatgagcacctatacatccagtttgatgattttgaatggcaaaaacgccggtgacgagacgctgcgcgaagccatcaccttactgcgcgatgaaggcatcgatattcaggtcagagtgacctgggaaaaaggcgatgcggagcgctatgtgcgggaggcggtgcagcttggcgtggcgacggtgatcgccggcggcggcgatggcaccatcaacgaagtggcgacggcgctgtataaaaacggcggcgaaaacgccccggcgctgggtattctgccgctgggcacagcaaacgatttcgccaccagcaccgcgatccccgagtcgctggacaaagcgttgcagctggcgattatcggcaaggcggtagcggtggatctggcgcaggtcaatgatgacacctgttttatcaatatggcgaccggcggcttcggtacgcggatcaccaccgaaacgccggaaaaactgaaggccgccctcggcggcgtctcttatctgatccacggtctgatgcgcatggatacgctgaagccggaccgctgcgagatcaaaggcgataactttcagtggcagggcgatgcgctggtgatcggcatcggcaatggccgtcaggcgggcggcgggcaacagctctgcccggacgcgctgattaacgatggcctgctgcatctgcgcatttttaccggcgaggaactgctgccggcgctcttcaccaccctcacccagccggaagacagtccgaatattatcgacggtaaatcggcgtggtttgaagtgaccgccccgcacgatattacctttaacctcgacggcgagccgctcagcgggcagcgtttccgcattgaagtattgcccggcgcactgaagtgccgtttgccgccggattgcccgttattacgttaatggcgttgataatgccgggtggcggctgcgccttacccggcctacagcgcgaatagcgagtaggcccggcaagcgtagcgccgccgggcaaggagcaatgagcaaaccattaatacgccgccacctcccgtgccatctcccggctgtactgctggctggcgctgaccagcatctgcgtgtagtcggttttcgccccgccgctcaccagctcgtccaccgtcagggtttcgaggatcttaccgtactgcatcaccgccaccttctggcacagatgggcgatcacccccagatcgtgcgtcaccatcagataggtcagcttcgactcctgatgcagctccgccagcagattgagaatttccgcctgcactgacacatccagcgccgaggtgggttcatccagcaacagcacctgcggttcaaggatcagcgctctggcaatggccacgcgctggcgctggccgccggacagctgatgcggatagcggtcgcgaaacgcgcggttcagcccgaccttatccagcagcgaattaatacgccggtcgcggtcaggaatgccgtggatttgcagcggctcttccagaatatcgccgatggtgtgacgcggatgcagcgaaccgtagggatcctgaaacaccatctgcaccagccgacagcgctgctgattgatgcggtgatcgagcttctggccgttaatcgccagctctccctgccagtgggtaaacaggcccgccaggcatttcagtaccgtggtttttccggatcccgactcccccaccagaccgtaaatctcccccggctgcacgctgaaattaacgtcaaacagcacctgattgcgcttgtcgccctcgccgaactccagacttaagtttctgacatcgatcataatctgccccttattcgtgaagccagctggcctggcgctgcaaaaccggcagcaccgggcggcgatggtgaatttccggcagcgcgttgattaacccctgcgtgtaggggtgctgcgcgttatcaagatctttcgcggcgatggattccaccacccgtccggcgtacatcaccagcacgcgatcgcaaaagctgcgcaccagattgatgtcgtggctgataaaaatcagccccagcccgcgggaggccaccagatcgtccagcagcccgagcacctgcaaacgcaccgacacgtccagcgcggaggtgggttcgtcggcgatcaccagttccggatcggtgatcagcatcatggcgatcatgatgcgctgcccctgaccgccggagatttcgtggggataaaggctgtaaacccgctccggctggcgaatacgtaccacatccagcatctccatcactttcactttcgcctcggctttgcgccccggatggtgcgtcagccaggcttcggcgatctgatccccgacgcacaccaccgggttgagggagtatttcggatcctgcatgatcatcgaaatacgtttgccgcgcacggtgcgcatctgcgcttcgctgacgttgcgcagatcgatatcgccaaaatgcatacgttcggcggtaatgcgtgctttagccggatgcagacgcatcagcgcgcgcccgacggtggatttaccggagccggactcgccgacaatcgccagcttttcccggcccagctggaaggagacgccgcgtaccgcgttggtcaccgtacgcccgttgacaaaatcgacgtgcagatcgcgcacgtcaagcaggggcgaattattcgctgcgaggatcgaggatgtcacgtaggccatctcctaagaagttgaacgccaggctgttgatcaaaatcgccagccccggaatagtcaccacccaccagcactccatcatgtaggtacgaccgctggagatcatcgcgccccactccggctccggcggctgtgcgcccaggccgaggaatcccagaccggcggcggtcagaatgatgcccgccatgttcatggtgatacggatgatcaccgacggcagacacaggggcaccacgtgacgccacagtacgcgcaccggcgaggcgccctgcaaacgcaccgccgagataaaatccgcctgtcgcagcgacagggtttcggcgcgggccagacgggcaatcggcggccaggcggtgagcgtaatggcgatcaccacatgctccagccccggcccgagggcggcgacaaaggccagcgccagcaccaggctcgggaaggagatgaaaatatcggtaacgcgcatcaggaccatatccaccttgccgccgaaataaccggcgcagacgccgagcagcagacccagcgggccaacggtgacggataccagcaacacgatgtacagcgtgatgcgcgagccatagaccaggcggctgaaaatatcgcggccaaactcgtcggtgccgaaccagtgctgcgcccccggcggttgcagggcgttgttcagatcctgcaccagcggatgataaggggcgatccagggcgcgaacgtcgccaccaccagcagcaggaagataatgccgccgccaatggcggtgagcggattacgcgccattttgccaataaagcctccggtgcggctgaacagacgtttcacgcgcgcaccctgctcgctggctttgccaccaacaggcggatccagataaaccgtcatgatttcgtcctcggatcaaagagttgatacagcatgtcggagagcaggttgagcatcacgaagatcacgcccaccactaacacgcagcccatcaccgcattcatgtcacccagcaacaggctgctggtgagataggagccgaagcccggccaggagaagacggtttcgatcagcaccgccccttccagcagcgagccgtaggccagcgccaccaccgtcagcaactgcacgaggatattgcgaaacgcgtggttccagatcacctgccgctcggttaagcctttcacccgcgcagtgatgatgaactcctgggagagctgcgccagcataaagctgcgggtcatacggctgatgtaggccagcgagtgaaagccgagcagcgaggcgggcagcaccagatgattaagcgcattccagaacacctgcatgttgcctgccagcagcgcgtctatggtcatcagcccggtacggcgcggcactatgccgtccagccccaggtcaatgcgaccggcgccgcccacccagccaagccaggcgtagaacagcagcagccccatcatgccgacccagaaaatcggcgtcgaataacccgccaggctgataatacgcaccacataatcggaaatgctgttacgccgcgccgccgccagcacgcccagcggaatgccaagacccgcgccgacgataatcgccatggtcgccagttcaagcgtggccgggaagacgcggataatgtcatccagcaccggtttaccggtcagcagcgcattgcccagatcgccatgcagcagattgctgaagtagatgccaaactgcgacagcagcgatttatcaaagcccagctgctgatagacctggttataggtgctctggtcggcatccgggccgacaatcgccagcactggatcgatgggcatcacgcggccaataaaaaaggtcagcagcagcaggccgaacagcgtgatcagcacctgggtcaggcgttttgagaagcgccgggcgcgggagccgggcgctaaaattgccgtactcatcctttatctccttcgcttttcaacggggctttccagacttcccgcaggtgcgtggtggcggagggatgcgactggaagtttttaacttcattacgcaccaccaccgaatccaccatctgggaaatcggcatcagggcgggaataagctggtcgtaacgggtctggatcgcctgatactccgccttttgtttttccggatcgcgctccagcagggcgctgtcgatcatctcgttcagcgctttgtcataaaagccggtgcgccagccctggaaattggtcagccgcgcttcgtcgctgttgtccgggttatagaccagcgcgcgcaggctggagtgcgggtgcggctcgacgccgctgccgccgcgcccgaccagcagatcaaatttacgctcgcgcatggcgccgtagatctggttgccggtgccggtgatgattttggcgttaatgcccgcctgcatcagggtggactgcacggcgatggcgatattgaggaacggctggtcggccagcacgcgcagggtggtgtcaaagccgtccgggtagcccgcttccgccagcagctttttcgcccgcgccacgtcaagcttatagcccggatccggcagcgtggacggcattcccgctttaatggggcgctggtgcagcacgccgtagcccggcatcagcgctttgttaatgccctggtaatccaccagatagcgcaccgcttcccgcactttcgggttggcgaagtgcggctctttcatgctcatcgctacgtaatagaccgtgcccttctgtaccgcttcaacggtgagatcggggtcgctacgcagcgcgttgatgtccgataccgccatattattcgcaatatccagatcgcctttggcgatcatcaggcgcagggtttgcgactcctggaaatggcgcagcaccacgcggttcattttcgccgcctcgcgccagtagtccgggttgcgcttcatgcgcagtacgtctttggcctgccaggtttccagggaaaacggcccggaacccgcttcattggtggtcagccagcggttgccccagtcgttattcacttcgtggctttgcacggttttgcgatccagcacgccgagattgccaagcgcgcccagggagtagatgaccagctgcggatcgttggctttcggcagacgaatttgcacggtgtggtcatccggtgcgctcacctgttcatcaatatttttcttgctgaagccgtaggatttccacaccgacgcctgcgcaagattgaggtgcagcaggcggcgcatcgaccacaccacgtcgtcggcggtcagcgggttgccggagtgaaatttgacgtttttgcgcagatggaaggtgagcgttttaccgtcggggctgatgtcccaggactccgccagcgccggtttaacgttggtcagctgattgggatccagttcgaccagcgaatcataaagattcaccacgatgcccaccacctcgttgccggtcatcgccgccggatcgaggctcagcaggttattcatattcatgccgatgatgagctgatcggggggcgttttggctgtcgccgccccgctccccatcagcagcgaaagcgccagcagacacgctcccgccagtgaggtttttttcatgtatatatcgcctgtagggtaagaagtttttataggtcagtcatggctgacggtattggcttcgatatatgcaaaattaatgtcttcacccagccccgggccttgtggcaaatgaacaaatccctcttcatccatcggatcgacaatgctgtgcagataggccgccgggacgtcgtaatcgaggaacgggtgcagcaggccgcgttcataccagcgacagtttttgatcgcccccaccaccgccaggctggccgcgccgttgccgtgcacttcgcaatccatgccgaaagattccgccaggctcgccactttcatggtcggccagatgccgccgacgccattggaaccggcgcgcagaatgtcgcaggcccccgctttcacccagtcggcgcggctgtgatgtttaccgccaaggctttccggcccgacaacgggaatggagaggttttctgccagccaggcgtaagaggccatgctctcttcttccatcggctcttcaaaccaggcgaagttgagtttttccagttccttaccgatgtacagcgcttcgctgcggctgtaccagtggtagccgtcgatcatcagatcgatgtccgggccgaccgcttcgcgcaccgcggcgcaggctttgacatccattttcgggttcggcgcaaaggacaccggcggcatccaggtgtgcagtttgatggccttatagccgcgcgccaccagcttttccgcaaaatcggcgtactcctgtggggtggaaagaccgccttccagatcgtcgccgcacatggtgctgccgtaggcgggcactttgtcacgaaaaccgccgagcagcttgtagaccggcatgttgagtttgcggcccatcagatcccacagcgcctgctccacaaaagagagcgcgcgttcggtcagctggtgcgcgctgccgcgctgccagtgcgccagatcctgccagatacgctcccggttaaaggcgtcctgaccaatcatcaccttacggaaaaaggtgttcaccacaaagggacgcaccacttccggcggcgcgaatgagtaccctttggtgccatcgtctgcggtgatggtcagcatcgccattttcgcgaggttctccgggccggggtgcgaatgcccggcggtatcggatacccgccgcgtgggatactgaaagacggtgacgtttacggattcaattttcatgacaagtccttgaggcagaggtgaagtaagcttttgaaaagctgtttcagtaatcaatgtatgcagaaaaaacagccagtgcctcggacaaattacgttaagcagaggttaaatgttgtgcatgtgcacgaagggatgtgaggttttccacaaaagaatggtgaaatgtgaagtggatctcccctcaccctaaccctctccccagggagagggaacggtccgcgttcgccctccagcaccgggagagggatggtccgcattctccctctcccgccgggagagggccggggtgaggggccgttatcaggcgatcgtcactttgctgtcgagatagacatcctgcacggcgttaatcagcttcacgccgtccgtcatggatttcttaaaggctttgcggcccaggatcagccccataccgcccgcgcgtttgttgatcaccgctgtgcgtaccgcatcgctcaggtcggtgtcgccccctgacgcgccgccggagttaatcagcccggcgcggcccatatagcagttcgccagctggtagcgcaccagatcgatagggttatcgctggtcagtttgctgtagacgcgttcgtcggtataaccgtatttcaccgcgttataaccgccattattttccgccattttctgcttcacaatatccgcgccaatggtggccgccagatggttggcctggccggttaaatcggcggaggcgtgataatcgacgccgtctttcttaaagccgctgttgcgcagatatgcccagagcaccgtcaccatgcccagttcgtgcgcccgctcaaaggcggcggagatctcctcgatctggcgacgggactccggcgacccaaaatagatggtcgcgcccacggccaccgccccaaggttaaacgcctgctctacgctggcatacagcgtctggtcataggtgttggggtagctcagggtttcgttatggttaatttttaccaggaacggaatacggtgcgcgtagcggcgggatacggaggccagcacgccataggtggaggccacacagttacagcccgcctcgatagccagctcaacaatatttttgggatcgaaatagagcggattcgccgcaaaggatgcgccagcggagtgctccacgccctgatcgacgggcaggatagataaatagccggtgcccgccaggcggccggtgttgtaaagcgtctgcatgttgcgcagtaccgcaggcggacggttgttatccatcatcacgcggtcaacgaaatcatgtccaggaagataaagctgatcggccggaatggtcatacaacgatgttgcagcaggctgtcggcgtcgttgcccagcaattgcgtaatatcagtcatagcgatgctcccgtaagttgataagcagagtaagcctggtaccgacctttgcggaacgccaccctggaaaatttattcagcacaatctgatggcacgatccataactcaaaaaaatgttattctgatcaaagatccagcacaaaggtatctaaaaggtattattaactggtatggtcataccgtaccctttgcttgtcatgaaggaagaccgatgaaaacaactgctaagctgtcgttcatgatgtttgtggaatggtttatctggggagcgtggtttgtcccgctgtggctgtggttaagcaaaagtggctttaccgccggggagattggctggtcctacgcctgtaccgccatcgccgcgatcctctcgcctattcttgtgggttcgctgactgaccgcttcttcgcggcgcagaaagtgctggcggtgctgatgtttgccggcgccgttctgatttacttcgccgcccaacaaacggagtttgcttacttcttcccactgctgctggcctactccctgacctatatgccaaccattgcgctgaccaatagtattgctttcgcgcatgtgaaggatgtcgaggctgacttcccgcgcatccgcgtgatgggcaccattggctggatcgcctcagggctggtgtgcggcttcctgccgcaaatgctcggctatgcggatatttccccgaccaatattccgctgctgatcaccgccggcagctctgtggtgctgggtgtcttcgcgctgatgctgccgcatacgccgccgaaaagcaccggcaagctggacgtcaaagttatgctcgggctggacgcgctggtgctgctgcgcgaccgtaatttcctcgtctttttcttctgctccttcctgttcgccatgccgctggcgttctattacatcttcgccaacggttatctgaccgaagtcggcatgaaaaacgccaccggctggatgacgctggggcagttctctgaaattttctttatgctggcgctgccgttctttaccaagcgctttggtattaaaaaggttctgctgctgggcttactgaccgctgctatccgctatgctttcttcgtctatggcggggcggatcactactttacttatgccctactgttcctcggcattctgctgcacggcgttagctacgacttctactacgtcaccgcctatatctacgtcgacaaaaaagcgccggtgcatatgcgtactgccgcgcagggtttgatcaccctttgctgccagggcttcggcagtttgctgggctatcgtcttggcggcgtgatgatggaaaaaatgtatgcctacaaagagccggttaacggcctgacctttaactgggcaggtatgtgggcgtttggcggcatcatgatcgccgtcatcgcggtgctgtttatgctgttcttccgtgaatcggatagagaaattaccgcgattgtggtggacaacgataagagccccactcgcggagaggtcccacaaggagaggtaaaatgaaatcagaacgtattctcggtgcgttatacggccagacattaggcgatgcgatggggatgccgtcagagctgtggccccggtcacgggtgaaggcgcatttcggctggatcgaccgtttcctgccaggtccggcggaaaacaacgccgcctgttattttgatcgcgcccagttcaccgatgatacgtcgatggccctttgccttgccgatgccattttcgaatgcaacggcaggattgacgccgaggttatcgcccggcatatcctgcactgggccgaagattttgatgcctttaataaaaacgtgcttggccccacctcaaaaatcgccctgcgggcgatccgcgaggggcgcccggtgagcgagctggagaacaatggcgtgaccaacggggcggcgatgcgcgcctccccgctgggctgcctgttgccgacgcactccctcgatcagtttatcgatcaggtggcgctggcctccagcccgacccacaagtccgatctggcgattgccggggcggtggtgattgcctgggcgatttcccgcgcaattgacggcgatcgatggcaggatattgccgatgctctgcccgccgtggcccgccatgcgcaggaaaaacgcgtcaccacctttagcgcatcgctggcggcacgcctcgaactggcgttaaatgtggtgcgcaatgcgtccggcgtggagtctgccagcgagcagatttatcagctggtcggcaccggcaccagcactattgaatcggtgcctgccgccattgcgatggtggagctggcgcaaactgacccgaaccgctgtgcgatcctgtgcgcgaatctggggggcgatacggataccatcggtgccatggctaccgccatctgcggcgcgctgcacggagtttccgccatcaatgccgcctttaagcagcaactggatgacgtcaatcagctcgatttttcgcattacagtgaaaagctcctggcttatcgtcaggagcgggaggaagcatgaaaccaggctatctcgtcagccttctgcaccggcttgaaacccggcgtccggtgacggtgttagggggcgcggtgatcgacgttatcgccagcgcctatgcgctgccatttcgcggctgcgacattgaactgaaacagcaaagcgtcaatatcggcggctgcgcgctgaatattgctgtcgccctgcatcgtctgggcatgcgcgcgcaaaacgtgctgccggtaggacacggcatctgggcagacatggtcagcaacgcgctcaattcccacggcattgaaagcgtgctgaacgtggatgaaggggataacggctggtgtctggcgctggtggagccggacggcgagcgcacctttatgaccttttccggcgtcgaaacccgctgggcgaaggcatggctggatccgcttaccgtgccgccgggcagcctgatttcactgtcgggttatcagctctccgccgcctgcggcgaagtgctggtcaactggctggaaacgctgcacgacgtgacgccctatatcgatttcggtccgcgtattgaagacattgatccggcgttgctggcgcgtatcctggcgctgaaaccgatcgtcaccttaaaccgccgcgaatcagagatcgccgcgcagctgctggacgtggagccggaacttttaggcccggcgtggcagaaagcgtacggcgcgccgctgattattcgtcacgatcgcgacggggcctggtactatgatggcgatgagcagggcttcgtaccgcccttcccggccaccatggttgacaccataggcgcaggggacagccatgcgggcggcgtgctggcggggttatcctccggcctgtcgctggcggattcagtctgccttggcaacgccattgcggcgatagtggtcagcaagcgcggcggcgactgtgcgccgacgcgcgaggaattactcctcgcatacaaagacgtataaatcgctgcgacaggtactgatgctgtactcaatgggccggttttgttgatcaagcgccacctggcttatcaccagaaccggcaccatgttttccagctgaatatgcgtctgaaattcagcgtccggcatccgggcgctgacccgcgattttgtgcgctggggatagagacgctggctgcggaaatagtcatacagcgaaacgccaatggcatccacatccttgatgagcggcgcgggcacccaggattcctcaatggacacggcgtcctcatccacatagcgaatgcgcttaagcagaaacacgtcggaatcggtgtcgatggcgagtttttccgccacctccgccgggcagggaacaatgcgtttgttcacccacagggtatccggcttcttaccgcgcagcaccacctgctgggaaaatccccgcgcctctttcagtgaatattcgaagatgttgttgatttgcgtgccgtagccacgtgaacgcgtgaccacgccttcatcctccagcatctgcatcgccttgcgcacggtaatgcgcgaaatccccgttaacccgctgaaatcacgctcgcccggcagaatattgccgtgggccagcagcccgctccgcacggcgtctttcaccgtcccggcaaacttcagatacagcggcatgttgtccgcggcggcaatccgctctttcagctgttcgattaactggatatgcgcttgttccatttcgggtatcctggcaaaaaagtccggtggttatactaccaccactcatggaaatgatgcaccggcccgatcccctcccccacttccagcgtgtcggcctgcgccagcgcggcgctgagccagcctttggcatgctccaccgtggtcgcccagtctgtacagcgcgggcgcagcgccgccagcgccgccgacagggtacagccggtgccatgagtatttttagtgtgaatacgcggtgcggtaaaacgcgtcgccccgtcgcgggtaaacagccagtccgggctttcggcatcctccagatgaccgcctttcatcagcaccgcttcacagccgagcgccagcaacgcgcggccctgctcgtgcatctcctgctcgttgcgggcgtgaggcgcggccagcagcgcggcggcttccggcaggttgggcgtgatcagcgagacctgcggcaacagatgccgacgcagggcgtcaacggcaccgggggagagcagcgcatcgccgcttttggcgagcatcaccgtatccagcaccacattctgcacctgataacgccgcagccgctccgccacggcttccacaatgtcggtttcggcgagcatgccgattttggtggtgtcgatacgcacatcgctgaacaccgagtccagctgtgctgcgacaaactccggttcgatgcggtacaccgactgcacgccgcgggtattctgcgccaccagcgcggtaatgactgaacagccataggcgcccagcgccgagaaggttttcagatctgcctggatacccgcgccgccactgggatcggtacctgcaatggtcagcgcattaatacgtttcatgccagcgcctccccgtccagacgatacagcgcatcgagaaacgccgggataaacgaacccggcccctgactggcagcgacggcacggctgcccgcctgcgccataatgccgcaggccgccgccacgttagtcaggcgatcccccggcagcgcacagctggcggccaccaccgccgagagcgcgcaaccggtgccgaccacccgcgtcatcaagggatcgccccccggcaccgcgagcacacgctcgccgtcggtgatgtgatccacctccccgctcaccgccaccaccgccccgctctgccgcgccagcgccacggcggcaggcaacgccgcacggatggtatctgtggtgtcaacgccgcgaccgcccgcctgcatgcccgccagcgcgaggatctccgaggcgttgccgcgaatagccgccgggcgcaggttcagcagttcccggcaaaaatcggtgcggaacgtcaggccgccaaccgccacgggatcgagcgtccagggttttcccgcctcgcgggcgctgttaatggcgacacgcatggcttcggcgcgatccgccgtcagggtgccgacgttaaccagcagcgcatcggcgatagcgctgaactgcacggcctcttccggctcgattaccatcgccggggacgcgccgagcgccagcaaaacgttagcggtaaagctctgcaccacgtcgttagtcatacagtgaacaaggggggaatggcggcggaagtgttgtaacagagtggcgatatccgccggatttagcaggtcaggttgcattttttgctcctgccagactgcgaagaagggacgccggcagaggcatctgacttccctacgctggcattatccagatcaggtggtacgggtatttctcagccttcacgcagaagggcaccccgagtcatttgaatcaaaatcaattatttacagttaacactgcaacagaatttagtgtagccgcgggctgttatcgggcacaaggaatttcataaagtttctgccgcccggcttttaacctcttttaggtattcgtgcttagtgtgatctggatcaacatttacaaatcttgacaggaggatagtaacggcgctgaactaatgcgtctcttttatagacacaaaatttactattcacgaagtcaatcaatatgaaaatctctactctcgccgcggtcgtcttagcggctactgcctttaatacagcggcaaatgaaagcgtttccattatgaacgatcgcctttccagcgccatgcaggatcaagccaataaccataatgatgcgacagcgagccgtgtacatgatgcgtacaacgccgttaagcaagctgaaaatggttcaatggataactcgcacatggggagcacgacgcaagccacaccaaccgcagccagctatggttttaacgcgtactccggatactcaacccgccccggcaccttcgcgccaacggcagacgatcgcaataatcatattccggacgccataccctctgtgaaaacagatggcgttccgcaggcaacgccgcagcgcgtgcccggtttgcagctgactccgaaagcggttgaacaacgtacgcctgtgctgaatcttacgcctgcagccattgcgcagaaaacaccgcaacttaccaacgctgtgcccacacagctcacgccacagcgcgtgcctggcgctattccggcacagcgttatcaaaaagtgcctgttgccaatttacaggcgccgggcacgctaacgcctgtagccacctattctgtacccaagcaggcaatcagctatagcggtgcttctcgccgaccgggcacttatcaaccttctgtgaccgctcccgccatggtgaaaggtattatgcagtctcctgcagtcgccacacctgagcaggttgacagcattaatgtcagcgttaacagcctgaaaccagatacacaggttaacgtcactgtcgaaggcaaaaccttcaccacaacggcgggcgctattgctaaggtcgatcctcaggcgcaaattagcgtgccacatatgccggtactggttcgcacccaatataacggggctaatcacggtaacaatggcgcacggaaaggcgagtctaatggtcgcggtgcagataatgcccattcccatgcctttggcggacatggctatggtcatgataatagccgatcagaaggcttcggcggccattcgcattttcattaataaccttagtctgtatttgataagaatacagcaaattaccgggttgattcataataatcagcctgctcaatataaaaaatgctcaaatacattttatgtagcgccctgctctatctgtcctgttttgtcattggtttcacaggcggcatggagtatataaaaatatttaccgactcatgtgatatttataaaataagcgacagcaataatgaaaaagttaatgatgatagcaatcataactggattagtcacttctaatgcctttgccataaatgccagctttcgtaagcaacttgaaaaatcaggctgcacacaagttactgaagctaatggtacatgtgacataaataaaacaaaggcacaaaacaagaaaagtaaaagcgaggaaactaagaatatccggaataaataattaacgtcactgccgtccattctgcacaacgggcggcagtgacagcttgccgcaaaagttttacttatcctcgcgccccgccgattaaacttacttaatccgaagtgaaaatttctcactttgtcaccctctcttacacgccagcatgattaatgtagaggtttatcaaacacttaaattcaatatttacttacctgactaagcgttccgcatccggttagctcattttttaatcaaatcctgaaatctcatacaagagatattctgcctgccatgcaaaatgaagttcgactacagacgcattaacttttgggcaggagagaaccgtgagtatcgaagaaaaaattgaaaatcatatacgtcagtttccggtatcgctggtgaattaccttaaaagcgattaccaggaagatctgatggtggtgatagatgatttgctgccgcatgacgttcgtgaagggatggaaacggaagcgcgccgcctgttgagcgaagaagcattacggcgtgaagtgataattgcccagagcggtaatacgccgcgtgcttacgacagtgttggacggaatgtcatccgcgaacagggggaatatattcccgcgttttttgacagcccaagcattctcaattttttcagccgcattaccggcgaaacgctttatcgggtgccttacgccccggaagaattcattattaattcacaaaacaaaaccggcgatacccacggctggcactgggatgactactcctacgcgctggtgtgggtgatcgacgagccggacgttttcgccggtgcgcgcgtggagtttattccccgtgtcccctggaaaaaaaccgccacccgggaatggattaaagatgtgctgacggaaaacaccatccgtagccgccatgtctcccagggacaatgttatctgctgcgcgccagagatgcgttacaccgtatctccccgttaaccagcgcgtcccgcagaaccgtaatcgtcttcacttatgccaacgatttagatcttaacgatcctgaactcacccatgactccatggaaactatttatccgcaggacacccaggcgcagctgtaaataataacgaagaaggaagacatcatgagtattaatgaatgtgcgggcgggatgaatgaccagggcggattcccggtattttttactgaaatctctgacgatctgggtcgctatgatgaatataccgacgccgcccgggcaatttcccaggcttttcctccggcttcttatcccgccgcgctcgatatttgctgcggcattggcaagatgagtaaagcgctccatgagtgtggctatcgcgtcacgggactggatttatccgccgcgcagctggagattgcccgtcagatttcccctggcccgcactatatccgcgccgacatggcaacgctgcctgccggagagtttgatttattactgaacgtttataccagctttggttattaccagagcgaagaagaagatctcagcgtgctgcccgcctggttcgccgcgctgaagcccggcggcgtgctgatcatggaactcgccgacatggatcgggcgcgtaaccgcatagatacctcaggtctgctggtacgtcatcataacggcgtacaggagacattaaccatggactgggaaaaacgaattcttaccgttgcctatgaaaaaaatagcagtcagtggacctgcttaacgcgcctgtatgaaaaagagtatttgcgggaggcgttactggccgccgggtttattgatgtcgggatcttcggcagcttcgatcttaaatcgaaagaagttgacgacaaccttgttcttattgccaccaaaggtaaataacatgtctaaaacaatctgcatcgttgatggttattccacgggcgcggaactggcgccgctgttcagaaaagaaggctggcgctgcgttcatattcaaagcaatccggttattccgggggattatcttttatcctttcgcccggaaacctttgataagcatttaatcttaaaagatcattcgcctgctgcgatgcgggaactggcggtcagcctcgccttttatggcccgacggttattattcccggcacggaaacgggcgtcgaacttgccgattttctcgcaaccgagctgggcaccgcgggcaatgactatgccaccagcgcattacgccgtaataaattcaaaatgcaggaagcgctgcgccagggcggtttacgcgccatcccgcagatggtgacggattcgctggcagatgcctggatttgggtgaaaacctccgcctgctggccggtggtggtgaaaccggtcgacagcgcaggggccgatggcgtgcgcttttgtcataattttgaagagctgaacgaggccttcaacgatattcacggcaaaaccaaccgtctgggtttacataacagcgaagtgctgttgcaggagagattaattggccgccagtttatcgtgaatgccgtcagtattgacggcgagcatttgatcagtgaaatctggtctgacgataaaaagcaggtcagaaacgcttcactcatttgtgagaaagaggtgctgctgccctatcagggtaaagagcaagaagcgttaattgcctatgtgcaaaaagccctgacgctgttaggcattaaaaacggcccgtcgcacagtgaattaatgatgaccgccaaaggcccggtattaatcgaaacggcagcccgtatgcagggcactattatgcacaacgcggtagtggcagccctgggttacagccatgtgaccttaaccgctgagcgttatcttaacccgcaacgcttcgccgcccggctacagcagcattatcagctcatgaaaacgctctattgcgtcacgctggcgtcggatgtggatggcgtggttagacaaaaccgttgtcaggaattgctcgcgcaactgccctctttttatggcgttatgcatacgccggatgcgggtgaaaaaatctaccgcaccaccgatctgtttaccaaccctggcattatttatctgtgtcatgaaagccagcagcagatcgaagcggactatgcgcagatcagagagtttgaaaaaaatggcgtcttatttgaattagcctgagataactatgaataattatagtggtgcagtgttcggttttattatggttttcatttacaactttctggacgccggaaaagaggtctattcgggattcctggtacagtctgcgcatccgatgatggtcacctgtattgtcttctcaaccgtgctggtattttttcagatcttctgcctgctccgcttgcgaaaggaatacctgcgtccttacagaacctggaagcctctggttgcgcttaatatgacaacagcgggatcgtggatcacttttttctactgtttaaaatatttagagcctgccagcgcgtcggcgattatcaccggcgttgcaccacttttaatggttatgattgtgcctttctttatcagaaccgaaaaacgggaataccgctggttgttactgacaggcattgcctgtagctcattatggctgggtgttatcagtctgcaggaggggcgtaatacctataatttatccgtacaggaagtgatcatcggtattgccctttccgtcggctgcgccctgttcagtattttctccaatatcctcagtaagaaactcagtgaggatgaatgtcgtccggaatccattatggcgcaccgcttttacctgacggtgctggtgacgctgctgttcagttttcagctacaggatatgcaaagcgatatgcaaaacctgtttcccggcgtgctgctgctggcagtcctggggttgattattccgttatggtgcttgcaatatggcataaaatccttagcgccttcgcgggtgatggtattaatttctgtcagcccggtctttacctttggctttcagatttttgacccccgactgtcgccgacagcgtcctcctttgttgccattctgttaatatgcttcttttctctggctgcggaagtgtggcgtattcagcatacaggacgggtgaacgatggctatcacagggtatcggaagacaggaacggttgagatcacgctttctgacagcaccaaccatgtttttccccggcactcccacgatgaattttatctgggcgcaaacctggccggcagggagaaaatctggcttgacggtaaacgttctgaagccagtattgcggatattaccgtttataatcccggccaggtacaggccgccacgcccaccccctataactgggtttattacagcttttacattccgcctcaggtgctggccgaacttaccggcctgcctgaggatgatgaattcagaaagagcgtattcaccgcgcccgatattgccgacgacattattaaaaccggggcgtattgcctggattacgcgcattccgatgatgaagtgctggaacgcctggcggtattattaaaaaaggtgctgcaacgcaccggttgccgcaccaaacttattctgttcgatcaggacgcggtgctggccgcgaggatcgccgcccagctgaaagatgaactgctcgaaccgccgtccctcaacgatctttccgcgcagtacggactcagcgccgtgcagctggtgcgtattttttctgcctcttatggcctgccgcccttcgcctggctgaaagtggaaaagttaaaaatagcgaaaaatttattattacgcggcctgagcttatcggatattgccgccggtcttaattttgccgatcaatcccatttcacccacagctttaaggaaatgtttaatatcacgccagggcgaatgtcgcgtttatataaaggggcgtgattttcactcccggaggataagtcctgcattttgcgccgggtgtttcccgcgccggtgggcggctatgctgaatacattcgctcaacgctatggagtagttatgaaagcaatcgccattaccgccgccgcgcagaacggcagcaacatcgatttcctgcatgatattgatattgaaaagcctgtcgcccgcggtcacgatctgctggtacaggttcatgccatttccgttaatccggtggataccaaagtgcgtgcgggctttaacgctgatgcgccgcgcattctgggctgggatgccgtgggcgtcgtcagtgacgtgggcgagtccgtgaccctgtttaagccaggcgataccgtctggtacgccggggcgctgacccgtccgggcagcaacgccgaatatcagctggtagacgagcgcatcgtggcgcataaaccggcctcgctggataacgcctctgcggcggccctgccgctcaccgccattaccgcctgggagatgctgtttgatcgccttggcgtcgcggaaaacggcaacgagggcgatgtgcttttgatcgtcggcgcggcgggcggcgtgggctcgatcatgacccagctggcgcgtaagctgacgaaaatgacggtgatcggcaccgcctcacgcccgcagagccagcaatgggtacgcgatcgcggggcgcatcatgtcattgaccacagcaaaccgctcagcgaagaactggcgcgtatcggcatcaaacaggtgacgcatgtcgccagcctgaccaataccagcgatcactatcagcagttgattgacgcgctgatcccgcagggtaagctggcgctgattgacgatcccgagacgctggatgcccggccgctgaaagcgaaaagtatctccctgcactgggaatttatgttcacccgctccatgtttgaaaccccggacatgatcgagcagcaccacctgctgacccgcgtggcctcccttatcgacagcggcgtgattgaaaccacgctgggtgagcatggcggcactattaatgcggaaaatctgcgtaaggcgcataagctgatcgagacacaacgggcggtgggcaagattgtccttgaaggtttctgagccaggaatcatcccaaaagcctttccccgatgaaagcggagcgcggttaacgcgcttcgctgcttctgctttgccccgcctttgcttacactttttcgcaaagcgctgttgctttcagtcataaatcgcagcaatgttagcgcgcatgatttaccagagggcggtagaaaaataaaacgcctgtcaaaaacggagagattatgggtaagacgaagatgttacttctgggcgcgctgttgatgacctcaggcgcggtactggctgcgccgcagggaaccggtattcagaagtatgaaattcaggaatttattgccgacttcaccaaatttaaaccaggcgatacggtgccagaaatgtaccgcaccgaagaatacaatattaaacagtggcaggcgcgtaacctgccggcgccggatgccggaagccactggacctatatgggcggcaactacgtgctgatcaccgatgccgacgggaaaatccttaaagcctacgacggtgagattttctaccaccgctgatcgacaggccgggataagagatgcgcatacgcaactggacagagagcgatcgcccttttttacgcacgctttatttgcaggcacgtcgtcacagctggacatggcttgagggcgaggagtggcaactggaagatttcgacgccgccaccctgggcgaacagatttgggttgcggaagaagacgggcaccggctgggctttgcctcggtttcggtgagcaataactttctgcacaatctgtttgtggatccccatgcgcagggaaaaggcgtcggcagcgcgctgctgaaaaaggtgcagtcggaatttaccagcaccggggcgctgaaatgtctggcgcaaaacaaggctgcgctggcattttatcagcgtcatggctggcatgtggaagcgaaaggcgagtcgccggaaggggaatatgtgctgctgcactaccggctaagctgatgaacgaaaaagaacccctcaccggacggcgaggggttttgttttacagcgcgcggaatgcgatttccgccgggatcacatcgccctgccagtacagctgcgcggcgacacgccccgccagcttacggtacattgccgtaaactcgctgtccggacggctgaccacggtcggcgtgccgttatccagatcttcacgcaggctgatgtgcagcggcatctggcccagaagctgggtgtgatactgctccgccagcttctctgcgccgccggtgccaaaaatcggttcgtggtggccacagttgctgcaaatatgcacgctcatgttttccacgatgcccagcaccggcacttccactttctcgaacatcacgatgccttttttcgcatcgatcagcgcaatatcctgtggcgtggtgacgaccactgcgccggtcaccggcacgttctgcgccagcgtcagctgaatgtcaccggtgcccggcggcatatccagcaccagataatccagatccggccacagagattcctgcaacagttgcagcagcgctttgctggccattggcccgcgccacaccatcgcgttctcgtcggtaaccagatagccaatggagttggtggcaaggccgtgggccatgattggcgccatgtgcgtaccgtccggcgatgtcggacgttcaccttcggcacccagcatggtggggatcgacgggccataaatatcggcatcgagaatgccaactttcgccccttccgccgccagcgccagcgccaggttgaccgcagttgaggatttccctaccccgcccttaccggaactgaccgcgatgatatttttcacgccgttgatgcccggctgatttttcacgcgctttaaggtggcgaccgtgtgcgacagcttccagtcgatggctttcgcgccggtaaggcgcagcagctcggcgctgcactcctctttcagctcttcaaaagcgctgcgccacgggaacggcatcagcagttcgatgtgcagcgtgtcatccatccaggcgacatgatggacggctttcagggccgtaagattatgggtcagcgtggggtgctggaaatttgccagggttccgacaactattgcgcgcaaggcttccggggatttggcctgggattgcgagttcatcccgactcctttgtatttgtatgattagctcgtcatgcaagtttacctgaaagaggcgggtttgtgcttacttaataattgctgttttggtaatatcaaaaccccttttttcacagaagaagtaatgttcactatgactcaagtcgcgaagaaaattctggtaacgtgcgcgctgccgtacgccaacggctccatccacctcggccatatgctggagcacatccaggctgatgtctgggtccgttaccagcgaatgcgcggccacgaggtaaacttcatctgcgccgacgatgctcacggcacgccaatcatgctgaaagctcagcagttggggattaccccggagcagatgattaccgaaatgagtcaggaacatcagactgattttgccggcttcaacatcagctacgacaactatcactccacgcacagcgacgaaaaccgcgagctggccagtgtgatttacggtcgcctgaaagagaacgggtttattaagaaccgcaccatctctcagctttacgatccggaaaaaggcatgttcctgccggatcgttttgtgaaaggcacctgcccgaaatgtaaatccccggatcagtacggtgataactgcgaagtgtgcggcgcgacctatagcccgaccgaacttatcgagccgaaatccgtggtgtccggcgcgacgccggaaatgcgtgattctgagcacttcttcttcgatctgccgtccttcagcgaaatgttgcaggcgtggacccgcagcggcgcgttgcaggagcaggtggcgaacaaaatgcaggagtggtttgaatccggtctgcaacagtgggacatctcccgcgatgccccttacttcggcttcgaaattccggacgcgccaggtaaatatttctacgtctggctggatgcgcctatcggttacatgggttccttcaagaatctgtgcgacaagcgcggcgatagcgaaagcttcgacgcttactggaaaaaagacagcgatgccgagctgtatcacttcatcggtaaagacattgtctatttccacagcctgttctggccggcaatgctggaaggcagcggcttccgcaagccgaccaacctgttcgtccacggctatgtgacggtgaacggcgcgaagatgtctaagtcccgcggcacctttatcaaagccagcacctggctgaaccattttgacgctgacagcctgcgctattactacaccgccaagctctcctcgcgtatcgacgacatcgacctgaacctggaagatttcgtccagcgcgtgaacgccgacatcgttaacaaagtggtcaacctggcatcccgtaacgcaggctttatcgccaaacgctttgacggcgtgctggcgtctgaactggcggatccggcactctataaaaccttcaccgatgccgcacagagcattggcgaagcctgggagagccgcgaatttggcaaagcggtgcgtgaaatcatggcgctggctgacgtggcgaaccgctacgttgacgagcaggcaccgtgggtggtggcgaaacaggaaggccgcgacgccgatctgcaggccatctgcaccatgggtctgaacctgttccgcgtgctgatgacctggctgaagccggtgctgccggagctgagcgcccgcgccgaagctttcctcaacacgaccttcgaatgggatgccattaaccagccgctgctggcgcacaaggtcaacacctttaaggcgctctacaaccgtatcgaaatgaaacaggttgaagcgctggtggaagcctcgaaggaagaagtgaaggcggcaagcgcaccggtttccggcccgctggcagacgatccgattcaggacaccattacctttgatgatttcgcgaaaatcgatctgcgcgtggcgctgattgaaaacgccgaatttgtggaaggttcagataagctgctgcgcctgacgctggatctgggcggcgagaaacgtaacgtcttctccggtattcgctctgcatatccggatccgcagccgctgattggccgcctgacggtcatggtcgccaaccttgcgccacgtaaaatgcgctttggtatttctgaaggcatggtgatggccgcaggtcctggcggcagcgacattttcctgttaagcccggatgatggcgcaaaacccggccagcaggtgaaataatcccaaatacgcttaactgggcgctgtttatacagcgccctttttttattgcactatgattgcagggatggtgattttttctcatattaaggagcagtatgaacattttaaaaaaattaggcgcactcgtcttcacggcgttcgtggttgtcgcgctgagcggctgtggcgataaagaagaaagcaaaacctttacctggtcagacggtaaaaccgatttatccctgacctattactacaaaaatgacgtagtactgcgtcagacagcgaaaaataccctgcactatgcaggtctgggcgtggcgaataaagaagaagcgatgcaacgtctggggccaatcagcgaaaaatataaagagattaagggcgtggaagagagcctggaatatggcgatacctctgcaaccgaaaccctgaccgtggattacagcaaagttgaccgtgacgcgctgcaaaaaattcagggcgcggagtttaccggtgatgtgaaagaaggcgtcagcatgtccaagtctgaagccctgctgaaatctcgtggttttaaagaagttaaagaataagtttgatattgcccggcggcgcaagcttgccgggcctacacaaacctcatcgccctccaggccggtgtaagcgaagcgccacccggcaaatcccacgccagttcaccctacctgtaggccggcgtaagcgcagcgccacccggcacaaaacccttatttcgcggcgtgcacccgggtcgccagaccacgcaggaaataacgcaggaactgatccccacattcacggaaatttttatgatccgccgcgcgcatcatggcggtgatctccggcatcgacacacggaactgctgcgcggttaaaatcgccagaatatcgtcggttttcaggttataggcgatacgcagttttttcagcacgatattgttattcacgcgacgctctaccgccagcgcaggcgccgattcatcccggccacgcttttcataaatcagaccattcaggaagcaggcgagcagaatatccgggcagcgcacaaagccctcttcatcttccttgcgcagccatggcaccagctgttctgcggtgacatccgcttcacccagcgcgaaaatacgcagcagatcttgattgttgaatttagagatatagcggacgcttcgtaaaatatcgttactgatcatagtgccttcggtggagaaaaatacaaaaacgcagtttaccacgatccccgcgttttacagacccagcgcttcttttagatttttcagataacgacggctgacgggcaccgtatgcccttcacgcagcagtaattcagcctgaccattatcctcaaagcggatctcttttaagtgcgccatattgaccagatattgccggtgacagcgcatcagcggcgtacggctctccagagtgcgcagggtcagctccgtaaagccctctttgccttcgtgactggtcacatacaccccgctgaggcggctgctgacgtacgccacatcgtccatctgcaacagataaatgcggctgtgcccggtgcagggaataaacttcagcggcgcctgattttccggcagcaccgagacgtcctgtactccgcgctcctggcgcaaacgcgtcagggtttttgccagtcgcggcgatgcaatgggtttgagcagataatcaaaagcatgctcttcgaaagccttcaccgcatattcatcaaaggcggtgagaaagaccacgtaaggccggtgctcaggatcgagcatgcccaccatttccagcccgctgatgcgcggcatctgaatatccagaaacagcacgtcggggcgcagtttatgcaccgcgcctatggcttccacggcgttggcgcactcgccgacgatctcaatatcgctttcatcttccagcagaatacgcagattttcccgcgctaagggttcgtcatcgacgatcagcacttttaacatgcgctttcctccacaggtaaacgtagggtaattcgggtaaatcgatccggctcgcaggccacggcgataccgcaatcatcgccaaaacgcgcccgcaggcgcttatccaccaggctcatgcccagcccgctggcattggccttcggctggtacagacccgcgttatcttcaatatccagcaccatatactgcccgtcgagactcgcccggatagtgatttcccccacgcccagcagctgtgaagtaccgtgcttaatggcattttcaacgatgggttgcagcgtaaaggcgggcagtttgtgccaggacagcgcctccggcacaaacagctgcacctgcaaacgcgactggaaacgcgcctgctcgatttgcagataggcgttcacatgctccacttcatccgccagcgtcaccacttccgacgggcgttttaagtttttgcggaaaaaggtcgacaggtactgcaccagttgcccggcctgctcgctgtcgcggcggatcaccgccttcagcgtgttaagcgcattaaacagaaaatgcgggttcacctgcgcatgcagcagtttgatctccgactgggtgagcagcgctttttgccgctcgtactgcccggcaaggatctgcgccgacagcagctgcgcgatcccctcccccagcgtgcggttaatggaactgaacaggcggtttttcacttcatagagtttgatggtgcccatcacccgctgattctcgccgcgcaacgggatcaccagcgtcgagcccagcttgcactggggatgcagtgaacagcggtacggcacttcattgccatccgcatagaccacttccccggtttccagcgctttttgcgtccagcgtgaggaaataggccgccccgacaaatggtgatcgtcgccgatgcctttaaaggccagcagcttttcgcgatcggtgatcgccaccgcgccaatgtccagctcctgatacagcacctgcgccactttcatgctgttctcttcgttaaatccctggcgcaaaatgccttcggtggaggccgccaccttcagggcagtggcggaaaaggcggaggtatacttctcaaacatcgcccgtttatccagcaggatgcgcataaagagcgccgcgccgacggtattggtcaccatcatgggcgcggcgatgctgctcaccagatgcagcgcgtcttcaaacgggcgggcgatcagcaggatgatcagcatctgtaccagttccgccaccagcgtaatggccccggcggtcagcggactgaatactttatcggtgcggccgcgtttgatgaggaaactgtgcaccaggccgcccagcagcccttcgacgatggtggacaccatgcagctgagcgccgtcatgccgcccatggagtaacggtgtaatccaccggtcagccccaccagcccgccgaccaccggcccgccgagcagaccgcccatcaccgcgccaatggcgcgcgtgttggcgatggagtcttcaatgtgcaggccgagataggtgcccagaatgcagaaaatggagaaagtgacatagcacagcagtttatgcggcagccggacggtgacctgcatcagcggaataaacaggcgcgttttgctcatcagccaggcgatgaccagaaacacgcacatctgctgcagcagcagtaacaccagattaaactcgtacatacccaaacaccgaaaccgcataaagcgcgtaacatacagggcgccggggatcctttctgtgaaaccgccggaaaaaatcaaaaaaacgtgcccgccatcacaataacgccgcctgttgtcaccctttcgtatgcctggcgaataaaaaacaagcaaatgagagccgttcgcataacagcgtctacagttagaccaggacccgtgcaaaggtgaaactatggcgctatacaccatcggtgaagtggctcagctgtgcgacgttaatcctgttaccctgcgggcctggcaacgccgttacgatttgctgacgccacagcgcactgatggcgggcaccggttatttaatgatgcggacatagaccgcatccgcgaaatcaaacgctggatcgacagcggcgtgcaggtcggcaaagtcaaaaccctgctgtggaatggcgcgacggacagcgaatataactggcgggagcaacaggagcgtctgctcggttacctgcaatgcggtaatcttccccgtctgcagctgtggatcaaagaacaggggcgcgcgttcccggcccatactatcatcacgcaattactcattcctttgcgtctgcgcctgcgctgccaggatccgacgctgctcgccatgctgagtctgctggacggcgtgctgatcaaccatatttcgctgtgtcttacctcgtcgcggaagaaaagcagcaatgatgcgctggtggtcggctggaatattcacgataccacgcggctgtggctggaagcctggatcgcaagcgagcagggctggcgcaccggcgtgctggcacattccctgacgcagttgcgcccggaacagtttaccgggcataccttaatggtgtggtgcggcgatgcgccgacgatttcacagatgcagcagatggccagctggcgtgatgccgggcatgcgatccagatgctcggcatttaatggttcgttaacacttgcgcttcacgttatactccctgcgttaatcatcaggagtaaaacatgaaggcgtccaaaatccttgtcaccaccctctttctacttatggctatcggcggcacgggcggcgtgatgctggcgggttacttctttattctgcgtgcttagtcattgcccgcgccaggcgctcgaatccgcgatcgacaataatcgcggccagcgccaccagtagcgcgccctgaatgacataggcagtattaaagccggaaagtccgatgataattggcgtgccgagggtattcgcccccacggtcgaggcgatcgccgccgtgccaatgttgatgatcaccgaggtgcgcacgccggctaaaatcaccggcgccgccagcggtaattccactttcatcagccgctgccaggcgctcatccccataccttccgccacgcttatcacccccgccggtacggcgctaagccctgccagcgtgccctgcaaaatcggcaatacgccgtagaggatcagcgcgattatcgccggatccctgccaaaacccatcaccggcacggcaatcgccagcactgccaccggcggaaaggtttgcccgaccgcggcgatggtttccaccagcgagcgaaattccagccctgccggacgcgtcaccgcgatccccgccccgacgccgatgatcaccgctatcacgctggaaatccccaccagccagaaatgcgccagagttaaggtaagaaaggattcctgctgataaaccgggcgcggcagctgcggaaaccaggcgctgaacagcgtggcgctgtgcggcagcgccagcagcaacgcgataaagagggcgataagccacagcagcggatcacggatgaccttcacggttggcctccatgctgagcagatcgcgaaaatgcagactgccgcaggcaataccttgcgcatccaccaccggcaacacgtcgcgctgctgcgccacgaaggccgacagggcgtcgcgcaatgtcaggttttcactgagcggctcgcctgctgccgcatccccggcgcgctgataatcgccgacccggcgcagggagagcaggcgcacgcccagctcgctgcgaccgaagaattcgcgcacgaatggcgtggccggacgggtgagcatctccagcggcgtgccctgttgtaccactttgccgttatccatcagcaccagatgatccgcaagctgtaaggcttcgtcgatgtcgtgcgttaccagcacgatggtgcgcccgagcagctgatgaatgcggcgcatctcctgttgcagcgccccgcgcgtcaccggatcgagcgcgccgaacggctcgtccatcagcagcacttccggatccgccgccagcgcccgcgccacgccgacacgctgttgctgaccgccggacagttcatggggatagcgcgagcgcaggccgggatccagcccgagcagcgccatcagctcatccacccttgctgcgatacgcgcccgcgaccatttctgcaactgcggcacggtggcgatgttttccgccaccgtccagtggggaaacagaccgatggactgaatggcgtagcccatgcgcctgcgcagcgtcagcatcggaaaggagcggatctcctcaccggcaaacaaaatggtgccggtatcgtgctccaccagccggttgatcatcttcagcgtggtggatttaccggagccggaggtgccgatcagcaccgtgaacgccccggttttgaaatgcagattcagatcgctgaccgcgtcctgaccattaaatgctttgctgacctgtcgaaattcaatcatgcctgttttaccttcagcagcgcgagccacaatccgaataatgcgtccaccaccactgccagcgcgatcaccgggatcacgccgagcagcaccagatccagcgcgctactcagcaatccctggaacaccagcgccccaaacccgcccgcgccaatcagtgccgcaatgaccgccatgccgatggtctgcaccgtcaccacccgcagactgcgcagcaataaaggcaacgccagcggcaggcgcacctgcaaaaagcgctgccgggcgctcatgcccatgccggcggcgctttccagcacctcgcgcggtacctggtttaaaccggccaccacgccgcgcaccagcggcagcagcgcataaagaatgagcgcgatcagcgcgggcgtcaggccggtaccggcaatgccaagctgtcccagcaccggaaagcgttgcaccagaccggcaaggggcgcgatcagcagaccaaacagcgccaccgagggcactgtctgaatgacgttaagcaccgcgaacaccggcccctgacgcgacggatggcggtaacaccacaaccccagcagcccgcccaccagcagcgcaggcagcagcgtgccgaccagcaacagcaaatggcgggtcaacgcatcgtcaaacacgtcctgacggttggcgtactctttcagcagggagagatcgttaagatagccatagtgcagcagaaacagcggcaggatccagatttgcgcatgtaacagccagcgccagacggggcctgccgtcaggcgacgaatggtatcgctggcggcaagcagcgccagcgccagccacagccacagaccgctgcccatggacgtacgggcaagcgtactgccctgctgcgccagatccgtcgccgcccggcctgccgcccataccagcacaataaacagcccttccgcgaggataagcgtggcggcctgaggccagcgacggggcagaaaacagagcgccatcagcagcaacggcgctgccagccacagccatgacgaggccggccagacctgccataacaggcggctttcgccggacaccagccggttaggcgcataattaacaaagggcagcagcgaggctgccagcgcgatcagcgccagcagcaacaccacgcgattatgacaacggatcaataccatcccatcctgtgattacttcaccagtcctttttgcttcaggtagtcagcggcgactttcttcgcgtccagcccttccacggcgatgctggcattcagctgttgcagcgttttttcatcgaggctggcgaagaccggcttcagccattcgtccagctgcggatacgcttttagcaccgcctcgcgcaccaccggcgttggggcgtaaatcggctgtacgcctttcggatcggtcagggtttgcagacccagcgccgctaccgggccgtcggtgccgtaggccatggcggcattcacgccggaggtttgctgcgccgcagctttgatggtcacagcggtatcgccgcccgccagcgacagcagctgatcctgattcaggttaaagccataggccttttcaaaggcgggcagcgcatcggcgcgttcgataaattccgcggacgccgccagtttgaaggtgccgccctctttcaggtaacggctcagatcgtcaagggaggtcagcttgcccttctccgccacgtctttacgcacggcgatagtccaggtgttgttggcgggcgcaggcgtcagccataccagcttgttctgttcggcatccagttttttgactttttcatagccctgctgcgcgtttttccacgccgcgtcgttttcatctttaaagaagaacgcgccattgccggtgtattccggataaatatccagctcgccggaggtgatcgccccgcgcaccaccggcgtggtaccgagttgcactttattaacggtcttcacgccgtggctttccagcacctgcaaaataatattgcccagcagcgcgccttcggtatcaatttttgaaccgaccttaattggctccgccgccagcgccggcaggctcaccgccgcgatcaacgccagtgagccaagcatcccctttttgattgtcatcgtgctttcctcgttttttgccgtctgctatcagcagcttgtgtaaaaagcgtagacgatatatcgctagtctgcggggttctctggcagctttaacggtacggtcataatactggccgaaaaatagagcagcgcaatgacccacagcgtgccttccacgcccagcggacccacgcacaacgtgacgataacaggcccggcaaaattgctcagccccgagccaagattaagacaggagatggcggtgcctttattttccggcagcagcgaggggaccagcgcgctcagcggcccaaaggcgccgaggccgatggcatagagcgcaagcgccatgaacagcgcggcattgctgtgaccaaagatcaccggcgcataacagaccgccagcgatgccagcccgcaaagggtgccggaaaaccacatcaccgtattgcgccagccgatggtgtcccccagccagccgaacagatagctggcgaaaatgttcaccacattgaccagtccccagatggtcagccattcggcgatgctgaagccgaagcgcggcagatacatcggcatgaggatcaccagcgaaaatttgccgatgtcattgatggttttgaccatcaccgcgagccgcattttcggctggcgcaccagcaccataagtccctcgcccatcgcctgacggatgctctggctgcgggtgaaacggggtctgtcgctattgaggatcagcgcgcatacggctcccagcgcaacaaaaataaaaccgctggccagggtggcggtttccccgatggcgggcagcatcagtcctgaataccagggtccgacaatggtcatgccgacgccaaaggcgatccagaaccacgacaccgcgcggcctaatatccgcgcttcgcagcgctggttgatccacaccagaaaggagtaggcaaacagcggataggccacgccgcgcagggcatagctgacgatcatcatcggatagtggttatccggcagagcgacaaaaataaagggcaccgatccggcgaaatagcacaccgtcgccgcccacatcagccgccgcacgcccagtacgccagcgccgatgccggaaaaccacgacaccgccgccacgcacaggccgaaaattgaggacagcaggctgatatcggtggccgcgaagccgcgcgtttgcagcatcgatgccagccagctctgttcgatggtcgcgccggtgataaagagaaagacgccgataaatccccagcaaagctcgcggggcaagccgaggcgcgcccagacgccccgctggataaaaagactttgatccatgatgttatccttaacaagattttcgtccctgaaggtgaaggccgcattatgcggattaccgcccgccatttttgtgacgcgctttctgagtctggtgaaaacgtactacagtgtgccgataaatcttttacaggacaggttaagcgagtatcagatgtcacaatactggtggaaggatttactcgaccgcaatggccactggcaggggctggaactgcaggtgcaggaaagcgactctcccgtgcaggccatggaaatgttaagcggccatcatggccgtatggcgctacagctccagggagaaacactgttctgggccacgatgcttgcggatcactcaggcgtctggctggtgtttaatgccgatcatccgggccagcaatccttgttgccgccggtgacttccgcagacgtggaatgggtccaaaagcaggccgtacacgatccgctaagcgaatggtgtcgctattttgcccgacagttaatgacggcccccacgccgttgttgtccgcgcgtcggtggttgttaagacccatgatgccagtaagcgcagctccgcgccccctggcgcagcgacagcccgttgccgactggcgttttgagtcgccgacaagcgccggaaatatcggctgcgactgggtgctctatggcgaagatttcccggatgtagcagacccgcaaaaagtcatgctggtggactggtggtggggaggcaatttactgcggggccgctatccgatcgaccgcgatgcgggacgcctgaaatggtggcggaaaaaaagccgtgaagggacattgccgccggtactggtctggtacattgccgggctggcctcctttgtgatcctcgacggacattatcgcctgcaggcagcaatcgatgagggcattgcccctgaatttgtggtgctcagtgaactgaatgagcggacgtttacgccggatccgggccagcaggcgcgggtcgttaaggcattagagatgcagcagcagcgtaatccggggtttaacgttgaggggatcaatcagaccttgattaacctttatgatacccgctatctgtacgcgtccacccacagtcgggcgatcctcggcgagggcacgggctgggcgcgggatttaaggaattatttgcaaaagcatcagttgagtgaatatctgggacgcatcatggcacgggtgagtgaataataaattttgtatccattgtgacgcgcaggaaggctttggcatgttacacatgagcaatgcgttgcccggcggcgcaagcttgccgggcctacaaattagtccgcagaccggataagcccgtaggccgggtaaaacggtaggccgggtaagacgccgtcgccacccggcgaaacagaaaagcaaaaaaaacgccaccggacggtggcgttggggattacggaaaaaggatcacagcagttcgaactcgccctgcttcacgcgggcggaatcggtgccgataaagacgttaaatttgcccggctccgcatcgtatttcatctgctggttccagaacttcagcgcctcaatatcgatcgggaagctgacggtctgggtctcacccggtttcagggtgattttttcaaagcccttcagctgtttcaccggacggctcatcgaggcggtcacgtcctgcagatacatttgcagtaccgttgcgccttcgcgtttgccggtattagtcacctcaacgcttgccgtcaccgtgccgtcacgcttcatggttggcgcagacagtttcacatcagacacgctgaacgtggtgtagctcaggccatagccaaacggatacagcgggccgttcgcttcgtcgaagtagcgcgaggtgtacttgttcggcttatcagcgttatacggacgaccggtgttcaggtggctgtagtagaccgggatctgcccgacagagcgcgggaaggacatcggcagcttgccggacgggttgtaatcgccaaacagcacatcggcgatagcgtttccgccttcggtgcccgcaaaccaggtttcgaggatcgcatccgcctgctgatcttctttcaccagcgccagcggacgaccattcatcagcaccagcaccagcggtttaccggtggcttttagcgccgcgatcagattgcgctggctttgcggcagggtgagatcggtacggctggaggcttcatgggccataccctgggcttcgccgaccacggccaccaccacgtcagactgattcgccacttttaccgcttcgtcgatcatcgcctgcggcgtgcgttcatccacctgcaccgccggttcgtactggtttaagaaggtgacaatgtctttgtcatcggtgatattcgcgcctttcgcgactatcactttgccctggtcgccgatggcgtttttaatgccggtcagcacggtcacggactgatccgccacccctgccgccgaccagctacccatcacgtcgcgcttgctgtcagccagcgggcccaccaccgcgatggtggcattctttttcagcggcagcgtatcaagacggtttttcagcagcaccaggctttcgcgcgccacttcacgggcttctttacgatgcagacggctttcggcgttggtgtcctgcggatcggtctctttcgcgcccaggtggctgtacggatcgttaaacaaccccatatcatatttcacgttcagcacgtgacgggtggcgtcatccagttcagccatggtcactttgccgtttttgatcagatccggcaggtatttgctgtaatactcatcggccatgctcatatcgacgccggatttcagcgccacgcgcacggcgtctgccggatcggcggcggtaccgtgtttaatcagctctttgatcgcgccgtggtcagaaatggtgatgcctttaaagccccactccttgcgcagcagatcttttaacagccagggatcggaggccgcaggggtgccgttaagggagttcagggcgatcatcaccccgccgctgcccgcgtccagcgccgctttgtacggcggcatgtagtcgttgaacagacgctgcgagctcatgtcgacgctgttgtactctttaccgccttccaccgcgccgtaagcggcgaagtgtttcacgctggtcattaccgaatagcgatccgccgggcttttaccctgcatggattccaccatggttttacccatgctggcggtcaggtaagtatcttccccgaagccttcggaaccccggccccagcgcggatcgcgggagacgtcgaccatcggcgcccaggtcatgttcaggccatcgtcagcggcttcataagcggaaatgcggccgacggttttcaccgcctcaaggttaaaggaggacgcgagaccgaggctaatcgggaagacggtgcgctgaccgtgcaccacgtcgtaggcaaagaacagcgggattttcaggcggctgagctgcatcgcctgatcctgcatggcgcgaatgtcctggcgggtaacggtgttaaaaatcgccccgacctgacttgctttgatcatctcgcggatggcttctttcgggttatccggcccgacgctgataagacgtaactgaccgattttttcatcggtggtcattttgccgagtaattcggtgacaaaggcatcacgcgcttccggcgtaaggggatgattgccggtcgtttcttccgccagcgcgggttgcagcgccagactcacagcgacacctacagaacatagccatttcatgtcgtatatctctcgtaattacagccgtatcagcggcagagcgtgcgaaaaccgcagtgtgccataatcgtagtagctgttgcagggttattctcttatttttctgacgattacttccgcgtgatgtattttcccgcgctatgctttaaagcgtcaattttgccccgccacaaggagtggatcatgtctggtcatcatcctgataataacgctgcttttttgcaggaacttacccgcctcgtgggccacgcccatctgctgactgaaccggccaaaaccgcgcgctaccgtaaaggcttccgctcgggccagggcgatgcgctggccgtcgtcttccccggctcgctgctggaactgtggcatgtgctgagcgcctgcgtgcgcgccgataaaattattcttatgcaggcggcgaacaccggtcttaccgcaggatcaacgccggacggcaatgattacgaccgcgagatcgtcatcatcagcacgctgcgtctcgataagctgcacctgctggaaaaaggcgagcaggtgctggcgtatccgggcaccaccctttattcgctggaaaaagcgctcaaaccgctgggtcgtgaaccccactcggtgattggatcctcatgcataggcgcgtcggtcattggcggcatctgtaacaactccggcggctcgctggtacagcgcggcccggcctacaccgaaatgtcgctgtttgcgcgtattaatgaagacggccagttacagctggtgaaccatctggggatcgatctgggcagcacgccggagcagatcctcagcaagctggacgacgatcgcattaacgacgccgatgtgcgtcacgatggccgccacgcccacgatcacgactatattacccgcgtacgcgacatcacggctgacactccggcgcgctataacgccgatccggatcgcctgtttgaatcctccggctgcgcgggcaagctcgcggtctttgccgtgcgtctggacaccttcccggcggaaaaacgccagcaggtattttacatcggcaccaatcagccggaggtgctgacggagatccgccgacatattctggcgaacttcacccatctgccggtggcgggtgagtatatgcatcgcgatatttacgacatcgccgcgcgctacgggaaagacactttcctgatgatcgacaagctcggcaccgacaaaatgccgatgttcttcaccctgaaaggccgcaccgacgcgatgctggaaaaagtaccgctggtgaaaccgcactttaccgaccgggcgatgcagaagctgggcaatctgttcccgaaccatctgccgccgcgcatgaaaacctggcgggataagtacgaacatcatctgctgctgaaaatgtccggcgagggcattgcggaagcacagagctggctgaagtcctacttcgctgatgcagagggcgatttcttcgcctgtaccaccgaagaaggcaataaagccttcctgcaccgctttgcggcggcgggggcggcaatccgttatcaggcagtgcatgcggaggaagtggaagatattctggcgctggatattgccctgcggcgcaacgacgagcagtggtttgaaacgctgccgcctgaaatcgacagccagttagttcacaagctctattacgggcatttcatgtgctacgtcttccatcaggattacatcgtgaaaaaaggcgtcgatgcccatgcgctgaaagagcagatgctggcgctgttgcatgcgcgcggggcgcagtatccggcggaacataatgtcggtcacctgtacgaagcggcagaaagtttaaaacaattttatcgcagcaatgacccgacaaacagcatgaaccccggcatcggcaagacttcaaagctaaaaaactgggcgtaatgcaaaccgaaagcgtaaccgcatagcgcaagcccggcgctatgcattgcactgtgatgtatggggtattccgtgttcctttttcgtactagagtagcgctatgtcgccatagaaacgtttctatggcatgccattcaggagcctatgcccatgtctgttattgatgttttaacgggaattgaagtggaggttcgcgatgcacggcctgacgatgcccatgccgtagccgcgatctacgcctggcatgtgctccacgggcgtgcctcttttgaagaagtcccgcccaccgtcgatgagatgcgcgaacgcatcgaggcggtgaccgccgacgggctgccctggctgctggcgctctatcgcggcattgtggtcggctactgctacgccagaccttatcgtccgcgccacgcctaccgtttcactattgaagaatccatttatgtggacgccagcatgaccggtcacggcattggcggcgcgctgatggatgcgctgatcgcgcgctgcgaagaaggcccgtggcggcagatgatcgccattgtcggcgacggccataataatgccggttccctgcgcctgcatgaaaaacacggctttaccgtggcaggccagctgcgcagcgtcggctataagaaaggtgactggcgggatacgttgattatgcagcgcccgctcaacgacggtgactggacgctgccggaataattaatcgttctgcgcggtttgctcgcctgcggcactgccgccgctgctgaccatttgcgccgctttctggcgcttataggccagcgccgccgccggtacaggctgcgctttaccggtttcgatccaggtgcgcagacggctggcatccgcaaagtgggtgtatttgccgaaggcatccatcaccaccagcgccacggatttgccgttaatcaccgtacgcatcaccaggcaatgacccgccgcattggtgaagccggttttggtcagctgaatattccagttatcgcggtataccagatggttggtattacggaacggcagcgtgtaggccgggctgctgaaggtcgccatctcttcccgcgtggtgcttaactgaccgagcagcggatactgtttggtcgccaccagcaagcgcgtcagatcccgcgccgtagagacattatggatcgacagccccgtcggctccacaaagcgcgtgttacgcattcccagggctttggctttggcgttcatcgcgcggataaaggcgtcatagccccccggataatggtgcgccaggctcgccgccgcgcggttctccgaggacatcaacgccagcagcagcatattcttacggctgatttcactgtttaagcgcacgcgggaatagatacctttcatctccggcgtatggctgatatccactttcagtttttcatccagcggcaggctggcgtccagcaccaccatcgccgtcatcagcttggtaatggacgcgatcggacgcaccagatcggggtgactggaatagatcacctcattggttttcagatcgacaatcatcgcgctgccggaggcaatttcgggctgggcagaagtcgcgactgcggaggttttcgccagcgcctgtggcatgacaggcacgctcagtaataacgcaaggcttaataaggaaacacggaatttcagcatggtgaggcttctgataattattcacgcacgtaataacgcgcaccgctaatgtcggcaattaaaaaataacaaaagctggctaaggcatgatagccgcccgttcgggttgtcgccacagaagaatcgttgcataaggttgcattgctggcattcacgccagcaatgcaattagctcagaacagccggtaaccgtagccccagaggatcaccgtcagcgccagcagcacttccagcaccagcacgccgatggcgagggtcgaaccggaaaagtttaggctttcttcacgattgatattgaggaaggtgggaatgccgacataaagcagataaccggtccacaacagcgccgcggtgcccaccagcgcgcacagccagaccagcggataaagcgcgacgataccgcttaaaaacagcggcgtggcgacataaccggcaaacaccatacagcgcgccagcgacggacgctgcggtatgttacgcgccatccagtaaatcacccggcccatcaccgccacccctgccagcatcagggcgtaaaacagaacgcccagataaaagccggtgaacagcgagagttgcatgacgttgccatcgccaaagtcccagccgatctgcgtggtgccgataaaggcgcagatcaccggaatggcggccatcagtaaaacgtggtgcgtatagtggtgcgaaaccgtttcgttttcgcgtttaattacctgcatttcacgatcgggatgggaaaagagtccccagacatggttcataacgcccccttgcagtcagccgaacgtcgaccctgtaagtataatgcatgaattggttattttttgagcgaaacgataagtctgataaatagtcagtcaacggacgttgcgatccggttcgcgtttgagggtgtatgctttaaaaaatggatgtaaacaatgagttgaatttgtcgtggatataaacggtctgatagcccagtacggctatgcggcgctggtgatcggcagcgtggcggaaggtgaaaccattaccctgctcggcggcgtggcggcccatcagggtttgcttcgtttctggctggtggtggcggcggtggcgctcggcggtatgattggcgaccagctgttgtacctgctcgggcggcgttacggcgagcgcattctgcgacgcttttcccgtcaccagaagaaaatcacccgcgcgcagaaactgatccagcggcggccttatctctttgtgatcggcacgcgctttatgtacggttttcgcattatcggcccgctactgattggcgcgagccgcctgccgccaaaagtctttctgccgctgaatattctgggggccattgtctgggcgctgattttcaccaccctgggctatgtgggcggcgaggtgataggaccctggctgcaccatctggatcagcatctgaagcatggggtgtggatcgttctggcgctggcgattgccctggcgctgcgttactggtttacccgccgtcgcgataaggacgacgaataagccgggctacggcccggcctgtaaagcttattttgcgttgaactgcgggttcgccagcataaagccgccatcgacgataaacgactggccggtggtgtagctcgactcttccgagcacagccagcccaccaggcttgcgatctcctgggttttaccagggcgggtcagggggacaatcggcagcgagccgtctttggcgtcttcgtcgtccatatcgttcattggcgtggcgatagcgccaggggcgacggcattaaccagaatacggtgatccaccagctccagcgccatggatttggtcagcccgcccagtgcatgtttggcggcggtgtaggcgctggcttccggcagcggggtgtgttcatgcactgaagtgatattcacgatgcgcccgccctgtccctgctccgccattttgcgcgcggcgatttgcgagcacagaaacgcgccatcgacatcaacggtaaacaccttacgccagtcgtcaaacgccacttcaaggaagggcgctttactcatcgccccggcgttattcaccagcgcatcaatacgaccgaaacgttcgatcagcgtgttgatggcctctgcaccttccggcaggtttcccagatcaaggtgcacatgttctgcgcgtcgccccagcgcctccacttccttagcggtggctttggcgccttcctcatcggaatgccaggtaataccaatatcgaagccctgcttagccagcaccagcgcgcactgtttgccgatacctgaatctgacgccgtaacgatggcaactttattcgtcgaaaccatgtagaactcctccgggaaatgagcctttagcggcaaagaggtaagtataggtaattcacgagggttaacaggctgatgcagaaacgatcttcgcgatcgaccaggcaaagctgccaatgtgtgcctaaacttattcgtgcaggcatatgactcttaaaaggaaaggacgatgaaaattttactatgggcggttttgattatttttctgattgggctgttggtggtgaccggcgtgtttaaaatgattttctgaaaattgcccccgttatgggggcaagtcatttataaagctactgaatctatcgccgccgcaatggcggccgaatgtttcaggatgcgcacctgttcaaagagcgcggtggcttcagcatattctttacgtaaatatcctaaccactgcttgatacgcgccacgtgatacagcccggtatcgccctgcttctcaagctggctgtagcgctgcaacagttgcaccacttccggccacggcatgcgcggcgcgttgtatttcaccacccggcttaagttcggcacattgagcgccccgcggccaatcatcaccgcatcgcagcccgttgccgccatgcaatcctgcgcgctttgccagtcccagatctcaccgttagccaccaccgggatggtcaggcgtttgcggatctcgccaatcgccgcccagttgatgcgctcggctttgtagccgtcttctttggtacggccatgcaccaccagctcgctggcccctgcctgctgcacggcatcggcgatttcaaactgtttatcgccggaatcccagccgagacggatttttaccgtcatcggcagatgcgcaggcaccgcttcgcgcatcgcttttgcgccccggtaaatgaggtcaggatctttcagtaaggtggccccgccgccgctgccgttcaccagccgcgacgggcagccgcagttgagatcgacgccccaggagcccagttcgacggcgcgggcggcgttttccgccagccattgcgggtattgtcccagtaactgcacgcgcaccggcgtgccgctgggggtacggctttgatgctgtaattccggacagattttatagaaggattttaccggcagtagctgatcgaccacgcgcaaaaattcggtgatgcagtgatcgtaatcgttcacgctggtcagcagctcacgcaccagcgaatcgagcacgccttccatcggagccagtaatacacgcataacaatacccaataattaagaggcgcgtatggtagcgtctctgtggcggggaggaaagaggccagccgccggagggcgggcggttttacgcctaatcttgtgtgaatgcataacgttaatctcaggattctttgttatgctcggctgcatgttgtgatcggtagcacatttcagattttaattgtatgatgaatgcatctcgtcaagggtagtcaccatgaataaatcactcattgttgtctggcaatatctgcgtgcgtttgtcctgatttatgcctgtctgtacgcgggtatctttatcgcctcgctgctgccgatcaccattccgggcagcattatcggcatgctgattatgttcctgctgctggcgctgcaaattctgccggcaaaatgggtgaaccccggctgctatgtattgatccgctatatggcgctgctgttcgtgcccattggcgtcggcgtgatgcaatattatgacgtgctgatcgcccagttcgggccggtagtggtctcctgcgccgtcagtacgctggtggtatttctggtggtcagctggagttcgcacattgtgcacggcgaacgcaaaatcgtcggtgagaaggagcagaaacaatgatggcttcgatctggtggtctttgccgctcacgctggcggtattcttcgcggcgcgcaaactggcgacccgttttcgtatcccgttactgaacccgctgctggtttccatggtggtgatcatcccttttctgctgctgaccggcattccttatgagcgttactttcagggcagtaaaattctcaacgatctgctgcaaccggcggtggtggcgctggcgtatcccttatacgaacagctgcatcagatccgcgcccgctggaaatccatcatcaccatctgttttgtcggcagcctggtggcgatgatcaccgggacatctattgcgctgctgatgggagcgacgccggaaatcgccgcctccatcctgccgaaatccgtgaccacgcccattgccatggcggtaggcggcagcctcggcggtattcccgccatcagcgccatgtgcgtgatttttgtcggtattctgggcgcggtgttcggccataccctgcttaatgtgatgcgtattcgcaccaaagcatcgcgcggcctggcgatgggtaccgcctcgcacgcgctgggcactgcccgctgcgccgagctggattatcaggagggcgcgttcagttcgctggcgctggtgatctgcggcattatcacctcgctgctggccccctttgtcttcccgctgatccttgcggtgatgggctaaaatttgcgatgcgtcgcgcatttttcatttgaatttcataagttgcatatacagtgtgatatgaatcacatataaaggcctgaccggcccgtaaactacgctcccattacactgttatgaggcaatgccatgcattcacgttttcacgctgctttcgcaagtctcgcggcggatctgcaatccgcgctggcgccggttctggcggatgagcacttccctgccctgctgaccgcggagcaggtcgccatgcttaaaaacgcaacgcgactggacgaagacgcactggctttcgcgctgttacccctcgccgcggcctgcgcacgcacgccggtgtcgcattttaacgtcggcgctattgcccgcggcgtcagcggcacctggtattttggcggcaatatggaatttatcggcgcgaccatgcagcaaacggtgcatgccgagcagagcgccatcagccatgcctggctgcgcggcgaaaaatctctcgcgtctgtcaccgttaactacaccccttgcggtcactgccgtcagtttatgaacgagctgaacagcggtctgtcactgcgtattaacctgccggggcgcgatccccatacgctggccgattacctgccggatgccttcgggccgaaggatctggagattaaaacgctgctgatggacgaagaaaatcacggctttgccgttaccggcgatgcgctgacgcaggcagccattactgcggcgaaccagagtcatgcgccttacagtcaggctccggccgggctggcgctggagtgtcgcgacggcacggtattctccggccgttacgccgagaacgccgcctttaacccgtcgctgccgccgttgcagggcgcgctgaacctgctcagcctgaatggttatgattacccggacattcagcgcgcggtgctggccgaaaaagccgatgcgaccctgacccagtgggacgccaccgccgccacgctgaaagccctgggctgccagaatatcgatcgcgtactgctggcctgatcccctttactgcggacgttcgcgtccgcagtgatgaaaatcttcgcaatcgaaccgccgtttcttgcgcaaaaccggcgcgtaaagtagcctgagtgaaatttcttcctttactgagctatctgcatgttgaagcgtttgttttacagcctgttagtcctcatcggcttgctgctgtttactgcgcttggactggaccgctggatcagctggaaaactgcgccttatatctacgacgatttgcaggatttgccctaccgacaggtgggggtggtgctcggtaccgccaaatattaccgcaccggcgtcatcaatcagtattaccgttaccgcattcagggagcgctcaacgcctataacagcggcaaggtgaattacctgttgctgagcggcgataacgcccagcagagctacaacgagccggtgaccatgcgtaaggatttgattgccggtggcgtcgatccgcaggatatcgtgctggattacgcgggcttccgtacgctggattccattgtgcgcacgcgtaaagtcttcgataccaacgactttattattatcacccagcgttttcactgcgagcgggcgctgtttatcgccctgcatatggggatccaggcgcagtgttatgccgtgccgtcgccgaaagatatgctgaccgtgcgcatccgtgaatttggcgcgcggctcggcgcgctggcggatctgtatgtcttcaaacgcgagccgcgtttccttgggccgctggtgcctattccgaacgtcagtgaaactactgacgacgcgcagggctatccggcggtgacgccggagcagctcagtgagcagctgagcaagcctaaaggccgttaggccgagatattatcggcccactcaatcgactgctgcatcgccccgataaccgtcgcctgatccagcttaaagctgtccagcagcgcgccggcgttatcccagtcctgttcctcgtaaagacgggccagcgtcaggaattgccagatcaccccttcgtgcttcgttaacgcgttcatgacgttctccggcagcagaatttgccggaacagatcttccatggaaatgcccagaatggtgtcgagcagcgagaacaggccgcagaaaaaggcatcgcccgaaagccgcgcgttgccggtttctttcgccatcagttcacagaacatgccgcgcaccaggctcatatgatagagctggtcggttttcacatccgccatattggtcaggcaggaaatggagacaaagcgccgcacttcgttaatgcctaaataaagcagcgtatccctgagggtggcgtttttacccagtacaatgccgcggtttttaaacagcacatttttggtgtaacgcatcagggtataggagagggtcaaatcacgcttgaggtaattctcaactttgaacatatcaggattaggggtgttcacttcctgaataagctgaagctgtaataccttaccgggggccaggcgcttgtttttgataatttccggcttactgtagaaataaccctgatataagtgaaaaccgaaggctttgtagcgttcaaattcctcggcggtttcgactttttccgccagcaattttaccttactgaggtgtttcttatgctggttgatgtactgggtaatttcttcaaaggagtaagcgcggatgtcgaacttcacaatgctgatgtacggcataaagcgttcccagccgttctccagcgtaaagtcatccagcgcaatcttgaagccccagccaaacagacgacgcaccgcgtcaaagagctcatcggtgggttttgccgtttcgaggatttcgatcaccactttgtcatgaggcagcgtatccgcaaagccctggacgatcatctccggcgggaaattgataaaacagttattattgccgaccagcttgggtagtgaggtcgagagaaacagatcggagatgatctgtctggtggcgtattccggcgagacatccggaaaccgattcgtcatgccgtcgcgaaagagcaactcataggcgaccgtcgacatgttcttgtcaaataccggttgccgggcgatgaatgaatacatgagattgcctccatggcgtatacgcattgacggaaatgaatgtcgcgatccgccctcttaaaacctgttttatcttataccatgatttggcaatttattcccggcacgcacggtgaccagctttaatagtaatagcatagtctggcagctttaaacgcgcctcgttaaacatctcacctatactgatggcaggatttacaaaacatgacgaattagtacgttttccattttgcatggagaggctatgaaaatcaggtcatcatcttccacacccccttcccattcacaacccgtatcggaaaatgcgttctggctgaattttgaagcgaatgcccgacgctacggcttttttctgctgctgttaatcgtcatcgcggcgctgtgcggcgcgttttctaagggctggctcagccaccagcaacgtaccacggcggacggcggcctgacgctggagtatgagcgctttaaccggctgatgagcgatgcggaaatgaaaattgtcgtccatgcaggcacccgtaaagaggtcactgtggtgctgggaggggattttatggaaaccttccagattaccaccctccagccgcagcccgatcgtatgcaggcgcagaacaaccggctggtgctgagctggtcacgcgacgcgcttccggcagaccatgccatctggctgggcgtgcagcctttgcagtggggccaaagccaaagcacggtagctgtggatcaggggccctctctccccttctggcaatttatttacccgtaggagcttgtcatggatatggttttaagagcgattgctatctatctgatcctggtggtggtcttcaagatcgccggacggcgggcgctgctgcaaatgacctcgtttgatttgattttactgctcatcatcagcgaagcgacccagcaggcgctgctcggtaatgacttttccgtgactggggcggccctgaccatcattacgctggtggtggtggacattctgtttggcttactgaaaaaatatctgccgtccgtggaagcggctattgacggtacgccggtgatcctcgtcgaaaacgggcgactgctggaagcgaaaatgaagaaagcagatatttcctgtgctgatattatagtgtccgcccgcaataaccacggcattgataagttgtcggatattaaattcgctattcttgaacaaaacgggcacatctcgattattccgctgtcagagtcttcataaaggccgacaggcacatcttaaggttaccttaagctgataagcactatacttactgaggctttaacattatttttacactgagccagcaagaaggggcctcaccattgacagaatagccaaaatcgcactgcgtcgccggggcattggcgtaagagaaaaaattgttcgctatcgcggtcagtcggtcttattccggctgaacggcgaggcgtatgatgtgtataccaacgaagaaaagatcgcttctcttgaaaccaataatattaacgaagccatccagctgtataaaattttagaagcgaaacattaagttgccgggtggcggttaattgcaggcccggcaaacagagccataaaaaaacccacgctaacgtgggttttttgtttaagccggtacttattttttgcgcgcgtacttcagggagtccagcgccacggcgaagatgatgatgccgcctttaataatgtactgccagtacgggttcacgccgatataggtcaggccatagttgatgacggtaaagatgatcacaccggtcaccacgccaaacaccgtacccacgccgccgctgaaggagacgccgcccaccacgcaggctgcgatggcgtccagctcatacataaagccgaggttgttggttgcagagccgatacgccccgcttccagcatcccgccgaaggcgtagaacacgccggacagggcatagatcatcagcaggttcagcgccacgttcacgccggagacttttgccgcttccgggttgccgccgatagcaaaaatgtttttgccgaagcgggttttgttccacagcacccagacgaaggccacggcgatcagcgcgtagaaggtgatgtaggacagacggaaggtgccgagcgccacaaagccctgggtaaaggtcgagaagccgctgtcaaagccggaaatcggcgacgcgcccacgaagtcgtagtacagggagttgatgccgtacacgatgatcatggtgccgagggtggtgataaacggcgttacgttcaggtacgcaatgataatgccgttgataaggccgatgatcgcgccaatcacgcagacgatagccacaacagcaataatcggcatggtcgccatttccgggaacaccttgttggcgttctccatcgactgcaacagcgtcgccgcgaccaccgccgccagaccgacctgacgaccagccgacaggtcagtaccctgggtgacgatcagccctgccacgcccagcgcgatgataatacgcactgaggactgggtaagaatgttacttaagttcagcaggcttaagaaggttggatcctggaaaataataatggccagtaacactaaaagaacgacgtaaataccgccctctttcagataagtgagaaagctttttttatttaacgcactcatgaggagcccctgatcttaaaggtgcaaagacgcaagacgcaaaatttcgttttgcgttgtcgttttagtgtcaacaattccggaaacgaggccattgctcattaccagaatacggtcagtgatccctaacaattccggcatttcagacgaaatgataatgatccctttgcctttcttagccagctctgcaatcaactggtaaatttcaaatttcgcacctacgtcgataccgcgcgtcggttcatcgagcatcaggatttccggctgggtcagcaaccagcggccgataatgactttctgctggttaccaccggagagggaaccaatctgcgtgcgatgacccggcgttttaacgcgcatggcgtcaattacccactgggtatcgctcttcatgcgggagttatccagcagaccgactttgtttttgtagttctgaatattggaaataagtgagttaaatccaatgtccagataggcgtaaatgcccgttgagcggcgctcttccgtcaccagcgcaaagccgttattaatggcttcgttagcggtgtggttattaatcggcttatcgtgcagcttaatggtaccggatgatttttcgcggataccaaacagggtttccacaatatcggtacgcttcgcccccaccagcccggcaataccgaggatttcgcctttacgcagatcgaaagagacatcgcgaatggaaggctgccgcagtgaggtcaggttgcgcacttccagaatggtttcgccagggacgttttgtttgtccgggaaacgctggttcagcgagcggcccaccatcatggcgatgatcttgtccatatccagcccttccagcggctgggtggcaatccactgtccgtcgcgcagaatggtgatttcatcacacagctggaagatctcttccattttgtgcgagatatagacgatgccgcagccgcgatctttcagcttgcggataattttgaacagatgattaacttctttttccgtcagcgatgaggtcggttcatccatgatgacgattttggcgtcataggagaacgctttagcgatctcaatcatctgcatttgcgaaacagataaggtaccgacgcgcgctttcgggtcaatatcaatatccagttcgtcgaaaatatctttggtgtctttatacattttgtcctgatcgacaaacacgcctttggtgggataacgccccagccacatgttgtccattacagaacgctgtaataccaggtttaattcctggtgaaccatagagataccgttttccagtgcttctttagttgaatggaaatcgatctctttcccctgaaaaagaatgctgccggaatctttttgatagatcccaaaaaggcattttaacaatgtggatttgcccgccccgttctcacccattaatgcatggatggaatgtggacgaacttttaaattcacattatcgagcgccttaacgccaggaaacgacttgttgataccgctcatttccaacaagaattcgcctgacgactgagtagtattgctgaccatatttataccttgttggcctggcacatcgcgttataaaagggcgcaaattaatgcgcccagtggaaccttcttatttgttgctgaactgagagaggttttctttatcaacaccaacgtaaggaatacggacaactttattgtcgagtttccagttggtgccggcagtggcttctttaccgtcggccaggtttttcgccagatcgaaggtggctttcgcctggttgttggcatcgttcagaacggtaccggccagcgcgccagatttaaccagtgccagcgcttctggcagggcatccacgccaaataccggcactgctgatttgttgtgggctttcagcgcttctaccgcgcccattgccatcgcatcgttgttggcgataaccacttcgattttgttagcgttcgggccagagagccacgcgtccattttgtctttcgccattgcggtatcccacatggcggtatccatttgcagctgctgggttttgatgcccttgtcattcagctctttgataacgtaagtggtacgtgcttcagcatccgggtggcccggctcgcctttcagcagcacgaactggatctggccgtctttgttcagatcccagccctggttagccgcccagtgtttggcaatcagatcgccctggataataccggactctttagagtcagtaccgacgtaataagctttgtcgtagctgtccagcgctttacgtgaaggttctttgttgtagaaaacgataggaacgttttgaccacgtgctttttcgataaccgtgcccgccgctgccgggtcaaccaggttaatagccagggctttcacgccttttgccagcagaacgtcgatctggtcgttctgtttggactggtcgttctgcgagtcgttcatcagcagttcaacgccctgcgcttctttagcatctttctcaattgctttacgtacaacagacatgaagttgtcgtcgtatttataaatggtcacaccaatgcgggtatccgcagcatttgcagccgcgccaaaaagcatgcttgccataacagcagacagagtcaaaaccttcttattcatggtatctccgggtttatgcagggtagttcttgtgaataatgatcggcaggacagcaggttggtgaaacgttactgtcgccgaaggtcacttaaaattattttcttccgtgttcggtaacgctccagaattcgaacggttcgtcgttttggggccacggtacgacgaattagcttcattaccgttacatgatgtttcagcccctggaacgctgacatcatagacatggcgatgttaagatactgtgaatttactcacagattgaaaacggttacatacaacatcgttataagttagtgatcggcgacacagtttgccgcaccgccacggaatgacggcgtaccagcgtgggcataaagcaatgagaatcagcaggatccagcattcccgccgcgccctgcagggccagctccgtcgccagtttcgccatagaggctatcggataacgcaccgtggtgagctgcggatcggtgtagcgggcaatgggaatatcatcgaagccaatgagtgataaatgctgcggcaccgcaatgccattatctttcagcgccgtcagcgccccggcggccatgctgtcgttataggcaaaaacggcggtgagttgcaggttgcggcccagcagttccaccatcgccgcctccccgccctgcatgtccggctcgccggtgccgatccagttctccggggccacaatcccctgctctgccagcgcccgctgccagccttcacgacgtaagtcgttgtcttcaatctgatgtctggacgccagatagccgatgcgctgatgaccctggctcagcatcatgcgcgtggccatcatcgccccgctgacgttatccagcgccacgcagcgatgggcatagcccggcaccacgcggttgattaataccataccggggatctgctccataaaaccggccagctcttcatcacttaaggcttttgagtgcacaatcagggcgttacagcgctgacgtatcagcacctcaatggcatgacgctctttttcagcttcatgataactgttgccgatcagcacatatttttgatgctgttgggcgaccatatccaccgctttgaccagcgcgccgaagaaggcatcggagacatccatcaccaccacgccaatggtatcgctgacctgcgtcgccagcgcctgggcgttggcattcgggcgatagcccagctgcgccacggctttcatgacggtttcacgcgtatcagggctgaccagcgcgctgttattcagcacacgggaaaccgtcgcgacggaaacggccgcaaggcgggccacgtcacgaatggtgatcatagatattttcctttctcaggttgcaacagctcacagacaccccctgtgttaagcaagggggtattctgtcaggcagagcggacaaccagcgtgaaggacatcacacagatggaaacggttacatccgttttgttaatgattgtgatccagatcgttatctggatgtatgggacaatgaaacgcctgacgcccgcgcggtaagctgacgccacagccattccaccggtccctgacggaagcggcgcaaccagcagaccgagagcaacagattaacggcccagatgaatggcacaaaggccagcagttgcagacggtcaaatttcataaacagccccagctgataaaacagcgtggtgcatatcaaagtttgcagcagatagttagtgagcgccatgcggccgacgcaggccaccgcatgcaccagcttcaggcggcttaactgcggccagtagccataggccagcgcagcataccccagggtttgcagcggcgcgctcagttcgcgtggtacctgcagaaagaaggcgcaccagcgataatcccagccgagctgccactggacgagggttgacggaaggttgatcaacaggccgaccgcaatcaataccagggcggtgcggcgataatgacgcaggctgaactgcccttttaaccagccgctgcgcatcagcgccgcgcccaccagcatcagccccgccagctgccagccatactgcgcgccgatggcgagcagcgtgtcggacagcatatccgcccggttgccgatagcttccagaccgccggtggttttccaccaggcttcatattgcaggttagccgcatcggggatccaggcgcggttcggctcattgccggcgataaatcccagcagcaacagcaccgcaataccgatgagatagagcgccacgccggtgttaaacagcgttttcagggatgccgcatcgcgtatcatgcgccagcacaccagcccgaccaggccataggcgagcaaaatatccccgtcccagaacagcagcccgtggataaatcccagcagcaccagcagcgttaagcgacactggatccagcgcttgccccgcccctgcaacagttgcagcccggcgccgaacagaatggcaaataaagagaggaatttcgcctgcgcgaagatgtccagcagtgcccaggtccaggcgtcccgcgaggtgatctcgccataccaggccgcattcagataagccgcctttggtaaaccaaaggcgttaatattcagcagtaaaatacccagaatggcaacgccacgaatgaaatccagcgtgacatgacgttccatggggtttgcctgcctcaattattgtgatgacgcacagcgcgcaggaactcctggcgggtgttctggctggatttgaataacccgcccagcgaggtggtggtagtggcgctggtggcatcgcgaatgccgcgcgctttaacgcagtaatgcaccgcatcaatagacacagccacattgttggtgccaagcagcgtttgcagggcgatgaggatctgctgggttaagcgctcctgcacctgcggacgttgggcaaaaaactgcacaatgcggttaattttggacaggccgatcaccgcatctttcgggatataggccacggtcgctttgccgtcgatgatcacaaaatggtgctcgcaggtgctggtcagcgtgatgtcacgcaccgtcaccatctcgtcgactttcattttgttttcaataacggtgatcttcgggaaattggcgtaatcgaggccggagaagatctcatcgacgtacattttggcgatacgctgcggggtttccatcaggctgtcgtcgctcagatcgagatttaacagttgcatgatctcggtcatatgcccggcaatcaggcgtttacgggtttcgttgtccaggtcggccggtgcgcgcagcggggtttccaggccgcgggcgacaagggcttcatgaaccagcgcggcttctttactcagtgatggcatctctttattctcctgcaggtgtcgctacctttgccgctcagcaggcaaagtgcgcagtcattgtgcgtgaggtcacgcacataatccagtgtattcaccgcgataattagtgaaatcgttacggcctttcatgctgacgtttccacaccagcccgccgccgataaacagcgccgcccccgccaggccaagggcaggctccagctgatgcgtcagccaggtggagagcgcagaggtcatcgggccgaccagttgtccgatggcgtaaccggtggtcagcagcccggccatatagcgcgcatgggccggagccagttcacgaccacagaccagcgacagctgcaccgcgcagagaaaaccgccgcccaccagcagcgccccgctcaccagccccgccatacccggcagcagccaggcggcaatcacgcccgcgccctgtaaccacagcaccaccgccagacgctgatggctgtgtccgacatgacgtaaggcgatgctgagcgcaatgccgatcaccgccgccgcgccgaacaccggccagacaaactgggcgaagacgctgccggggaagcgctgcgccgccatctgcgataaaaaggtagccggaaggatgtagccaaagcccgcgagactgtagctccagaccagccgtttaatatcggcggtgagctgtaacggctgcggtttgtcgccgctgcggtgtaactgtcccggtcgcggcagccagcgggcgatgaacgcgatcaataccagcgccagcacgccgtacacctgccagcccgctgaggcggacagcgcctttgactggatgccgatggccagcagaccgctcagggcgatacctgcccccggcccggcaaacaccgccgcgttcaggcccggtttgcccgcatgggccagctggtcggtgatccaggctgcggtcagcaccatcgcccagccgctcatcatgccgatcaccagccgcagcagaccgtgtgcaatggcggtatccgccagcgcggaaagaaaagtcagcgccaccgccccgaacacaccggcatacagacggctttccacgtgccggtgcgcgcgcatggcatcccatgcgccaagcagataaccgagatagttcatggcggccaccagcccggcgctggtcagactgagctgaccgtcgcggatcattagcggtacctgcggcgtaaaggcgaagcggccaattcccatcgccacaatcagcaccacaaatccactgagcgcaattctgagcgccatggttatcccgtaagttaatgtaaagttgtgtttatgatgcaatatgttgcagggatgcggaagtgaaagttactcacagcaaagtgaatgcctgtatgatgatgccttcattctgagtatgacgagtagaggaacttcgcatggaaatgcttgaagaacatcgttgttttgacggctggcagcagcgctggcgtcatcactccgccgtactgaactgtacgatgacgttcagcgtgtttttaccgcctgaacgccgggaaacgccgccgccggtgctctactggctctccggcctgacctgtaatgacgagaatttcaccaccaaagccggggcgcagcgcgtggcggcagagctggggattgtgctggtgatgccggataccagtccgcgcggcgaggatgttgccgacagcgagagctatgatctgggcaaaggcgcaggtttttatctgaacgccacgcagcagccgtgggcggcgcattaccggatgtatgattatctgcgtgatgagctgccggatcttatccgtgagcagttcaacgtcagcgatcgctgcgccatcagcggacattcgatgggcggtcacggggcgctgatcatggcgctgaaaaatccgggccgttataccagcgtgtcggcctttgcgcctattgtgaatccctgccaggtgccctgggggcagaaagccttcagcgcctatcttggggataatcctgccgactggcaggcgtgggacagctgtgcgctgatgctgaacagcaagccggatgatgcgatcccgacgcttatcgatcagggcgacagcgatcagtttctggccgatcagctacagcctgcccgccttgcggaagccgcccgtcagaccggctggccgctgaccctgcgcgtgcagccaggccacgatcatagctattactttattgcgtcctttattgaggatcatctgcgcttccatgcgcagcatttattgaagtgacgttttgcccggcggcgcaagcttgccgggcctacaaatctgtccgtaggccgggtaaggcgcagccgccacccggcacccggcacccggcacccccatcagaaccggtaatccaccgccataaagtaacgacgtccgtcttcgttatagctgtagtcgtcgcggctgagatctttatccatcaggttcagcacacccgcacgcagcttgacgtttttcgtcgcctgccacgcaccgccggtattccagatcacatagccgcccggcgtggtgccggtggcgctgatattgcgtttttcgccactgtaattcccggacacatagaatgaccagtcctgcaccggctgccagtccagggtaccattagccgtatggaacggcagctcctgcaacggcgtattgccgccgttactcagatcgcgcccgtcgttataggtgtaattcagcgtcagcttccactgatcgtcaaacggcactttcagctcggtttccaccccgcggatacgcgccttgttaacgttgtaatagcggaaaatcggttcaccatcggcattcagaccgacgtagttcgggtagccctgcgccgcgttgacgtcggccgtacggctgatgctgatacgatcttccacgtcattctggaaggtagtgatgctcgcctgcacgccttccagccagccctcttccccggcgtaatacagaccgaattcgtagctttcgctggtttccggcttcagatgcgggctgccgacgatttcgcacgcgccgcggcaggagccggtgacccagtccgggctgagctgtaacagcgatggcgctttgaaggctttcgcccagccgcctttcaccgtcagcgtgtcggtagcgttgtacaccagataagcacgcgggctccagtgatcgccataggtctcgtgatcgtccatacgcacgccggtggtcagcgccagcggctcaaggagacgccattcatcttcaacaaagagtgcgtactgactggtggaggtttcgctgctactgctgccggtaatgttgacgggatctttcagcttatcgtgccgccattcaccgccaaaggtgacgaactgattaatcgcctccaccggcagcacgtatttgccgtcgatggtgttgctttcagaggtgatggtgtggctgttgccggggtttttgttatcgactttctcgccgtaatatttcagctcgctgttacccagatcccagcgtccgttgtggctcagggagaagttctgccgctccaggcggttctggtcgagggagtcggagctgcgatcctggcggtcaaaaccataaccggcagtgaaatcgtgattgtcattcggcgtccaggcgaactccacgttcgcatcgcggctggtaaagccttcaattcgcggcgtttcgcctgtggcagccgtgtctgagggttccgctttatctttttcgcgtttcgccacgctgccgaacgctttcatgccgagcacgccgtcaatcagcgggccgctggtgaagaactgaccgttccaggtatcgccgcgatcgcgtttttcctgaatagtggtgtcggcggtgaggctaccggtccactgttgaccaatttttttggtgatgatgttgaccaccccgccgagggcatctgaaccatacagcgacgacatcggtccgcgtaccacttcgatgcgctcaatggcatccaccgggatccagttcaggtcgaaatcattgtgacggaatacggcgttgcgggaattcacgcgtttaccgtcgaccaggatcagcgtgtagctgctgtcgaggccgcgaatgctgacgcctttgcggttatcgccttcgttggtgagctgtacgccgggtacttcctgcagtacatctttgaggttctgtaccggcctgcgttgcagatcctgctgcgtgatcacgctgatgctggccggcgcgtctttcacattctgctcggtggcagcggcagtgaccaccatggtttcactggcaaaggctggcagcgcgagtgaaattgcggacgcacagagtcctccccgcacgacgggattcagggtaaacattccaaattctccatgaactaaatacagcaaataaaaaagaagttgctcacaatgcgcagattcccgcccgctacggtggcgaaggcggtgataataatgcaggtgacccgccgcgttacgccgggtttttatcattctgaaaacgagcgtaacgataatgcaaacaataacaattatcaattgaattgttaaaagttatgtcaatatgggagattaaggagaagggatagcaaagaaaaggccgggtggcgcaagccccacccggcctgataacatcgattacttcttaacgcgttccgggaattccatctcgcgatagctgacgaacttagtaccgcgactcagtttgtagccaaaccagatgatcaggaacagcggaataccgatataggtcgccgccacgccgccccagtcaatggtatctgacaggaaggcttcgtaattctgaccgagggtgatgataaggcacagcacaaaggcgaagattggccccaacgggaagaaaccggaacggtacggcagttcgctcagatcgcgcccctgcacctcatatccacgacggaagcggtaatggctgatggcaatgccgagccatgcgataaagccggtcatgccagaggtgttcagcagccacaggtaaacggtctggttaccaaacatggaggtcaggaaacagagtccggcgatcaccgtagtggcatagagcgcattacgcggcaccccgcccttcgacagcttgctgaaaatgcgcggcgctttgccgtcacaggccagggtatagagcatacgggttgacgcgtacatgccggagttacccgccgacagcaccgccgtcaggatcaccgcattcatgatcgccgccgccgacagcaggcccgcatgctggaacaccagggtgaacgggctgacgctgatgtctttcacatcgttacgcagcaggctcggatcggtgtacggaataatcaggctgatcaccagaatggcgaacacatagaacagcaggatacgccagaacacctgacgcaccgcgcgcgggatgttcttctcaggatcttcggattcaccggcggcaatgccgatcagttcggtgccctggaaggagaagccgacgatcatcgccacgccaatcatggcagcgaaaccgcccgcgaacggcgcttcgccgatgccccagttgctccagcccgcaggctctgcgccctggaagataccgaaaatcatcatcacgccgacaataataaagatgatgacggtggcgactttaattaaggagaaccagtattccgcttcgccgaagccttttaccgagatccagttgaggaggaaaatcacgcacaggaagagcgcgctccagatccagcctggcgtatccgggaaccaccagctcatcaccagctgcgccgccacaaggtcaacggcgatggtcaccgcccagttgtaccagtagttccagcccagcgcgaagccgaagccttcttcgacgtatttctggccgtaggtggcaaaagagccggaaaccggcatataggctgccagctcgcccagactggtcatcaggaaatagaccatcaggccgatcaaaatataggagaacagtgcgccgcccggccctgcctgggagatggtcgcgcctgatgcaacaaacaagcctgtgccgatagaaccgccaatggcgatcatcgtcaggtgacgcgccttgagttcacgacggagcgtgggcgcttgtgtggttttagattcggaaaccatgggaaaatgctgtccttccaaaaaatgaggccggattgtagcagaccagacggcatccttccggcacaaatgcgctgttataagagaccttcatgaccggccctggattataagtaaagcagtggatgggccgcttttcgataataaaatgcaatgacgctattcaccgcaataacgcaaaaaccgcttcagggcgctggagagatgtttttgccggtgatgaatacgccacagcgtgcgtaccaggcgcggcagcgggatcggcacttcaaccagcgagccggagtcgagctgctcggcgatcacccgccgggataaacagctgatgcccagcccgtggcgcaccgcatgtttaatggcttcggaattgcccagctccattgccagctgaaactgcggcaaatgtgacagcagcagataatccaccagctcgcgggtgccggagccgcgttcgcgcaggatccagggcgcggccgccagctgttccagcgtcacgtcatgctttaacaatggcgatgatggcgcggcaaagaccaccagctcgtcctcaagccagggttcggcgatgatttccgccgtgtggcatggcccttcgataagcccaatatccacgcgaaaatccgccacggcgttgatcacctcctggctgttaccgacgctcatctccagcggcagatcgggaaaatcacggcgatagcgggcgatcacttccgggagaatatagttgccgatggtgctgctggcagacacgcggatcgcgccgttatcctcgcggaacagctgctcgatctctgtggcctgctccagcagcgccagcgcacggggatacagcagccgtccgtgctcattgaccaccagccgtttgccgacgcgatcgaacagctgtacgccgagctgcccttccagatcgcttaacgccgcgctgaccgccgactgggataaggccagcatttgcgaggcctgggttgtcgagccacttttcagcacttccacaaatacggccagttgccgcaacgtaatatgcatggttcaccgcatccggtaaggcattgcttaccacttataaagattaattataaatatataatcaattttatttttaagccagcagcccttacgctttgtccacacaaaggagagaggttatgactgagcttaccttacacacgcattcttcatttcaacgttatgcgcccggccttgcgctgagcgcgctggtggcgggctttgccctgtgggttggcggcattccggccatcgcgggggccggattcagcgccctgacgctggcgatcctcgtcgggatgcttctcggcaacacgctttacccgcaggccgcgcaccattgtgataccggcgtgctgttcgcgaaacagcatttattacggctggggattattttgtacggcttccggctgaccttctcgcagatcgccgatgtcggcatcagcgggatcatcattgacgccctcaccctttccagcaccttcgcgctggcctgttttctgggacaaaaagttttcgggctggataaacagaccagctggctgataggcgcgggcagcagcatttgcggcgcggcggcagtgctggcaaccgaaccggtggtaaaagcgcaggccagtaaagttactgttgccgtggcgacggtggtcattttcgggacgctggcgatcttcctttatccggcggtctatccgctgctgaacacggttttcagcccggaagcctacggcgtttatatgggctcgaccatacatgaagtggcgcaggtggtggctgccggtcatgcggttggcccggaagccgaaaacgctgcggtgatcgcaaaaatgctgcgcgtgatgatgctggcccccttcctgatcctgctggcaatgcgcgtcaaacgcctcgctccggcagatgataaccagcgcagcaagatcaccatcccgtggttcgccgtgctgtttatcgtggtggcgggttttaactccttcagtctgttgcccgctgcgctggtgcaggcgctggtcacgctggataccgtactgctggccatggcgatggcagcgctcggcctgaccacccacgtcagcgccctaaaaagcgccggggtgaaacctctgctgatggcgctggcgctgtttgtctggctgattgtcggcggcgggatgattaacctggcggtggaggcgctgactaaataaattcctggtttggcgaaagggtgatgcatctccggatccgggacgggtgatgaggtaaaacatcaccctcttccacttacagggtaaaaaaaatgaaagggaatttttgcggtatcaataactttaagccaggccaaagaacgcgggatgcactggcggaagtggatcggatcacacgctcggcaaatatcctcacttatttactttccgccgtgccgctattccagtttttcgcggggcgcagtagctatctcggcagcagcgtttttagtagcagttataacatcagcacttatgactggagcaaacttgccaatgcgctttcgagcgtggataaggttaagcgagagcaacttgagatactcgcatggaatatgaaggaacagacatcctcggaagaaagcaagttttgggagtgtgtttataatgcgctttaaaagcagaaccgtgctctggttagcctgttgcctttatatatctccggtcttcggtggtttgtctcacattgaaaaactcactcaggaaacaaccactgcccggcaggtacttgaacaccaatacggactatgcagagcattgcgcgatcgcgaagtgaactattttgacttctggcttcaggcgcaacgccgggacgttaaagtcaaaatgctcagggagctttcggaaattgctttcaataactgtattaaaccgcagtccgatgcctatacccttatagttgtgcgccttgcggccatcagcaaagataaaagtaagctggaggagtggcttgatctctatcctgaagataatcgtgatgattttacgcaaaccgcgataccggaatatgtttacgagcagcagcttcagcggcttagtcagtcacccacctttcatttcccctttaatccaatggacgcatctaacaccattattcatggcgacgaaaaaaaattaatggaaaccctcagtgaaaccgttataagagaaccctatatccagggacttatcccgcccctgtaatggctgcggccctcacaaccataaccccccatgtaaaattcctgttaacccgttatcatagcgtttttgcccggccgggtttgccaggagtttttatgaaatacattggagcgcatgtcagcgccgcgggcggtgtcgccaatgccgcaatgcgagcggcggaaatcggggccacggcctttgcgctgttcaccaaaaatcagcgtcagtggcgcgccgcaccactgaccagcgacactattgatgactttaaagccgcctgcgaaaaatacggctacacctcagcgcagatcctgccgcacgacagctacctgatcaatctggggcatccggtgagtgaagcgctggaaaaatcccgcgaggcgtttcttgatgaagtgacccgctgccagcagctcggcctgagcctgctgaactttcaccccggcagtcatctgatgcagatcccggaagaggaatgcctggcgcgcatcgccgagtcgatcaatatcgtgctggataagacggaaggcgtcaccgcggtgatcgaaaacaccgccggtcagggcagtaatctgggctttaagtttgaacatctggcggcgatcatcgacggcgtggaagataaatcccgcgtcggcgtctgtattgatacctgccatgcctttgccgccggttacgatctgcgaagctttgcagagtgtgaaaaaaccttcacagaatttgagcgcattgtcggctttaaatatctgcgcggtatgcacctgaacgatgcgaaaagcgcgtttgccagccgcgttgaccgtcaccatagcctgggcgaaggcaatatcggtcatgaggcgtttcgctggatcatgcaggatgcgcgcttcgacggcatcccgatggtgctggaaaccgtcaaccctgatatctgggcagaagagatcgcctggctgaaagcgcagcagtatagcgaagtgaccgcataaaaaaaggacagcctgggctgtcctttttgcatacctcatcagggcgatgcaggccgggtaagctttgcgccacccggcaactcgtcctcaggcgactttctcagccaccaccgtttccggacgtttcaggaaggcgtaagccagaccagccagcagggtaccggcaataatcgccagcagataacccactaccggtgtgattgcgcccgggatcagcagtacgaacagaccgccgtgcggcgccatcagcttcgcgccaaccgccatcgagatagcgccggtcaccgcgccgcccacgatacagcatgggatcacgcgcatcggatcacgggccgcgaacgggatcgcgccttcagagataaagcacagaccgagcaccagcgcggctttgcccccttcctgctgacctttgtcgaactttttacgggcaatcagggtggccacacccatcgccagcggcggcaccataccggcggccataatggcagccataggcgcgtaagtctgggtactcagcaggcccacaccaaaggcgtatgccgctttgttcaccgggccgcccatatcggtacacatcataccgccgaggatcgcgcccagcagaaccgcgttagcggtgcccatggtttgcagccagtgggtcagacccgtcaggatgcccgcgaccggtttgccgatcaggtagatcatcgccaggccaaccaccaggctggagaacagcggaatgatcaggatcggtttcagcgcttccatgctcggcggcagcttcagtttctggctgatggctttcgccacataaccggcaataaagcctgcgatgataccgccaataaagccggagccggtgcttaccgccagcataccgccgatcagacccggcgtcaggcccggacggtcagcgatggagaacgcaatgtaacctgccagtaccggcaccatcagcgcgaaggctgaaccaccaccgatttgcatcagcgcggcggcaagggtatccggcgttttgaaggcttctataccaaacgcaaaggagagcgcgatacacagaccgcccgccactaccatcggcagcatgtaggacacgccggtcagcaggtgacgataagcaccgccgccctctttcttgccttcgcttgccgcctgcggtttacccgacggttgatacggcttcgcttccgcctgggctttatccagttcctgcgcggttttcttcagcgccagaccggtcgaggtgcggtacatcggcttaccagcgaatttcgccagatccacttcgatgtcggccgccacgatcaccagatccgcttccgccacttcttccggggtgatggcattgcccgcgcccacagagccgcgggtttccactttcacccaccagccgcgttttttggcttcggtttctatggcttccgccgccataaaggtgtgcgccacgcccgtcggacaggcggtaaccgccactacgcgcttcacgccgccggttgcagcgggtgcagcctcggccactggcgcgctgtacggcgcggcgtggtttttggcttcacttaaaaacagctccgggtgggccacggcgcgattgatatcgcccagccacacttttttgccgttcagcgcgctgtcgtccggcacgcgggttcctaatacaatagccagttctgcatcatgcggattgtcgatgatttcgacattggctttttgcgccgccactcccaacaaggttttcgccatgtaagcgcgggcctggccgagactggagtcaattatcagcagcgttttcattatgctctcctgctgttagttaaagggttttaagtcaacgcgcgccatcatcgcggccaactgggtacggtcggtaatgccgacgttgctctggctgacagccagggctgcgacggcggtagcaagacgtaatgtatgctcactggattcacgcatcagcaggccataaatcaggccgccaaccattgaatcccctgcgccaacggtgctgaccacttccattgacggcggtttggcgatccattcgccagaggcgttaacccacaacgccccttcagcgcccagagaaatcaccacatgggcgatgccctgctcacgaagtgcatgcgccgcttcgataacatctttcagttccggtaatttacgaccggcccagatttccagctcgcggcggtttggtttaaccagccagggcgcggctttcagaccggccaccagcgcttcgcggctgctgtcaaaaatgatgcacggacactggctgcgcaggcgcgtcatccagtcggtgaaggcttccgggctgacgccagccggcaggctgccgctcacgcaaaccatgtcgaactggcccagccagctcagggaatccgcaacgaaacgctcccagtccgccggggtgacatcaaagccggagaagttaaagtcggtcacttcgccgtctttttcggtcagcttgacgttgatacgcgtacggccctgcaccacctgaaaacggttggcgatacctaattcgctgaacaactgctgaaagccgtcctggttatctttaccgaggaagccgccaacggtgacatcgatgccaaggtctttcagcaccttagccacgttaatgcctttacctgccgcatgcagaccggtagtccgcaccaggttgacttcgccgcgctccacttccggggtgtaacccaccagatcgtaagccgggttaagagtgatagtcgcaacacgtctgctcattatgcgccctccccaagaccagccgcgatggcgtcgccaatcgctttcagcgcctgttcagcatcttcgccctgtgcggtaaagcgcaggcgatggccttttttcacgcccagcgccaccactttcatcaggctgcggccattggccggtttgccgctgccgtcgaggttggtgacggtcacgtcgcagttaaactgcttgatggtgttgaccagcatggtgcccggacgggcatgcagaccgtgttcgttacgcaccacgaactccgcgctcagcacgtcttccgccagcgcgtcgtcgctggtcagcagtgccagcagcgtggcggcatccgccgtcagcagacggtcagctttattgttcagcagcagatccgtcagacggttgagcacggcgaccggctggtcgtcggccatcgccacgctgatcaacagctgggcgttttcaccgtcaacggtaaaggcgctggcggcgcggcttactgcaatggcgctgccgaggttgccttcggcgctgtcgttcagccatacaccctggccgaggttcagcggtttttcattaatggcgcgggtcacaaaagcggtgtcaacggcaccggcctctttcagacgtccggcgtttacggcctggagagttacaatatcgctggcagtgatgtcgagcgtcagcaaatcgttatccagcttcagcgcttcactctgtttttcacccatcagcagggcgcgaagctcttcagtcgtggtggcagactgcaactgcgccgccaccgcatcgtcgcttaacacgtgcgtcagctgacgcagcaggccgagatgttcgtcagaactggcggcgatgccaatagcgacgtaagccacctgcccttcgccccacagtacgccctgcgggaactgataaacctgaacgccggttttcagcacctgatcgcgggtatctgtcgtgccgtgcgggatggcgatgccattgccgaggaaggtggaggtttgctgctcgcgggcgagcatgccgttaacatagccgtcggccacgttgccagcctgcaccagggcggcggcgatctgacggatagcgtcttctttattggtggcctgctggccgggatgaatatcctgaacggataactggaacatagatttccactcctgctgaagttgaatcgtttcagccttctggtgaattaacgcgccaaccggtaacggggaagttaaaggatagcgctgaaacgtttcaagaagtcttgctctttatccgtcagcacgcaagaaatctcgtctttccgcttaaaaaatttagatgtacagcacatttttgctgcggcgctggtttttttgctgatgctgctgacgccgccgctgcgtctgtttcagcaacttcagccgtaatgagaattattttgaaatgctattttgattttttgtggcactttttcgttagcgtctgtctattttctgagtagcggcgtaaactccgcgtcttcttcagaacgcagaaccgaaaagatgcacattacccccgcagccgcctctcccaaaccgtttgacgtcacctccacggcgtttttgattgtggcctttctcaccggcattgctggtgccctgcagacgccgacgctgagcttatttctgactaacgaagtgcacgcccgtccggcgatggtcggctttttcttcaccggcagcgcggtgatcggcattctggtcagccagtttcttgccgggcgttcggatcgcaaaggcgaccgtaaaaacctcatcgtcttctgctgtctgttcggcgtgctggcctgtacgctctttgcctttaaccgtaactatttcattctgttgtttatcggcgtcttcctgagcagctttggctcaaccgcaaacccgcagatgttcgcccttgcccgtgaacatgcggatcgcaccggccgcgaagcggtgatgttcagctcgatcctgcgcgcgcaggtgtcgctggcctgggtgatcggaccgccgctggcctatgcgctggcaatgggattcggctttacgatgatgtatctgagcgcggctattgcctttgtggtgtgcgggatcatggtgtggttttttctgccaaccatgcgcaaagagccggtgctggcgaccggtgtgctggaagcgccgcgcaccaacagacgtgatgcgctgctgctgtttgtcatctgcacgctgatgtggggcaccaacagcctgtatatcatcaatatgccgctgtttatcattaatgagctgcatctgccggaaaagctggcgggtgtgatgatgggtaccgccgccgggcttgagatcccgaccatgctgattgcgggttactacgctaaacgcttcggcaagcgctttctgatgcgcatcgcggtggtcgccgggctgattttttacgccgggatgctgaccgtgcacacgccggtattactgcttgctttacagctgctgaacgccgtatacatcggtattcttgccggtatcggcatgctctattttcaggatctgatgccaggccaggcgggggctgccaccacgctttatactaataccacccgcgtcggctggatcatcgccgggtcgctggcgggcgtggtggcggagttctggagctatcacgcggtattctggtttgcgctggtgatgatcgtcgtcaccatggcatgcctggcgcgcataaaagatgtttaaggcgcggtcagcctttccagatcgataaggtaaaccatcgcctgggcgcgcgtgctgccgcacatctcgcgggagggttgcagtccggcgcagactttcgggcgcagcggcgagcggaacagcttacagcgctgctgctcgtcaagctgaacgcagggggtattggcgggtttgccgtccggcataccggggatcgggctgctgatggatggcgcggtacaacaggctccgcaatcgctgcgacactccataaacggctctcttttggcgggggtgatcggggttgtcatcccacgtttgcgcacgctatcactttttgtggtgaacatgcaaaacatgctgattccccttgcctgaaacgcccctcgcgagtaatttgtcgcgatatttttacccttttcccaaacaggattaataatgccaagagcgaatgaaattaaaaaaggtatggtgctgaattacaacggcaaactgctgattgtgaaaaatatcgatattcagtcaccgagcgcccgtggcgcagcgacgctgtataaaatgcgtttttctgacgtccgtaccgggatgaaagttgaagagcgttttaaaggcgacgacatcgtggataccgtgacgctgacccgtcgtttcgttgacttctcttatgtcgacggcaacgaatacgtgtttatggataaagaagattacacgccgtatatcttcaccaaagagcagatcgaagacgaactgcaatttattcctgaaggcggtatgccggacatgcaggtgttaacctgggatggtcagctgctggcgctggagctgccgcagacggtggatctggaaattgtggaaacggcaccgggcattaaaggcgcttcagccagctcccgtaccaagcctgccaccctgagcaccggtctggtgatccaggtaccggaatacctgaccacgggcgagaagatccgcattcatatcgaagaaagccgttatatgggccgagcggattaaggcacattttcgcccggcggcgcaagcttgccgggcctacatgtaggccgggttagcgcagcgccacccggcaattgttttaccattttaccgttctaaagcagttccgggaacagcgtatgtttcagcgccagttccacgccgcgtacttccgccatccctttcagacgaccaattgccgaatagccagggttggttttcttacgcagatcgtccagcatctggtgcccgtgatcgggacggaacgggatcggtcgtaaatctccggccttcttacgacgcagttcttcagtgaggatcgctttcaccaccgccaccatatcaacgtcgccctgtaaatgcgcggcttcgtggaaggttttcgggttcgcctcgcggcaggtagaacgcagatgcgtaaagtgaatgcggtcgccaaaggtttccaccatcttcaccagatcgttatctgcccgcacgccgtaagagccggtgcacatggtgaagccgttatggatgctgtcgacgcacgttttcagccactgcatatcttcaatggtggaaacaatacgcggcaggccaaggatcgggcgcggcggatcgtccgggtgaacggccagacgcacgcccacttcttccgcaaccggcacaatggctttcaggaacacggccatgttttcacgcagctgttctttattaatgccatcgtattccgccaggcgcgcgcggaactgatccagcgtatagccctcttccgcccccggcagaccggcaataatattacgcgtcagcttttcaatttccgcgtcgctggcggcgttaaagaattccagcgcctgacgctgctcttcttcggtgtagtctgcctgcgccccttcgcgtttcaggatatgcagctcgaaagcggcaaaagcaatctgatcaaaacgcagggctttggagccgtccggcagcgtatattccaggtcggtacgcgtccagtcgaggatcggcataaagttgtagcagacggtatcgatgccgcaggccgccagattacggatactctgctgataattggcaatccaggttttgtattcgccgctgtgggttttgatgtcttcgtgtaccggaatactttccactaccgaccaggtaaggcctttttcagccagctgcgcctggcgctgtttgatttcttccaccggccatacctgaccgttaggaatatgatgcagtgcggtgaccacgccggttgcgcccgcctgacggacgtcatcaagagataccggatcgttcggtccataccaacgccaggtttgttccatcgcctaaccctctaaaagttgttataccaatacagtcaaagccaatgacgactaccatacatgtttatttccggcgatcaaaccccaccgtatcccagattgatccagctcacattccccgtaaaattaaggcataccaattcaatttgctgtcatataactttacactgcatcttgttaattattagttaatcaggtgtttattaatgaagacaatcgcctcgcaaacgctgccggaaaacgtccgcttaccgcagtatgatcgctccctgctgcgctcgcgcatcgtgcatttcggctttggcgcttttcatcgcgcgcatcaggcgctgttaacggaccgggtgctgaacgcccggggcggcgattgggggatctgcgaaatcagcctgttcagcggcgaccggttaatgatgcaattgcgtgagcaggagcacctgttcaccgtgctggaaaaaggcgcgacgggcaacgaggcgattatcgtcggcgcggttcacgaatgcctgaacgccaaactggactccctgcctgccatcatcgaaaaattctgcgagccgcaggtggcgattgtgtcgctgaccatcacggaaaaaggttactgcatcgatccggcgaccggcaaactggatcttaatcagccgcgtatcgtgcacgatctgcaaaaccccaccgagccgcactctgcgccgggtattctggtggaagcgcttgcccgccgtcgcgatcgcggccttgcgccttttaccgtcctctcctgcgacaatattcccgacaacggccatgtggtgaaaaacgccgtgctcggcatggcgcagcagcgctccgctgagctggcacagtggatcaacgacaaagtgagcttccccggcaccatggtcgatcgcatcgtaccggcggcaacggatgaatcgctggcggagattacccgcacgttgggggtggaagatccctgcgccatcagctgtgagccttttattcaatgggtagtcgaagataactttgttgccggacgcccggcatgggaagtggctggcgtgcaactggtgcaggatgtgctgccgtgggagcaaatgaagctgcgtatgctgaacggcagccactctttccttgcctatctgggctatctggcgggttttgcccatatcagcgactgcatgcaggacgcgcatttccgccgcgccgcccgccgtcttatgctggaagagcaggcaccgacgctgcgcatcaccgatgtggatctcaccgcttacgccgacagcctgatcgaccgttttgccaacccggcgctgcaacaccggacctggcagatcgccatggacggcagccagaaattgccgcagcgtatgctggacgggatccgcgtgcatctgcaacgcggtacgccctggccgctgctggcgctgggcgtcgctggctggatgcgctatgtcagcggcgttgacgatgccgggcaggcgattgatattcgcgatccgctggtggaaaaattccgcgccatcgtcgaaaccagcgagccggacgatcgcgtacccgccctgctgacgctgacggaaatcttcggcagcgacctgccggccgatccggcgttcgtcaatgcgatccaggcggcctggcaacagattgctgataaaggcgcgcatcaggcggtgattgacacgctcgctcattaacaattcctgccattaaagcggacagagaagccatctgtccgccctttcacttctcttttccttcttttttcgccaggattagcattattgttacttaataacagttaacagatctaatcatggagcttatatgaccaggaccaacctgatcaccggttttctgggtagcggtaaaaccacctctattttgcatctgctggcgcagaaggatcccgccgaaaaatgggccgtgctggtgaatgaatttggtgaagtcggcattgacggcgcattactggcggacagcggcgcgctgttaaaagagatccccggcggctgtatgtgctgcgtgaatggtttgccaatgcaggtggggctgaataccctgctgcgccagggtaagccggaccgtttactgatcgagcctaccggcctgggccatccgaagcagatcctcgatatgcttaccgccccggtttatgagccgtggatcgaattacaggccaccctctgcctgctcgatccgcgtcaactgctggatgaaaaggccgtgaataatgagaacttccgcgaccagctggcggcggcagatattatcatcgccaacaaagcggatcgccgcacgccggaaagcgagcaggcgctggcgcagtggtggcagcagtacggcggcgatcgggagttattcaccgccacccagggaaatatcgaccccgccctgctggatcgcccgcgccgcaaccagcgtgagctgcccgaaagcgccgcgcatcagcacagccatggcgataaaaaaggccttgccgcgctaagtctgccttcccatcagcgctggcgtcgcagcctcaacagtgggcagggccatcaggcctgcggctggatctttgatgctgaaacccgtttcgacaccattggcctgctggagtgggcgcggctggcgccggtggatcgtgtaaaaggcgtgatgcgcattcccgaagggctggtgcgtattaatcgtcagggacaggatttgcgtatcgaaacgcaaaatgtatcgccgccggacagccgtattgagctgatcaccgctgatgaagcggactggaatgcacttcagtcaactttgttgaagcttcgtttagccgacgagaattaacgttacggttgataccttagtttctgatgaatacatgaaaacgcgacttcccctgattttactgttaaatgccgccggtctggcgctgtttttatcctggttcctgccagtaaaccatggcatgtggtttaccctcgactcggctatttttcatttctttaatgaaaagctgactgaaagccgtgcctttctgtggctggtcgctatcaccaacaaccgcgcctttgatgcctgctccctactggcgatgggcgcgctgatggtgagcttctggcgtaacgccgatgcggcgggtcgtcgccgcgtggtgatgataggcctgatgatgctgttcaccgccgtggtgatcaaccagctggcgcaggcgctgtacccggtaaaacgcgccagcccgtcgttattctttgagcatgtcaaccgcgtcagcgatttgctgagcgttattcctactaaagatgcctcgaaagacagcttccccggggatcacggcatgatgctgcttattttttcagcagtcatgtggcgttattttggtaaaggcgcctttgccattgccctgcttattgtggtggttttcgcgttcccgcgggtaatgataggcgcgcactggtttactgatattgtcgtcggctccctttctgccgtgctcattggcttaccctggtttttgttgacaccccttagcgataaaatcgtttcactgtttgactattatttgccttataaaaacaaacaacttttaaacaaataaataacttctttttaccgccattgcagggatcgacaaggatccctgcaaaataaagttggctctttctcctttccgtcatacgcctgtcacaaaatttctccagctaaatgagcggcatgcatggtttttaagctaaattgcttgctttttgtacaaagatttattttcactttcggtatcataatttcttataaaaaaacacataaaaagtctcgcattgcctggggtgataaggtaatctcgactgcgtttcgcctcacagacataaaatattcccgctgtgaataaatttgtgcgttaaaccacagatttgacctggaggaattgtgtcgtagtgcgcaggtaattaatctcgtcacgtttggcatttatatagcgatatttatcgttaaggacttcaagggaaaataaacaacatggtcaaatctcaaccgtttttgagatatctcgggcgggcgatccccgcgttagcagtagcggtactgctttcagcttgttcaactaataccgcaaagaatatgcaccctgagacgcatgttgtgggcaccgaagatgcctcgtcactgcaagcctctcaggatgaatttgagacgatggttcgtaatctggatgttaaatcccgccttatggatcaatacgcaagctggaaaggcgttcgttatcgtcttggcggcgataccaaaaaaggtattgattgctccggtttcgtacagcgtactttccgcgaacaatttggtttagaactgccgcgttccacctatgaacagcaggaaatgggcaaatccgtttcacgcaccagcttacgcaccggcgatctggtcctgttcagagccggttctaccggacgtcacgttggtatttatattggcaacaaccagtttgtccatgcctctaccagcagcggtgtcgtgatttcaagtatggatgagccatactggaaaaaacgttataacgaagcgcgtcgcgttttagtccgcagttaacgtatcgcctgttggtttcccttgactgacatgacgacataaaaaagaagcgctgctccggcagtgctttttttttgcctgctgacggctgaagtctttccaggctatagtctgacaattcaaagcgatcctctgtcttatctggataccgtacccctatgccgatccgcttaacgcatgccagccgcaaaattctgatcatcagtattctgacaggcattctgacgggcatcgtggcaggaggcctgcaatttagcattgcgcaacaccatcgtgaaattcagttagatcgtttattcagcgatattaaagctaacgttgaacattattttagcgatctgcataccaccagcgatttactgcaaccgttagccttaagcccctgtgaaaaagtcagcagcgaattaacatcgcgggcggcattcagcgtgaacgtgcgggcgtttttactggtacgtaaccataatgcgttttgctcctccgccaccggcgcgatggatgtgccgctgaccgatctgataccgggtattgatgtcagcaaaaagctcgatatggtgatcctgcccggcacgccgatgatgcccgatactcccgccatcggcatctggtatcaaagcccgctgcgggatgaacacggggttttcgtctccgttaacgttaatctcgccccttcgttgatcaactcttccctgcgggataattatcagggcgttgcgctggcgacaggcgataacgctatctccaccttttccgcccggctgatttccccgggggatgtctctgcgcagtcggtacgtcatgcggccatcgacagcctgccgctcaccctctggctgtatgccgaacgctggacgccgcaggacattcagctggcgctgcttcccgcgctgatggcgggtctgctggcgggtttactctgcgccctgttgctgcaccggcgtctgcggcctggcagagagattttgcaggccattaagaacgaccaattttatgtggtgtatcaaccggtggtggatgcgggcacgctgcgcgtcagcggcgcggaagtgctgctgcgctggaagcatccgacgaagggtgagatctccccgaatacctttattcccctcgctgaagcgcaaaaactgatggtaccgctgacgcagcacctgtttcgcctgatcgcccgtgacgccgcggcattacaaagcgtgctccccgtgggcggcaagctcggcatcaatatcgccaccggccatctgcatgccgccagctttattgaagatcttgatcgtctgaatgccgccctgcccgtgcagcatttcagcatcgtactggaaattaccgagcgtcatatgcttaagcatggcgaagcggcggcgctgtttaaggccctgcatcagaaaggctatgaaattgccattgatgatttcggcaccggccacagcgcgctgatttatctggagcgttttaccctggattacctgaaaatcgatcgcgcctttgtgagcgtcattgatatggaaaccgccgcctcgccggtgctggacaccgtgctgctgctggcgaaacggctgaacatgcagaccgttgcggaaggcgtggaaaccgctgaccaggccagatggctgcgcgcccgtggggtaaactttttgcagggctactggttttgccgcccgatgacgctggcccagctgcaaaactggcagccaccgcctttttctgttcagcttcaggggtgaagcatttaccatccaccagcctgtaccttattattcaccggtcttagcgctggtaaaaggaagccgcccgatgatgtctctgcgcgtaataatgatgctgttcgccatgttgagcctgaccgctcaggcacagaccataaaagagagctacgccttttcggtgattggcgagccgaaatacgccgcggatttcagccattttgattacgtcaatccggcagcgccgaagggcggcaacattacgcttgcggtgatcggcacctttgataacttcaaccgctacgccctgcgcggtaatgccgcggtacgcaccgaggcgctgtatgacaccctattcaccacttcggacgatgagccgggcagttactacccgctgatcgcggagatggcgcgctacgcggatgacttttcctgggcggagatcgccattaatccaaaggccacctttcaggacggtacgcccgtcaaagccagcgacgtggccttttcctttcataaattcatgaccgaaggcgtgccgcagttccggctgatttacaagggcaccacggtcaaagccatcgcgccgctcaccgtacgcattgcgctggccaaacccggtaaagaagatctgctgagcctgttcagcctgccggtgatgccggagaaattctggaaaaaccataagctcagcgatccgctgtccgtaccgccgctgggcggcgggccgtatcgcatcagccagtggcgtatggggcagtatatcgcctacacccgcgtgcgggattactgggcagcagatctgccggtcaatcgcgggcgctggaatttcgataatattcgctacgactactatctggacgataacgtggctttcgaagccttcaaggcgggggcatttgatttccgtcaggaaggcgatgcgaaaaactgggcgacacgctacaccggcaaaaatttcgctaatcactttattgttaaagacgagcagaaaaacgaatcggcgcaggatacgcgctggctggcgtttaataaccagcgtccgctgtttcaggatcgccgggttcggcaagcgctgacgctggctttcgattttgagtggatgaataaggcgctgttctataacgcctattcacgaaccaacagctatttccagaatacggaatacgccgcccgtggctatccggatgccgccgaactgacgctgctggcgccgatgaaagcagggctgccgccggaggtgtttacctccatctaccagccgcccgtctcgcagggcaacggctttgaccgtaataatctgctgaaagcaggtcaattgctggatgcggcgggctgggtgctgaagggcaaacagcgtgtgaatgcgaaaaccggaaaacccttcagctttgagctgctgctgcccgccgggagcaacaatctctgggtgatgcccttccagcataatctggcgcggcttggcgtaacgctcaacgtacgccaggtggataactcccagctcaccaaccgcctgcgcagccgtgattttgacatgataccgcgcaccttgcaggcacggccatggccggataccgatctgcaaatttcctggggctcggcctacctgaattccacctacaacacgccgggcgtcaccagcccgatcatcgatgcgctgcttgaaaaaatcattgccgcgcagggcgataaaaaaaagctgctgccgctgggccgggcgctggatcgggtgctgacgtggaattattacatgctgccaatgtggtttatggcgtccgatcgcctcgcttactgggataaattttccatgcccgcgcagcgcccggtctattccatcgggtttgatacctggtggtacgacgtcaacaaagcggcgaaactgcccgctgccagacgttaaggagaggctatgggcgcttatttacttcgtcgtttactgctgctgatccccaccctgtgggcgatcatcaccattaactttttcatcgtgcagatcgcccccggcggcccggtggatcaggcgattgccgctattgagtttggtcagaaaggcgcgatgcccggcggcggcgatggcggtatgggcgcgtcccatgcgcgtaccggcgtgggcaatatcggcgagggcaactatcgcggcggccgcggcctggatccggaagttatcgaagagatcaccaaacgctacggcttcgacaaaccgctgcatgagcgctatttcactatgctgtggaattacctgcgctttgattttggcgacagcctgttccgcagcgcctccgtgctacagctcatcaaagagagtatgccggtgtcggtgacgctcgggctgtggggcacgctgattatctatctggtgtccattccgctcggcatccgcaaggcggtgcacaacggcagccgcttcgatacctggagcagtgcctttattataatcggctatgcgatcccggccttcctgtttgccgtgctgctgatcgtgctgtttgccggcggcagctattacgatcttttcccgctacgcgggctggtgagcgccaatttcgacaccctgccctggtaccagaaaatcaccgattacctgtggcacatcacgctgccggtgctggcgacggtgatcggcggctttgccgccttaaccatgctgaccaaaaattcctttctcgatgaaattcgtaagcagtacgtggtcaccgcccgcgccaaaggggtgagcgagcgcaatattctgcataaacacgtctttcgtaatgcgatgctgctggtgatcgccggtttcccggccacctttatcagcatgttttttaccggctcgctgctgattgaagtgatgttttcgctgaacggtctggggctgctcggctatgaagccaccgtctcgcgggattatccggtgatgttcggcacgctctatattttcaccctgattggcctgctgctgaatatcctcagcgatatcagctatacgctggtggatccacgtatcgattttgagggtcgctgatgcgtcaattaagcctcgttaaccaggcccgctgggcacgctttcgccataatcgtcgcggctactggtccttgtggattttccttgtgctgttttccctcagcctgtgcgcggagcttattgccaacgataagccgctgttggtgcgctatgaaggccagtggtacgccccggtgctgaaggattacagcgaaacggtattcggcgggcagttcaccaccccggcggattatcaggatccctggctgcaaaagcagctggatgaccacgcctgggtattgtgggcgccggtacgcttcggcgcgcgcagcattaatttcgccaccgacacgcctttcccgtcgccgccgtccgcacagaactggctgggtactgacgccaacggcagcgacgtgctggcgcgcattctctacggcacgcgcatttcagtgctctttggcctgatgctgacgctctgctccagcgtgatcggcgtgatggtcggggcgatgcagggctattacggcggccgtatcgatctctttggccagcgggtgatcgaggtgtgggcaggaatgccgacgctgttcttgatcattctgctctccagcgtcattcagccgggcttctggtggctgctggcggtgacggtgctgttcggctggatgagtctggtgggggtggtgcgggcagagtttttacgcacccgtaattttgattatatccgcgcggcgcaggcgctgggggtcagcgatcgcagcattatcctgcgccatatgctgcccaacgccatggtcgccgtgctgacctttatcccctttattctgtgcagctccatcaccaccctcacctcgctggattttctcggcttcggcctgccgctcggctcgccgtcgctgggagagttgctgttacagggcaaaaataatcttcaggccccctggctgggcatcgcgggctttttatcggtggcggtgctgctgtcgctgttgattttcatcggcgaagcggtgcgcgacgccttcgatccgaacaaggcggtgtaagatgagcgctcccctgctggcgataaattccctgacggtagccttccgccatcagcaacagctgcgcaccgtggtcagcgatctgtcgctgacaatccatgccggtgaaaccctggcgctggtgggcgaatccggctccggcaaaagcgtcaccgcgctgtcggtattgcggctgctgcccgcgccgccggtggaatatcctgcgggcgatattctgtttaaaggcgaatcgctgctgcatgccagtgaaaaaactctgcgctccgtgcgcggcaataaaatcgcgatgattttccaggagccgatggtctcccttaacccgctgcatacgctggaaaaacagctgtatgaagtgctgtccctgcatcgcgggatgcggcgtgaggcggcgcgcagcgaaatgctcgactgtctggatcgcgtcggcatccgcaatgcccgtacccggctgaatgatttcccccatcagctttccggcggcgagcggcagcgggtgatgatcgccatggcgctgctgacgcgcccggaactgctgatcgccgatgagccgaccaccgcgctggacgtttccgtgcaggcgcagatcctgcaactgctgcgtgaactgcgtgatgagctgaacatggggctgctgttcatcacccataacctgagcattgtgaaaaagctggcggacagcgtggcggtgatgcaaaacggccgctgcgtggagcagaaccgcgcagcagaactgttcgcccgcccgcagcatccttatacgcagcggcttctggacagcgaaccggctggcgatccggtgccgctcacccctgccctgccgccgctgttgcaggtcaaaaatctgaacgtcgcctttccggtacgcagcggccttttccgccgcgtgaccgggaaaaaaccggtggtcaacaacctgagcttcagcctgcggcccggcgaaacgctggggctggtgggggagtccggatcgggaaaaagcaccaccggactggcgctgctgcggctgattgccagcgaagggcaaattgaatttgatcatcatccgctgcacagctgggatcgccggcaaatgctgccggtgcgtcaccggatgcaggtggtgtttcaggatccaaactcctcgctgaacccgcggctggatgtgcagcagatcatcgaagaagggttacgggtgcatcagcctgccctgtcgcgggcggagcgggaagaacaggtgaaagcggtgatggtggaagtgggtcttgatccggacagccgccatcgctatccggcggagttttccggcggccagcgacagcgtatcgccattgcccgggcgctgatcttaaagcctgagctgatcgtgctggatgagccgacgtcatcgctggatcgcaccgtgcaggcgcagatcctcacgctgttaaaatccttgcaggaaaaacaccgcctggcgtacatctttatcagtcacgatctgcgcgtggtgcgcgcgctctgtcatcaggtgatcgtattacgtcagggagaggtggtggaacagggggagtgcgcgcaggtgttcagccagccgcagcaggcttatacgcgccagctgctgtcgctgagctaactcagaaaggattgttgttcgagaacggctctgcgatggcgacgccaaagtttttcaggcggcaggtggccgcaaactcgtcctgacgattaacaaacaggcacggctcgccttcgcattccagcaccgagcagtccacttcgatatcgtttaacgcctggctgagcttatgcatcactggccacgcgctatcgccatccgggcttaacagtttcaacgcgaccagacaattttcgccgctctgtccattgtgcggaatcggttcaactttcgaacctgcgcttcccgccagccagcgatagttctgcggcaaccggtgcacgatagagaggtttaatgtattcacgttatttccctgaaagcaaaatcttcacaattaatttacatctgtaactacacaggctatatgtacccgtttatgagatctaactcaacctttttaactacaacggtgtgactttttacacaaatacattttacataaaagaaacaaatcggggaaatgcgatcgcaggatccgttgatatgcatcaacgaagggggcagtttttgccccctggaaaggattaggcggcgcgctttttcgagcgactggcgtagaaatagaagagtacagagctggccgcgcagaaggcgatagaccagatcatcggccaggcgctgttaaaggtcgccagcgacagtaacgcgccgacaatagcaccgatgccgaaacggaaggtgcccgccagcgacgaggccgtccccgccatatgcggaaattcatccaggatcaccgccatggcgtttgaggccaccagcgacacgcagccgataaaggccgccacgcccaccaccagcgcccagaatccgacgtccagcgcggcgcacaccaccatccatatcgccatcgccagttgaatgtacagcccggcgcggaacatattgatcgccccgacccggcgcacgaaacgtccgttaatgatggtcataatgaacaggaagacgatgttcagcgcgaagtaatagccgaaatcctgcggcgaaacatggttgatctcgatgtagacaaaaggcccggcgctgaggaaggagaacatcccggcgaagctgaagccgctcgccagcatatagctcagcacccgcttgtggcgaaacagcgtggcgaaattcccgagcgtggtgcgaacgcggaatttttgtcgccgctccaccggcagcgtctctttaatgaaaaagaagatcatcagcgaggccagcagcgcggcaatggccaggatccagaaaatcgcatgccagctcatccacaccagcaccgccccgccgatcatcggcgccagcagcggcgcgatggtggtcaccagcatcacaaaggacatcatccgcgagaattcctctttcggataaatatcccgcatcagggcgttgatcaccacgctggcagcggccgccgccagcccgtggaagaaacgcatggtgatcagctgctcaatgctctgcgccagcgcacaggcgacggcagcggcggcaaaaatcagcgtcccgccgaggatcaccggcttgcgcccgatgctgtcggccatcgggccatacaacaactgccccagcgcaaaacccagaatataggtgctgagcgtcatctgcgcgctgcctgccggcacggcgaactgctctgcgatcaccggcagagcgggcagatacatgtcgatggagagcggcatcagcatggccagcaggccaaggataaagacgatactcagagatgagttttgcctggcggtcactcaggactcctgggaaagttcagaaggcatgccaacgctggcaatctcttcgtctgttaacgggcggtattcaccgggggctaaatcatcgtcaagggcgatggcgccaatacgttcccggtgcagaccgacaacgtggttacccacggcggcaaacatgcgtttcacctgatggtagcgcccttcgctgatggtcaggcgcacctcggtcggagtaatcacttccagcaccgccggtttggtgagatccttttcgttatgcaactggacacccttcgcaaactgttcggcagtgtcatcgctgaccggggattcgagggtcaccagataggttttttcgcagtggtggcgcggtgaagtgatgcggtgcgaccactgaccgtcgtcggtcatcagcaccagaccggtggtatcaatatccagacgcccggcggcatggagtttgtgcgccaccggctcgtcgaggaaatagagcaccgtcggatgatcgggatcttcggtagaacagacgtaaccctgcggtttattaagcataaaatagcgcgggccattctgctgcgccagcgggttgccgtcgaacgccacttcatgttcgggcagcagtttaaacgccgcttgtcgtacaatttcgccgtcaatagtaatacggttggcgcggatctcacgcccggcaatagcacggcttacgccaagctgctgagcgataaacttatcaagtcgcatgaaattaaatttgcctgtaaagggtgccggagtcgggctaactgcccgaaaaaaagaagcaatgttgcatggctaagtataacgggctgcgcgtatcgctcaagggaaaaaaaccgtggcatactattagtctgctgatgaaaattaaagagaccatgacttttacactccgcccctaccagcgtgaagctgtcgacgccaccctcgcccactttcgccatcatcgtcacccggcggtgatcgtcctgcccaccggggccggtaaaagcctggtgatcgccgaacttgccagggtcgcgcgcggacgtgtgctggtactggctcacgtcaaggagttggtggcgcagaatcacgcgaaatatctggcgttaggccttgaggcagacatttacgccgccgggctgaaacgcaaagagagccacggcaaagtggtgttcggcagcgtgcagtcggtagcgcgtaatctcgaccattttcagggggagttttcgctgctgattgttgatgaatgccaccgtatcagcgatgacgacgacagccagtatcagcaaatcctcgcgcatcttacaaaagtgaatccgcaactgcgcctgctggggctgaccgccacaccctttcggctgggtaaaggctggatctatcagtttcattatcacggcatggtgcgcggcgatgaaaaagcgctgttccgcgactgcatttatgagctaccgctgcgctatatgatcaagcatggctacctgacgccgccggagcggctggatatgccggtagtacagtatgatttcagccgcttacaggtgcagcgcaatggcctgttcagcgaggcggatctcaatggcgagctgaaaaagcagcagcgcattacgccgcacattatcagccagattgaggaatttgccgccacccgtaaaggggtgatgatttttgccgccaccgttgagcacgcccgggagatcaccggcctgctgccggcgaatgaggcggcgctgatcaccggtgaaacgccgggcagcgagcgcgatgccctgattgaggcgttcaaagcgcagcagtttcgttatctggtgaacgtctcggtactgaccaccggctttgatgccccgcatgtcgatttgatcgccattctgcgcccgacggaatccgtcagtctgtatcagcagatcgtaggccgcggcctgcggctggcccccggtaaaaccgactgcctgatcctggattacgccggtaacccgcacgatctcttcgcgccggaagtgggcgcgccaaaaggtaaaagtgataacgtgccggtgcaggttttctgcccggactgcggtttcgccaacaccttctggggaaaaaccaccgccgacggcaccctgatcgagcattttggccgccgttgccagggctggtttgaagacgatgagggtcatcgcgcccagtgcgactaccgcttccgctttaaaaactgcccgcagtgcaacgcagaaaatgatattgccgcccgccgctgccgcgagtgcgacacggtgctggtggatcctgacgatatgctgaaagccgcgctgaagctgaaagacgcgctggtgctgcgctgcagcggcatggacttacagcatggcgcggatgagaaaggccagtggctgaaaattacctattacgatgaggacggcgcggacgtcagcgagcgattccgtctgcaaacgcctgcccagcgcacggctttcgaacagctttttattcggccccacacccgcacgccgggcgtgccgctgcgctggatagtcgcggcggatatcgtcgcgtcccgcgcgctgctcaggcatccggattttgtcgtcgcgcgcaaaaaaggccagttctggcaggtacgtgaaaaggttttcgattacgaaggtcgcttccggcgcgccaatgaattgcgcggctagcggcgcttttcgttgaagtcacatacgttcgggtatagaataccgcccgctttacaaccgtaaagccgatcatctgcctgttgctgggtcgcctgtaacaggattaattagagagattcaaatgtttactattgaagcacaagcacgtaaagagcagggtaagggtgcgagccgccgcctgcgtaccgctaacaagttcccggcaatcatctacggtggcgctgaagcaccgattgctatcgaactggaccacgacaaagtgatgaacatgcaggccaaagaaggtttctatggcgaagttctgaccctggttgttgacggtaaagaagtaaaagttaaagttcaggctgtacagcgtcacgcgttcaagccgaaactgactcacatcgacttcgttcgcgcgtaatcgccaacaggttgaataaaaaaccccgctccggcggggtttttttatggctgttatttgccaccgctcagacggcgctgcaactggtcgcgcagattgggcggcgtgcctttgatggtcagcgtgtcggtggccggatcccagaaaatgcgttcgccgagcagcatggcgtcgaaattaatggtcaaaccgccgccgctgcccgcgtatttggtcagctgacgcagcgtactgcgatccgccgggaagctctcttccagctcgtagcctttatcggcggtaaaatcctggaagctgacgtcgctcacacccgccagctctttcgacagggatcccagctcgatctcttccccggcctgcaactgttcgttgcagtagctgtatacctgctgacgcacactctggcgttccgctttatccagatccgcttcagcggtaaagtcgtccaccgcctgtaacagccctcggttctgcgctttggcattcagaccttcgctggcgccgaggaaatccataaagaaatcggcaaccttgcgccctacccgccctttcaggaacgtcaggtagcgggtcgattccggcctggtttcccattcggttaaatcaatgcgcgccacgatgtcggcatggttgatgtcgagatagtgcgtggagctgatatccagctcctcattcacccgcatgctgcttaaattattcagcacggcaatgagaagatactctaccgccagatagcgataatggcagaacagcacgatcccgccgtcagcgaaggggtattttgacagctcatcccgcagacggccggttgccgcacggctgaaagcgagaaaatcttcgtcgcccttgcgttgcaggcgcagcgtttgcgccagttcgctctcttcattaaacaggccataggctttatttttggcgctgtagacccggtgcagctcggccaccatgtcgttgacggtagccgtcggttccagcaatgaatcgcgtaacaccagctcaagggtttgctcatcgcgcttgataagctggtgcagggcaatctggttgatgtccagactcatgataaactctccttttagaccgggcggtattcaaccaccgccagcacatctgtgcaatagcggataaaaatgcagaaaaaaagctgttgctacggtaatatgttgccctttcatgaacaaactgattccgaatttatgccacagatttcccgttatagtgatgaacacgttgaacaactgctgagtgaactggcaaacgtgctggaaaaacataagacgccaaccgatctttccctgatggtgctgggaaacatggtgaccaatcttatcaacaccagcgtcgcgcctgctcagcgtcaggctatcgcccgctcttttgcagaggcgttgcagtcgtccgttaacgacgataacgcgcactaaggaacacgacgacattttatggtgactcatcgtcagcgctaccgtgaaaaagtctcccagatggtcagctgggggcactggtttgccttgttcaacattttgttgtccatggttttcggcagccgctatctttttgtcgccgactggccgaccacgcttgccgggcggttttactcctacctgagcgtcgtcgggcatttcagctttctggtgttcgccacctatctgctgatcctctttcccctgacctttgtcattatgtcgcagcggctgatgcggctgttgtccgctattctggccaccgccggcatgacgctgctgctgatcgacagcgaagtctttacccgcttccacctgcatttgaatcccatcgtctgggagctggtgatcaaccccgatcaaaacgagatggcccgcgactggcagctgatgtttatcagcgtcccggtcatattgctgatcgaaatgctctttgcaacctggagctggcagaaactgcgcagcctgacgcgtcgtcgccattacgccagacccgtcgccgccttcttctttgtggcctttatcgccacgcacgtgatgtacatctgggcggatgcgaacttctatcgcccgatcaccatgcagcgcgctaacctgcccctctcctatccgatgacggcccgccgttttctggaaaaacacgggctgctggatgcgcaggagtatcagcgtcgtctggtggaacagggtaatccggaagcggtgtcggtgcagtatccgttaagcgatctgcattaccgcagcatgggcgcggggcagaacgtcctgttgatcaccgtcgatggcctcaactattcgcgttatgagaaacagatgcctgcgctggcaagcttcgcccagcagaatgtgacctttacgcagcatatgagtaccggcaacggcaccgacaacggtatctttggcctgttctatggtatttcgcccgcctatatggacggcgtgctgtcgtcgcgtacgcctgcggcactgatcaccgcgctgaatcagcagggttatcagcttggcctgttctcctccgatggcttcagcagcgccctgtatcgccaggccctgttgtcggacttctcactgccgcctgcgaaatcgcagtcggacaaacagaccgccgatcagtggatcgactggcttggccgctatgccgccgaagacaaccgctggttctcctgggtggcgctcaacggcaccacgctggatgagacgcagcagcagggctttgcccgccgctacgcccgcgccgccggtgatgtggatgcgcagattgcgcgcgtgcttaacgccctgcgcgatgccggtaagctggacaatacggtggtgattattaccgccggacacggccagccggtggataaagccgagcagacctttgactggtcgcgcacgaatctgcacgtgccgctggtgatccactggccaggtacgcctgcgcagcgcatcaacctgctgaccgatcataaagatgtcatgaccacgctgatgcagcggctgttgcaggtgaccacgccagcgaacgaatactcgcagggtcaggatctgtttaacgccaaccgtcgccataactgggtgacggcagcggatgccaccacgctggcggtcaccacgtccagtatgacgctggtgctggatcataacggcacttatgaaacctataacctgcgcggcgagaaaatccgcgatcagaaaccgcagctcagtttgttgctgcaggtgctgacggatgaaaaaaggttcatcgctaactgattgattaattataaatcagtcagcgttacccggcttgcaatcagccgcaaaacgggtactattatcgccacagttcggcacgtagcgcagcctggtagcgcaccgtcatggggtgtcgggggtcggaggttcaaatcctctcgtgccgaccaaaaatcccggaaaaaccaaccttcgtggttggtttttttatatcagcattgtagttcattcagcctcttcccttatcttttcccctcattaaagttttctatccacagcagtgctgaatgtatatatacccttcggcctgcgattgagaccgctctttcactcacgacatgttatttgcacaataataacctgatagttacaaagacaatgttgcgacaatgataataaaactggcatctgccaggctgcgcggctactattttgcgctttgctaaaccgcatggatgcctgtttgcccgcactgtatgcggcgcgcctaatttgcgaaaccctatgcctgatccaatgtcatctgtaacggccagccacgatggtcgtgtaagtactgttcttcgctctccttcgctgctgatgcgcgaaaccctggccggggtgatcacggcccttgcgctgatcccggaagtgatttcgttttcagtgatcgccggtgtggatccaaaagtcagcctgatcgcctccgtggtgctgtgcctgtcgatgtcgctgctcggcggacgtccggcaatggttaccgcggcggcaggttccgtggcgctggtgatcggcccgatggtgcatcagcatggtgtggagtacatcctgccagcggtgctgctggccgggcttatccagatcctctttggcctcgcgggcatggcgcgtctgatgcgctttattccgcacagcgtgatgaccggctttgttaacgccctcggcatcctgattttcttcgcccaggtgccgcacttctggagccgggaaccgctgatcctcgggctgttcggcctgacgctgctgatcgtgctgtggttgccgcgctgggtgaaaagtatcccctccccgctggtggccattgtgctgctgacgctgtttaccgtgaccagcggccagatcttgccgaccgtcggcgatgaaggcccgatgcagggtggtctgccgggcttcacgcagtggctggtgccgttcaatctgcacacgctgagtatcatctggccgtgcgcgctgagtatcgcctttgtcgggctgatggaatccctgctgaccgccaaactggtggacgatctcaccgatacgcgctccagcaagcgtcgggaaagcgccggtctgggcatcgccaatatccttgccggactgtatggcggtatcgcgggctgcgcgatgatcggtcagaccatcgtgaatgtggaaatgggcaaaggccgtagccgtatctccacggtggcggcgggtctggtgctgctgctgttagtcaccgccctcagcgaggtgatggcaaaaatccccatggcggtgctggcaggcattatggtgattgtggcggtgaaaaccttcagctggcacagcatccgtccggcagagctgaaacaggcaccggtggcggaaaccctggtgatgctggtgacggtggccgccaccgtcagcaccggtaatctggctattggcgtcgccgctggcgtggcgctgatgtttgtgctgccaggccgccgccagcgcgccgcagacgctaaagcaaaaacagcgtcgccagacccagaaaaataaagaagccaccggtatccgtcagggcggtgatcatcacgctggagccgaccgccgggtcgcgccccagcctgaccataatcatcgggatcaacacccccatcagggcggcaaccagcagattcagcaccatggcgagggtcatcaccccgccaagggccatatcaccgtacaaccaccaggtgatgccgcccatgatgccgccccacaccaggccgttaatcagcgccacccccatctcacgaaaaatcagaaagcggaagttgccagggtggatcttttgcagcgccagcgcgcgcacgatcatggtgatggtctgattgccggtgttaccgccgataccggcgacgatgggcatcagcgaggccagcgccaccagctgtgaaatggtgtgctcaaagccgtcgatcacccgggaagcgataaacgcagtgcagagatttatcgccagccacgcccagcgggtacgcaccgctttgcccacaggcgcgaagacatcctcttcggcgctcagaccgcccatcagacgcatatcgttatcggtttcctgatacaccacgttcacgatctcatcgatggtcagacggcccatcagcgtgccggtggtgtccaccaccgcggcgctgagcaggttgtcacgctcaaaggtacgggcggcattttcggcgtcgtcttccggcgagaagatcaccggatcgctttccatcacttcactgaccttcaccgatccggtattgagcaggatggtctgcaacggcagctcgcccagcagcacgttgtcccgcccggtgacaaagagtttgtcggtgttttccggcattttgtcgagacggcgcagaaagcgctgcacggtggccagcgtcacatccgggcgcacggtgataacggcgaactccatgttcgcgccgacgctggtcttcgggtagtgcatgacctgatgcacccgcgcgcgctcccccgccggtagcgaggcgaccagccgtccggtcaggttacgcggcaggcgctgaacaagataaatctgctcgtcgatgtcgagggttttcagggcatcgagcaacgctttgtcgctcatgccctcaataaggtcgtcccagacgttttccgaggcttccagcagcacttcgccgcgtttggtgtggtcgatcagctgccagaccgcgtgacgggcatcggcgggcagcgcctccagcgcatccgccagatccggcggcggcaaatgcgccaccagcgcgcccacttccgccatatcttccgccagcgtgccgacgtcatactgttctgcgagcgtcagcttgttgagtaaggtggaggtgatcgctttatcggtggtgagcagccagatcaggcgcgctcgttcttcatcgcgcaaccgggcgctgttgtttggtatgactgacataggacatccctgcattcgtgatcatgatgacagggtaaagcatagcggcaggtaagataaataaatggaatgaataaaaaaacccggcgcaacgagccgggctttttcgatcaggcggtacgggacaccgcatcgcgtgacgcggcatcgcgctctgcgccggtcagctctgacaatttgccgtcccgcatctccagcagacgatcggcgtgaataaagtagtgatcgtcatggctgatggcgaaaatggttttacccatttctttcatcaatggcagcagcacctgatagaactcgcgacggaaatgcggatcctgatcggcggcccactcatccagcaggatgatgtcacgatcttccgccagcgccagcagcagggccacgcgcttcttctgccctttcgaaagcttgagattgaggattttgccgtccttcagctccagcttgtgggacattttcagctgattaagccatttgtccaccagcgccggatcggcagatttgccctgcgggccaagcaattgatcaaacaaccagacatcggtaaacactgccgagaacagctgacgatagtcttccggtttgtttgccgccagcggcttgccgtcgataaggatttcaccggacaccggctgatacagtccggtaagcagcatcgccagcgtcgatttgccgctgccgttgccgccgatcagaaataccagctcgccccggtgcagcgtcagattcagcgggccgacggcaaaggcgttgtcctgataggtaaaggtgacatcgcgcatttcaagcgtctgccagccctgtagcgacaccggacgcgggaattcttctttataaggcgcgagatcaaactggttcagcttgttgaacgccacctgcgcgctgagcagcgtcggcagcgcgccgaccgccgacagcaacggcgtgcgcaggaacagcacggtaagggagaagatcgccgcgacattggtatccgcccagccgaggctgttggccatccagaacaccaggccaatcgcccccagcatcataatgtttgaccagttcaccgcgctcaggtggaaagtgtcggcgcgaataatatggtggcggtattcccgcgcatccggcagatagagctggttatagatgtattcggcgcgttcgcggttgagggtcagttctttacgcccttccagcaccgtctggtaatcgttatgcagtttgtcttcggtttcacgcagcgtggcgatatgtttgtacacccgcgccaccagcacaaatcccacccaaatggtgatcgccatccataccgcggtgaccatcagcattttaccggacagccagcccatgtaagccgtgcagccgacggtcagaataatgccctgcaccagttccggcagacggacaaaggcgatggtgatattacgcacgtcgctggtcagccccgccagcagagaggcgctgccgagctgctcaatacgctcgacgtgagtatccagaatacgcttgataaattcactgcgcagacggtaaacgaaatggtgaccgagggtggtcagcgccagctgggagccgagggtgaccgccatcaacaggatcagcagcccgagaaattccggtagcacggagagcgaaatatcaacgttttcaatcagccgctggttgataaaggcaatcagcccgatacccagcgcggcgctggcaaggcttaacgccagcacggcaataaaaggccagcgatattgtcgccagacgagaagaagaagtggcataaaagcgatccgcacagagtaaaaacagcgtgcagtgtaaacggctcttgtactggatcaagaataattgctatttatgttcgcaataaccccgcctggcggaacgtcaggttgtagcggtactcgccggtgtccggatgctgcccggctttgagcggcagaatgccatgataaaagagacgcgattcgccgccccataccaccacatccccctgctccagcatcacccgggcgacaggatcgttacgtttcaggccgccaaactgaaaaaccgcgggcagccccagcgaaacggacacaataggcgcgcgcagatccggctcgtctttatcctgatgcaacgagagtttcgcgcccggcgcatagcggttaatcagacaggcgtcaggggtaaaatcgggatagcccgccgcctgcgccgcgcgatcgcacaatgaacggaacacctccggcatcaatggccacgggcgctgcgtgaggggatcttccgtcgcatacagataaccccgcgcattggtcgcccagccgaggttaccgcagttggtcatcgccaccgacatggtgtagccgccgggggtgatcatatggcgaaacggcgactgcgccgccacctgcgcgatgccgtccagcaacgcctgcgcctcgctgacggcaaaacggcgcaggatcaccgcgcccggtgcgagtggctcctgccagggttcttcatcggcaaacaaatccagcattacggctcctcctgttcagattcacgggccagcaattgcgctttgcgcgccagtccccagcgataaccggaaagcgcgccattgacgcgcagcacgcggtgacaggggatcaccaccgccagcgtattggccgcacaggcgctggcgacggcgcgcacggcacggggtttgccgatggcttgcgccacccgctgatagctgacggtctctccggcagggatctggcgtagcgcgttccatacctgccgctgaaaggcggtgccgcgcagatccagcggcagcgccagggtatgtcgcgggttatccagcaccgcaatcacctgatgcacccgtcgggtgaaatcctcatcgcccgcttctctgtgcgcaccgggaaaggcgcgcgccagttcggcaagcagctgctcgtcgctgtcagccagcaaaatggcgcagataccgcgctcgctttccgccaccaggcagcgccccagcgtacagccttccagcgcatagcgaagggtggtgtccctgccgccgctgcggtattgctgcgccgtcatgccaagcgcccgatccgcgtgacgataatagctgctgctgtccgggaatccggcggccagcacggcgtcggtcaccgttgtgcctgcggccagattttgccgcagacgttctgcgcgatatgccagttgccaggctttgggcgtcatgccggtagtggctttaaaaaggcgatggaaatgataaggactcatcgccacctgccgcgccagcgcgtcgagggtgacgggggtgtcctgctccagcagacgacatgcctgttcgattttatcgcggcggtgctgaccggcggcaggaagatccggctggcagcgtttgcagggacgaaagcccgccgccctggcgctgtcggcatcggggaaaaaacgcacgttctcccgcagcgcatgacgggcgcggcacgacgggcggcagtaaatcccggtggtgatcaccgcaaaaataaagtgaccatcagcgtcgggattgcgatccagcaccgcctgccagcggtgcgcatcgttttgcaacagtagttcagacatggcgggctcctccgttaagtgtagcctgaggatgagccacaccggcagccttcgcacccgcaatcttgcggtttaatttttttcgctcaccagaaaggcctggaactgtggcgtcatccagggaacaaatttatccccctctttggtgatcatatacaccgccagcccctcgcggcgcgccacttctttcgcctgctgcggcccgagcaccatcagcccggtatcccagccgtccgcctccagcgccgttggcgcgatcaccgtcaccgacaccagattgtgcgtaatcggactgccggtctgcggatcgataacgtgggaaagccgtttgccgtccagctcatagtagttgcggtagctgccggaggtgctgataccgtggccgttaatatcgacaatggcctgcaccgcgttttcgcgatcggtgggcttctggatcgccacccgccatggcttgccgtcgccgttcatgccgcggctggcgagcgcgccgcctacggataccagatagcgcgggatcccctcctgcgccatcagatgcgccagatgatcggcggcgtagccttcgccgacggtggagaggtcaacaaacagatccggcagatctttttgcagatactgtcgcccggcctcctgggtgaccgtcagatgttgcagaccggtacgcgctttcgcggcgtcgatttgttcctgcgacgggatggtgactggctgtttgtccgggccaaagccccacagattgaccagcgggccgacggtaatatccatcgcgccctcggttttatagccaatgcgcagtgaggtggtgacaatatccgccatcgcttcgctcacaggccagggcgtcaggctggaggaggcgttaaagcgcatcagggcagagtcatttttccaggtcgacatcatctgatcgtcagcatcgagctgcgcctggattttttgccggagttcgtcggcgcgcggtttttccaggttcacaacgctgacgcgccatgaggtgcccatggttttaccttccagcacggtgaccgctgacgccgccggttgtgggctggataccgcgtcacagcccgctaaaaaaactgaagccgcgagcgtcgcggcacgaagaaaacgcagatccatgtcttttccccccttgctgaatgcgcgcaagggtacactaaaagtctaagtttgtgagcaataaaaaaaggggccgtgcggccccttcgctaagcgtctcagttgattagaactggtaaaccacgcccagcgcaacgatatcatccgtgctgatgccagcctgacgggtgaaggtgttgtcgtccagcaggttgattttgtaatcaacgtaggtggagaggtttttgttgaagtagtaagtggtgcccacatcaacatatttcagcagatcctggtcgccgaaatcacggccgttagcgctgctgatgtctttcccgcgggattgcaggtacgcgatggacggacgcaggccgaagtcgaactggtactgtgcaacggcttcgaagttctgtgctttatccgcaaagccccatgcggcagtacggccggaaccgttagaggtaccgaaacgggtcgcgttgtaagtctgggagaactgcgctgccaggtaaacgttgttggcatcgtatttcaggccgccgctgtagacgtcagcgcggtcgccgttaccgtaagcgtctgccacgttctggtcagaggtacgtttggaggaagacattgcgccgcccacgctgaagccttcgcccagatcgtaggtcagggacatgccgtagccgtcgccgttctgtttcagggtgctgcgaccattgtcgttttcaccgctggtgctgccgtttttgccctggtactgcaccgcaaagttcaggccatcaaccagaccgaagaagtcggtgttacggtaagtcgccacgccgttagcacgggactgcatgaagttgtccgcgccgtaggtatcgccgccgaattccggcagcacgtcggtccaggaggtcacatcgtagatcacgccgtagttacgaccgtaatcgatggcaccggcatcaccgaaacgcacaccggcaaaggccagacgggtccatgcctggtcgcttgcgccttcggcttcgtccgcctgtacgttgtattcccactggccgaaaccggtgatctggtcgttaacctgagtttcgcccttgaagccgaaacgtacgtaggttttgtcgccgtcgtcgccatcgttatcagagaaatagtgcaggccgtcgactttaccgtacagatctaatttgttgccgtctttgttataaatttcagccgcatttgcagcgcctgctacgagcagagcaggcaccaccagggaaaggactttgcgtttcatgttattaaccctctgtaatatgcttatttttatatgccactgcttactgattaacctgctaaccagtcggcgagttcattctccctaaaaatacagaataatccaacaacattatgatacgaaaaatctaaaggtgtttctctttaccgcttagatgtttcaatatgtaaactgcacggaactttttttagcactaatagctaaaaaatagcgcacggaaaatcaaagatgataattaaatcaatataatcaataagttgaaatgacaaacaatgatagcactgaatgataaaacaaaatcataacctgcgactaaaataatctggctatcatcattaacttttatttattaccttcattcggcttcgaatgactgtttacccctattacaaccggatgctctgcattcggtttttttttgccctgcaccgcccggataacagaaaaagcggtaccgcaggtaaattataatgactattaattaatcacttagccacagggtgatattagctaccaatactccgtaaattaatttcttgattaaaagtgctatccctttacttttcagagttaataacgggaaaaatggtgattaattgtacgtgccttaccgatccgctgtgccgcctccctttttgtccccccgctgcggcctttacctgcaagagagtctggaaattcattcattaggctttatactgcctgctgtacactgccgtgtaacataacaactacaagcccgacgcaggcgcgagcggcgcggtagtctcctgtcttagtcttacgaaaggcgctaaatggctttttcttcgcgtgttggcataacgggttacacacactaatgagtcgatctgacaccatgaaccctggaaaattttccctgataccgggcagcattacccgtttctttcttctgttgatcatcgttctgctggtcaccatgggtgtaatggtgcaaagcgccgttaatgcctggctgaaggataaaagctatcaggtggtggatattacgcatgccatgcataagcgcattgatacctggcgctacgccacctggcagatctatgacaatatcgccgcggcgcccgcctccccggcggatggtctgcaggaaacccgcttaaagcaggatgtctattatctggagaagccgcgccgtaagacggaagcgctgattttcggctcccatgacggctcgacgctggagatgacccagcgcatctcaacctatctggatacgctgtggggcgcggaaaccgtgccctggtccatgtattatctcaacggccaggataacagcatgatcctggtgtcgacgctgccgctgaaagatctgtcctccggctttaaagaatcatccattggcagcattgtcgatgcccgtcgcgcggagatgctgcaacaggccaatgccctggatgagcgggaaagcttctcgccgttgcgccgtctgacctggcagaatggttactatttcacgctgcgcactactttcaaccagccgggacatctggcgacggtggtggccttcgatttgccgatcaacgatttgatcccgccgggcatggtgctggacagtttccgtctggagagcgatgcctcccagagcgccctgcgcaccgcggataaagagatggcggacagcgcgtcggtgaatttcaacagctcgcagattgagatttcctcctcactcaactctacgggcatgcggctggtgtggcaggtgccctttggcacgctgctgctggacacgctgcaaaacatcctgctgccgctgctgttaaacatcggcctgctggcgctggcgctgtttggctataccaccttccgccatcagccgggccgtctgagcgaaaacgccgccctgcccggcgcgaataacgaactgcgcatgctgcgggccatcaacgaagagatcgtgtcggtgctgccgctgggactgctggtgcacgatcaggaagccaaccgtacggtgatcagcaataaaatcgccgaccacctgctgccgcatcttaatttgcagaacatcaccagcatggccgatcagcatcagggcgtgatccaggcgacggtcaacaacgaactttatgagatccgccagttccgtagccaggtttcgccgcgcacgcagatttttgtcatccgcgatcaggacagagaagtgctggtgaataaaaagctcaagcaggcgcagcgtctgtatgagaaaaaccagcagggtcgcaccgcctttatgcagcatattggcgcggcgctgtcgcagccggcgaaacaactggcgcaggacgcggcggcggtagatagcgaaaacgcgcaaaagctggcagcgcaggctgaccggctggtacagctggtggatgagatccagcttgccaatttgctggaaaacgacggctggaaaagcgccgccagcatgttctcgattcaggatctgatcgacgaggtggtgcccgcggtgctgccggtggtgaagcgtaaagggttgcagttgctgatcaataatcatctgccagccaacgaacagcgccacggcgatcgcgacgccctgctacgcattctgaccatgcttatccagtacgcggtgaccaccacgcagattggcaaaatcacgctcgaagtggacgccgatgaatccgcaggggatcgcctgaccttccgtatcctcgataccggggaaggcgtgacggcgagcgaagtggataatctgcatttcccgttcctcaacgacacccaggaggatcgctatggcaaagctaatgccctcaccttctggctgtgcgatcagctggcgcgtaaacttggcggccatctgaatattaaagcgcgtgaaagtttaggaacgcgctattctttacacgttaaaatggatgcacgtccgcaggcagacgatgaggaagagaaattactggatgatgtcgtcgccatgattgatattacgtccagcgatattcgtaatatcgtggtgcgtcagctggaaaactggggcgcaagctgcattaccccggacgaacgcctggcgagtcaagaatatgatctctttttaacggataatccgtctaatcttactgcctcgggcttgcttttaagcgatgatgagcccggctcgcgtaaaatcggcccaggccagttgcgcgtgaactttaatatgagtaatgcaatgcaggaagcgatattgcaactcattgaagagcaactggcacaggaagatgttccggcgtccccgctggggggcaatgaaaatgccgaactccatgccagcggctattacgcactgtttgtggatacagtacccgacgatgttaagaggttgtatactgaatccgccgcacgcgatttagcggcgctggcgcagacggcacaccgcctgaaaggcgtgtttgccatgcttaacctggtacccggcaaacagttatgtgaaacgctggaacatttaattcatgagaacgatgttccaggcatagaaaaatacatcagcgacattgacgattatgtcaaaagcttgctgtaagcaaggtagccttatacatgaacaatatgaacgtaattattgccgatgaccatccgatcgtactgttcggtattcgcaaatcactcgaacaaatcgagtgggtgaatgtagtcggtgaatttgaagattctacacagctgatcaataaccttcccaagcttgatgcccatgtactgattaccgatctttccatgcccggcgacaagtacggtgacgggatcaccctgattaaatatatcaagcgccacttccctaacctgtcagtgattgtgctgacgatgaacaacaaccctgccattttaagcgccgtactggagctggatatcgaagggattgtattaaaacagggcgcgccaaccgatctgccgaaagcgctggccgcgttgcagaaagggaagaagtttaccccggagagcgtttcccgtctgctggagaaaatcagcgcgggcggctatggcgacaaacgcctgtctccgaaagagagcgaagtgctgcgtctgttcgcagaaggtttcctggtgacggaaatcgccaagaagctgaaccgcagtatcaaaaccatcagtagccagaagaagtcggcgatgatgaaactgggcgtggaaaatgacattgccctgcttaactacctctcgtccgtaacgctgagcgcggcggataccaaagagtaactgccataccgacgttaccccgcccggcggggtaacgccttttcctgctttatccccgcgcttttcttacccgttccgcatagaccgccagcgtctgctggatcacgtccagcgttaccggcttcgacagacagctgtccataccggactccagacaacgctgcttctcttccgccagcgcgttcgccgtcacgcccaccaccggcagcgtcagcccaagctgacgaatacgctgcgtcaggcgatagccatccatgttcggcatgttcacatcgctcagaatgatgtcgatatggtttttgctcagcacattgagcgcgtcgacgccatcgttcgccgttttgcactgatagcccagcgaaccgagctgatccgccagcaggcgacggttaatcggatggtcatccaccaccaggatcatcatgtcgtcattgctggcgaccagcgaatccggcagttgcagcgcacgtgaggcgtcgttattttccatggtaatgctgtagatacgcgccagcagcgcgatcagctcatggggagaggcaacactgtgcacccactgtccggccgcccgctcctgcggaatgccgatatggcgacggcagaaggtaatggtggcgcggcctggccacggcgtatccagatcgtcgtcggtgatcagggtatcgttggcgtccggcgtttgcccttcgtaacgcagcacgcggatgccgttctgcgtcagcaaggagtcaataaaggcgcttaacgccgcattgcgcaccgccagccagcaggtggttttcttcaggccgtcaacgtccagcggctgcgctggctgcgcggcataaagcggaatacgcaccgagaactgactgcccatgcccggctcggtatccacggcaatatcgccgtccatcatgctgatcagcttttcgcagatcgccagccccagccctgtgccctggaaattacgttgcacgccggtccccacctggaagaagggatcgaagagtcgcaccacttctttacccgggatacccaccccggtgtcccgcacgcggatacagagatattccccggcgcgctgcacatgcagcacaatacagccgacatcggtaaacttgatggcgttgctcagcaggttggagatcacctgttgcagacgcatcggatcgccctgaagcgccaccggcacgtccggctcgataaagcagtacaggccgagctgtttacgcaccaccagcggcagatagttggcggtgatatggctcatcagctcacgcggcgagaattcgcgcggctcgattttgagctgctccgattcgattttggagaagtcgagaatatcgctgatgattttcagcagcagactcgacgagttgttcatcgccgtcaccaggcgatccacccctttcggcagctctttggtttgcagcagatcgaggttgccgataataccgtacagcggcgtacgcagttcgtggctgacggtggcaaggaacatggatttcgactggctggcctgctcggccgcctgcgccatatcctgcaacgactcttccatcttcacgcgcgcgctgacgtccaccagcacgcagatcgccacgttttcgttgcgatagcgggagtgcacgaagctgatttgcagattggtattgttgctggtcagcacatccacaaaattgacctgctggccgcagatgatttgcgtcagccgctgcctgtcctcgtgggtgagcatattgagataattatgcgccagctcgttactgaggatattggtgccgtcaatggtgcgcagaatacagatcccgaccggtgcggaggcgacaattttgcggttgaactgctcatgctcttccagtcgctgggcatcggcctcggcgggaataaagatccgccgctcgtacatgcgcgccagggtgaacaacgccacgcccaccagcacgttgagcagtaccgcgttaaggataaggatgcgcacgcgctccagcaccagatcgacaggtacggaataaactacgctcagggacgacggcggcaggctcttcttcagtaccagctcgcggaagccagaggagtagccaaaccaggtgcgctcctgtatccactccggatcgatttccaggctattttccggcccggtcagggaaatcagttgatgcccgttttcatcgagaatggtcacgcccaccggcagattgcccggcgtgtaaaagttatccatgcggatggtctgctctgatcccagcagcgcctgtaagcggttgcccagatagaccggcgttaaggcatagaaatagccgatgcccggacgcggcccctgactcatccagaagatattattgccgcgctcttcctgcggggcattacggtatttgagaatacgctcgtgcaggcttttcagcgccgtttcacgctccagcggtacgttgcgcaggccgaagtccgccatacagagggattcgttgccaatgaggaacacgcggttcagctcataagcggcagaaaagttatcgcgccagtagcgcataaaccacgccagcgattccagcgagccgcgccaggtgttgcccatggccgagcagtcggaatccgcaaacagcggcgcaaactccggcacatcgttacgggcgttgggtccccgtgacgtcataatgccgttttcagcggtcaggcgattttcggcaatgtacttaagctctttcatcacgtctgaggtgcgctggacatagcgttgcgcctgctcagaactgagattaagttctttgcgaatgtcggactctttgttctgcaaagcgttaacgatataaaacaccgaacacagggcaatcaacagccagagcagcagcgccagcgcccggaacaggtatcgtgatactttgagggtggtgcggaaagaaacaaggtatttcaagggggcgaagctccgccgcagaatgtaaaaagaatgtggataaagtagcggtaaaacgtcatacccgcaacgctaaagaaaacgccaataaaaagggccggaagcccggcccttttatcgacaaagctgattattcttcagcgtcgtctgcgacatcatcatcggtgtccgcttccggcacgatctcgtcgtcaccttccgctacgctgccgtcgatggcatccagctcttcttcatccaccggctcagccacgcgttgcagccccaccacgttctcatcttccgcggtacggatgaggatcacgccctgggtgttacgacccacaatgctgacttcagacacgcgggtacgcaccagcgtaccggcatcggtgatcatcatgatctgatcgctgtcggccacctgcaccgcacccaccacggagccgttacgctcggtgactttgatggagataacgccctgggtaccacgggatttggtcgggtattccgtttccgccgtacgtttaccgtagccgttctgggtgacggtcaggatcgccccttcaccgcgcggaacgataagcgacacgactttatcttcgcccgccagtttgatcccacgcacgcccgttgcggtacggcccatggcgcgcaccgcgttctctttaaagcgcaccactttaccggcggcagagaacagcatcacttcatcagagccggaggtcaggtcaacgccaatcagctcgtcgccgtcgttcaggttcaccgcgataataccggcagagcgcggacggctgaattcggtcagcgccgttttcttcacggtaccgctggcggtggccataaagacgttcacgccctcttcgtactcgcgtaccggcagaatagcggtgatacgttcgttcgcttccagcggcagcaggttgacgattggacgtccacgcgcgccacggctcgcttccggcagctggtacactttcatccagtacagacggccacggctggagaagcagaggatggtgtcgtgggtgttggccaccagcagacggtcgataaagtcttcttctttaatacgggcggcggatttgcctttaccgccgcgacgctgcgcttcgtaatccgtcagcggctgatacttcacgtagccctggtgagacagggtgaccaccacgtcttcctggctgatcagatcttcgatgttgatatcagcggtattggcggtgatttcggtgcgacgcgcatcgccaaactgttcacgaaccagttccagctcttcgcggatcacttccatcagacgatcggcgctgcccagaatgcgcagcagttcggcgatctgttccagcaactctttgtattcgtcgagcagtttttcatgctcaaggccggtcagtttctgcagacgcagatccagaatcgcctgtgcctgctgttcagtcaggtagtactgaccgtcacgcacgccgaattccggctccagccactcaggacgcgcagcgtcatcgcccgcacgttccagcatggcagagacgttgcccagctcccaggaacgcgccaccagaccggctttcgcttcggccggggtcggcgcgcggcggatcagctcgataattggatcgatgttggccagcgcaatcgccagcgcttcgaggatgtgcgcacgatcgcgggctttacgcagttcaaaaatggtacgacgggtcaccacttcacgacggtggcgcacaaacgcagaaagaatatctttcaggttcatgatcttcggctgaccatggtgcagtgccaccatgttgataccgaaggagacctgcatctgagtctgcgaatagaggttgttcagcaccacttcgccaacggcatcgcgcttgatctcaatgacaatacgcatcccgtctttatcagactcgtcgcgcaggccgctgatgccttccagacgtttttctttcaccagttcggcgattttctcaatcaggcgcgctttgttcacctgatacggaatttcatgcacgataatggtttcgcgaccggttttggcgtcggcttccacttccgcgcgggcgcgaatgtagattttgccgcgaccggtacgataggcttcttcaataccgcggcgaccgttaataatggcggcagtcgggaagtcaggccctggaatgtgttccatcagcccttcaacgctgatattttcatcgtcgatatacgccagacagccgttgatcacttccgtcaggttgtgcggcggaatgttggtcgccatacctacagcgataccggaggccccgtttaccagcaggttagggattttagtgggcatcacgtccggaattttttccgtgccgtcatagttgtccacaaaatcaacggtttctttttccagatcggccatcagttcgtgggcgatcttcgacatacggatttccgtataacgcatcgccgcagcggagtcgccgtctacggaaccgaagttaccctggccgtcgaccagcatgtaacgtaaggagaatggctgcgccatacgaacgatagtgtcatataccgcggtatcaccatgaggatggtatttaccgatgacatcaccgacgacgcgggcagattttttgtaggctttattccagtcattgcccaatacgttcatggcgtatagtacgcgacggtgaaccggttttaagccatcgcggacatccggcagcgcacggccaacaatgaccgacatcgcatagtccagataggagctcttcagctcttcctcgatgttaaccggtgtaatttctctcgcaaggtcgctcatgtaaccgctatccctctactgtgtcccggattcaaaggtcgcaaattataacacagcccgcgcgtgagaggtaaaccaatcggtttattcacgcccgtggcctgatatacttcacggtcttgatgataaaggagtaaaagcgcccatgaatgtcgaaaaaccgtcggtggctcataacgtcgaccacgatgaaattgcgaaatttgaagcggtcgcgtctcgctggtgggatctggaaggcgagttcaaaccattgcaccgtattaacccgctgcgcctgggctatatttccgaacgcgctggcggcctgtttggtaagcaggtgctggacgtaggctgcggtggcggcattctggcggagagcatggcgcgcgaaggcgcaaccgtgaccggcctggatatgggctttgagccgttacaggtggcgcgcctgcatgcgctggaatccggcgtcaacgttgactacgtgcagcggacagtagaagaacacgccgccgcccacccgcagcaatatgatgtagtgacctgcatggagatgctggagcacgtgccggatccacagtccgtggtgaacgcctgcgcaaaactggtgaaacccggcggccacgtcttcttctctacccttaaccgcaacggcaaagcctggctgatggcggtggtcggtgcggaatacgtactgcgcatggtgccgaaaggtacgcacgatgtgaaaaaattcatcaagccggcagagctgctgggctggatcgatgacaccgtgctgaaggagtgccatatcaccggcctgcactacaacccgctgaccgacaaattcaagctcgcgccaggggttgacgttaactatatgctgcatacaaaagcacgaaacgactaacgtcatgcgaaattgttatgaagattgcgtgacaggacgttacgcattttctcccgccgatgaagaaatcagcactcgatcaaatttcttattttttttgcaaatgattgactttccctggaggccttacagttcggggacttagcgattcttaccttttcgcaaccttaaattaacgccaaaatcaactcttgtactcaaaagaatccctactagaatactcaccatatagcgtttctcttatcgcaaaccccctacatgtagtatttatccacagagttagccacagcgcggacttgtggataagcgggggatattttttctatttcacggacaggtaaatcccacatgaatcagagtctgctggtgacaaagcgtgatggtcgtactgagcgcatcaatctggataaaatccaccgcgtactggattgggcggcagaagggctgaataacgtctccatctctcaggttgaactgcgttcacacattcagttttatgacggcattaaaacctccgacattcatgaaaccatcatcaaagccgccgccgatctgatctcccgcgacgcgcctgactatcagtatctggccgcgcgcctggcgattttccatctgcgcaaaaaagcctacggccagtttgagccgccgacgctgttcaaccacgtgctgaaaatggttgagctgggcaaatatgaccaccatctgctggaagactacagcgaagaagagttccgccagatggacgcctttatccagcacgatcgcgatctgaccttctcctacgctgccgtgaagcagctggaaggcaaatacctggtgcagaaccgcgtgaccggcgaaatctacgagagcgcgcagttcctgtatattctggtggccgcatgcctgttctcgaactacccgcgtgaaacccgtctggactacgtgaagcgtttctatgacgccgtatccacctttaagatttcactgccgacgccgatcatgtccggcgtgcgcaccccgacccgtcagttcagctcctgcgtgctgatcgagtgcggcgacagcctggattccatcaacgccacctccagcgccatcgtgaaatacgtgtcccagcgcgccggtatcggcatcaacgccggtcgcatccgtgcgctgggcagcccgatccgtggcggcgaagccttccacactggctgtatcccgttctacaaacatttccagaccgcggtgaagtcctgctcccagggcggcgtgcgcggcggtgcagccaccctgttctacccgatgtggcatctggaagtggaaagcctgctggtgctgaaaaacaaccgtggcgtggaaggcaaccgcgtacgtcacatggattacggcgtacagatcaacaaactgatgtacacccgtctgctgaaaggtgaagacatcaccctgttcagcccgtctgacgtgcctggcctgtacgacgccttcttcgccgatcaggacgagtttgagcgtctgtatacccagtacgaaaaagacgacagcatccgcaagcagcgcgtaaaagcggtagatctgttctcgctgatgatgcaggaacgtgcttccacgggccgtatctatatccagaacgttgaccactgcaacacccacagcccgttcgatccggctattgctccggtgcgccagtctaacctgtgcctggaaatcgccctgccgaccaaaccgctgatggacgtgaacgacgaaaacggcgaaatcgcgctgtgtacgctgtctgcgttcaacctcggcgctatcgattcgctggacgagctggaagagctggcgacccttgcggtacgtgctctggacgccctgctggactatcaggattacccgatcccggctgcaaaacgtggcgcaatgggccgccgcacgctgggtattggcgtgatcaacttcgcttactatttagcgaaacacggcgtgcgttactccgacggcagcgccaacaacctgacgcataaaacctttgaagccattcagtacttcctgctgaaagcctctaacgagctggcgaaagagcaaggcgcctgcccgtggttcaacgaaaccacctatgcgaaaggtattctgccgaccgatacctacaagaaagatctggacgccatcgtcaccaaagagctgcattacgactgggaagcgctgcgcgaatccattaaaacgcacggtctgcgtaactccacgctctctgcgctgatgccgtccgagacttcgtcgcagatctccaacgccaccaacggtattgaaccgccgcgcggccacgtgagcatcaaagcgtcgaaagacggtattctgcgtcaggtggtgccggattatgagcacctgaaagacagctatgaactgctgtgggatatgccgaataacgacggttatctgcaactggtgggcatcatgcagaagtttatcgaccagtcgatctctgccaacaccaactacgatccgacgcgcttcccgtcagggaaagtcccgatgcagcagctgttgaaagatctgcttaccgcctacaaatttggcgtgaagacgctgtattaccagaacacccgcgatggcgcagaagattcacaggatgacctggtgccgtccattcaggatgatggctgcgaaagcggcgcgtgtaagatttaataaattgcccggcggcgcaaagcctgccgggcctgaggttaggttttgtaggccgggtaagctttgcgccacccggcgtatcattgcaggacaggaaatactcgcatggcatacaccaccttttcacagacgaaaaataaccagctgctggaaccgatgtttttcggccagccggtgaacgttgcacgctacgatcagcaaaaatatgacatcttcgaaaagctgatcgagaaacaactctctttcttctggcgtccggaagaagttgacgtctcccgtgaccgtatcgacttccaggccctgccggaacacgaaaagcacatctttttaagcaacctgaaataccagacgctgctggattccattcagggacgcagcccgaacgtggcgctgctgccgctgatctccattccggaactggaaacctgggtggaaacctgggcgttttcagaaaccatccactcccgctcctacactcatatcattcgcaacattgtgaacgatccggcggtggtgtttgacgatatcgtgaccaacgagcagatcctcaaacgcgccgaaggtatttctcactactacgacgatctgatcgagctgaccagctactggcatctgctgggtgaaggcacgcataacgtcaacggcaaaaccgtgaccgttaacctgcgcgagctgaaaaagaaactgtacctgtgcctgatgagcgtcaacgcgctggaagcgatccgcttctacgtcagcttcgcctgctctttcgccttcgccgagcgcgagctgatggaaggcaacgccaaaatcatcaagctgatcgcccgtgacgaagccctgcacctgaccggcacccagcatatgctgaacctgctgcgcagcggcgtggacgatcccgagatggccgagatcgccgaagagtgtaagcaggagtgctatgacctgtttgtactggcggcggaacaggaaaaagagtgggcagcctacctgttccagggcggctccatgatcggcctgaacaaagacattctttgccagtatgtggattacatcaccaacatccgcatgcaggccgtgggtcttgatttaccgttccagacccgctcgaacccgatcccgtggatcaacgcctggctggtgtccgacaacgtgcaggtcgcgccgcaggaagtggaagtcagctcttatctggtcggtcagattgattccgaagtgaacactgacgatctgagtgacttccagctctgatgagccgcgtcattctgcgcatcactggcacagaactcctgtgccaggatgaacatccgtcgttactggcggcgctggaatcgcaccaggtggcggtggaatatcagtgtcgtgaaggctattgcggctcctgccgcacgcggctggtggccggtcaggttgactggctgaccgagccgctggcctttatttccgccggtgaaatccttccctgctgttgccgtgcgcgtggcgatattgaaatcgagttatagcgcgtcagattttccgcaaatgaattaatttccggcgtttattatttcagctccccaaacgtcagcagctaccgcaaataatataaaaaaaccctgaacagcactgttcagggttaaattcctggttgacatcactcacacaggaataactagctctcctttatttcttccggatgatgatggagttcactcacccgataataaataggggtaatatcgacataattgatgcagtaaccgcttccgcgcacgctggtgataaaatcttccggcagccctaacagactaagacgacggttaagattcttcagaacctgccacagacgctgggtggacggaaccagatcgttctcctcccacaccacgcgcagcagttcctctttggtcacgatgttctggcggccatgctggagtaaatagataaatagctgcaacatcgtatgattaaataatactgagccgaacataaaatatttctcagtacttccctgcggaaggcggtaaagtcttccgttgtcaatttcgaagtgaacttctttgcctatcacatagccgtacagccgatatcccatcgtgtcgttgctcatttgtcctgaaactttgcaaggaatgccttttttattcctgttcataggccatactgtcaataaggtcgattatatggctatgggaattagtttcaacatacagggggaaggttattttggcacaggccatcgcacgtcgacaaaatatttacacaacctaagtaaaatattaagcatctatccgcgcaaattgaactacaaaaagtccagacacctgcaggatgatcgctatccggatcattaactttaaatattaatttatgccttttttgcaggataaaatgctggtcaggaatatcgcgcaaaaaaatgcccctccggacggagaggcatcagaccagggttaaccgcgtttacgggctattgcttcgtgatgctttttctcaccgatcatcaccaccagcaacagcagcacagcgatgacgctaccgccaatcatcaccataaagccgccgtcccagccgaagaaatcgacggtatagccgacaatggcgctggccgccaccgagccgcccagataaccaaacaggccggtaaagcctgccgccgtccctgccgcttttttcggtgccagctccagcgcatgcagaccaatcagcatcaccgggccgtaaatcaggaagccgatgacgatcatgcagatcatgtccaccgtcgggttgcccggcgggttcagccagtacacgacggtggcgatggtcaccagcgtcataaagaatacgccggtcgcgccacggttgcccctgaacactttatccgacatccagccgcacagcagcgtgcccggaataccggcatattcatacaggaagtaagcccatgacgacttatccagcgcgaagtgtttcacctctttcagataggtcggcgaccagtcgagaatgccgtagcgcagcagataaacaaaaacgttcgcaatggcgatgtaccacagcaatttattcggcagcacatactgcataaagatctgcttcgcggtcagctcttcttcggttttttcgctgtaatcatccggatagtcgttcttatattcttcaataggcggtaatccgcaggactgcggggtgtcgcgcatcagggcaaaggcaatgaacgccacgacgatagccgcgaacgccggcatatagagcgccgctttccagtcgttgaaccacgccatgccgagcaggaacagcaagggcgggatcccgccgccaacgttatgcgcgcagttccacaccgacacgatgccgccgcgctctttctgcgaccaccagtgcaccatggtgcgtccgcacggcggccagcccatcccctggaaccagccgcataaaaacagcagcacaaacataatggcaatgctggaggtcgcccagggcacaaagcccataaacagcattacggcggcggcaaggatcagccccgccggtaagaagacgcgcggattcgagcgatccgacaccgatcccatgatgaatttggaaaagccgtaggcaatggaaatccctgacagcgcaaagcccagatcgccgcgggaaaagccctgctccaccaggaacggcatcgccagcgcaaagtttttccgcaccaggtaatacgccgcgtagccgaagaaaatgcccataaaaatctgccagcgtaaacgccggtaatacggatcgatctgctgctccggtaaccggggttgatgcgcggcaggtttaaagatgctcaacataaagcctccgtggcatgtgttgttttgtaatgagtgaaaacgagcgtcacgccgcctcaaaagcgtgcgacgagtgaagactggacgttaacgcaggaaaagtcgcgtcgaatgttacagaaatatgacaaggcgctcaattcacgcaacaaatgttcttttactttcgttttatgcgcgaatatgcgcgcaatcaaacaaaccacacaaggaatgtggctaaatgcgcaataagggtcattaagataagagggaagcgaaaatgcgcgacgtgactgagtacgacgtcatcattatcggcggcggcgcaaccggggcggggatcgcccgcgactgtgcgctgcgcgggctgcgtgtggtgctgctggaacgccacgacatcgccaccggcgccaccgggcgtaaccacggcctgctgcacagcggcgcgcgctatgcggtaacggatgaagaatcggcgcgggagtgtatcagcgaaaaccagatcctgcgccgggtcgcccgccactgtattgaacccaccggcggtctgttcattaccctgccggaagacgatctggcctggcagcaacagtttatcagcgcctgtacccgtgccgggatcgccgcacagccgctgtcggcggaagaagcgctgcgcatcgaaccctgcgtgaatcccgcgctcattgccgccgtgcaggtgccggacggcaccatcgatccctttcgcctgaccgccgccaacatgctggacgcccgcgagcatggcgcgattatcttaaccggccatgaagtgatcggcctgctgcgggataaagatcgggtgaacggcgtgcagatccgccatccctcaacgcaggcggtgcagtccctgtacgcgcctgtggtggtgaatgccgccgggatctggggacagcgcattgcagagtatgcggatctgagcatccgcatgttcccggcgaaaggcgcgctgcttattcttgatcaccgcatcaaccagcaggtgatcaaccgctgccgcaaacctgcagacgccgatattctggtgccgggggataccatctcgctgattggcaccacctccacgcacattgattaccgtgatattgataacacccgcgtcacgccggaagaggtggacgtgctgctgcgcgagggggaaaaactggccccggtgatggcgacctcgcgtattctgcgcgcctatgcgggggtgcgcccgctggtggccagcgacgacgaccccagcgggcgcaacgtcagccgcggcattgtgctgatggatcacgccgaacgcgacggtatggaaggctttatcaccattaccggcggcaagctgatgacctaccggctgatggcggagtgggccaccgacgccgtgtgccgcaaactcaataatacgacgccctgccgcaccgccagcgaaccgctgccgggatcgcgggagtctgccgctcagaccctgcaaaaagtgatctccctgtcagcgccgctgcgcggctcggcggtgtggcggcatggcgatcgcaccccggaatggctcggcaacgcacgtcttagccgtagcctgatctgcgaatgcgaagccgtcactgccggagaagtggagtacgcggtggataatcttaacgtccgttccctgcccgatttgcggcgtcgcacccgcctcggcatgggcacctgccagggcgaactctgcgcctgccgggcggccgggttgctgcatcgcctgaacgtcaccaacgatgcgcaatccatcgcgcaattgtccgcatttttaaatgagcgctggaaaggcatccgccccgtcgcctggggcgatgcgctgcgggaaagcgagtttacccgctgggtataccagggactgtgtggtctggaaaaggagacgacagatgaagtttgatacggtgatcgtcggcggcgggctggcgggtctgctgtgcggcatcaggctaagccgcagcgggcagcgctgcgccattgtcagccgcggacagagcgcgctgagtttttcctccggctcgctggatctgctctcgcgcctgctggacggcacagcggtgcaggatactgccgccgggctggccgcgcttgaaaccctcgccccggaacatccttacagcctgatcggggccgggcgcgtgtaccagtacgcccgcgaggcgcaaaacctgctggcagaatgcgggctgaaatttcagggtgatgccagcgccccgcaccgccgcgtgacgccgctcggtatgacgcgtccggcgtggctcagcccgccggaagtgccgctgtcgccgcgcaaaggagagcatatctgcgtggtcggcatcaacggttttgccgatttccagccccatctggcggccgcaacgctgcgtaaacagggcctgcgcgtcacggcaacggacatcgatttacccctgcttgataaactgcgcgacaaccccagcgagttccgcgccgtcactattgcccgccagctggatcaggatagccatttcgctgaactttgcgccgccctgcgcccgctcagcgaaacccatgacgccatctggtttcctgcctgcttcggcctgacggacgacaaggtttatacccggcttaatgctgaactcgcctgcccgctgtacctgctccccaccctgcccccgtcggtaccggggatgagaatgcagacgctgctacagcagcagtttatccgcagcggcggcgcgtggatgccgggggatgaggtgctgcgcgccactctggataacaacgtggtcagccagctgtggacgcgcaggcatgaggatattccgctgcgcgccgatcatgtggtgctcgccagcggcagttttttcagtaacgggctggtggccgggcgcgacggcgtgcgggaaaaggtattcggcctcgatgtgctgcacagccccgatcgcgccagctggtatcgcgataacctgtttgatgcgcagccgtggcagcagtttggcgtgcgcaccgatgccaccctgcgcggacaattacagggcgaacccctgcaaaatttatacgttatcggctcggtactgggcggctatgacgccattcaccagggctgcggcggcggaatttgcgccgtgaccgcgttacatgtcgcgcagcaaatctgcgcgccgggaggctccgaatgaacaccactcacttcgacagctgtatcaaatgcaccgtctgcaccaccgcctgtccggtaagccgcgtcaatgtcgactatcctggcccgaaacaagcggggccggacggcgaacgtctgcgcctgaaagacggcacgctgtacgatgaggcgctgaagtactgcaccaactgtaaacgctgcgaaaccgcctgtccgtccggcgtgaagatcggcgacattatccagcgcgcccgcagccagttcgcgccgcgtaaaccttcactgcgtaacgccattctcagccataccgatctgatgggaagcctgtccacgccagtcgccccgctggtgaatgccgccaccggcatgaaaccggtgcgcctgctgctggataaagcgctgaaaatcgatcaccgccgtaccctgccgaaatattcccacggtactttccgccagtggtatcgcaaacaggcggccgtacaggcggcatttgatgaccaggtggccttttttcacggctgttttgtcaattacaaccatccgcagctgggaaaggatctgctgcgggtgctgaacgcgatgcaaatcggcgtacaactgctggagggtgaaaaatgctgcggcgtgccgctgatcgccaacggcttttttgaaaaggcgaaaaagcaggccaatgccaacgtcgcgtcattaacgcgcgccattagcggcaatggcctgccagtgatcgccacgtcttcgacctgtacttttaccctgcgggatgaatacccacatttgctggatatcgataaccgcgcgctgcgtccgcatatcgatctggcgacgcgctggctgtggcgcaaactggaggaaggccgccgtctgccgctgcgcccgttgccgctgaaggtgatctaccacacgccctgccatatggaaaaaatgggctggacgcattacaccctggaactgctgcgtaaaatccctgaactggagctaacggtgctggagtcgcagtgctgcggcattgccggcacttacggctttaaagcggagaactatacgacctcacaggcgattggcgcgccgctgttccggcagattgaggagagcggcgcggatctggtgatctcagactgtgaaacctgtaaatggcagattgaaatgtccacccgcctgcgctgtgaacacccggtgacgctactggcgcgggcgctgggataacctaacgttgcccggcggcgctgcgcttgccgggcctgcgacattgtcaccgtaggcctcgtaggccgggtaaggcgcagccgccacccggcattctgctacttcgtccccgccgtcaccagagtatcgacaacattgatccagccatgatcgctggcgacgtctttacccagcaaccagcgacgcagcatattcagcgccatcatcgcgcagacttcctggcgaaccgccagaccgtggcggttgacgctgaactgcacccgcagcgcatgtacgccatccggcgttgccagcgcaaagttcaggtgctcatcatccataccgccgacaaataacgccagcccggccagatgacgatcgcgcagcgccgccgcccagcgcgccgactgctccagattatccgcctgcgacggcagcacttcgctggccagcaacggcgcttccgcacgggaaagttgcagcgccaccagcccgctggtgaactgctcgctcagggtcaggctcagctgtcgttcccgtagctgacgggcgatcagcgccggtaacccttcggtgccttcaaaaatcaggctttcgcccgccacgcgctgcacttcaggccacagggcttccatctgctcgcgcgcgtctgccggaccggtcagcttgagttcaataatcggcatggaagagcgatagcccatcaccacgccgtccggcagttgcagatgttccaggctctgggcgagatcgctttcggagcgaccaaaagtggtcagacgcaggcacagcggcggcgagggcagcgtaaagcgctcgcgcaggcgcggcagaatttcgcgctccaccatcactttgaattcagagggcacgccaggggtgaaaaacatcaggcagcggttaagctgcatggcaaagccgcaggcggtacccacagggttatcgaccatctcggcgctggagggaatttccgcctgtttgcggttgctcggcgccatcaccttgccacgttcagagaaaaaacgctccatgtgcgcaagccagtcttcatgcaacaccagcccctcgcccgccgccgtagcggcagccagcgcgctcagatcgtcgctggtcggcccgaggccgccgttcacaatcagcacatcggcgtgttcgctgcgctcgcgcagtatggcgacaaggctgtcgagatcatcgccgacggtctggcggcgcgttaaaggtaatccctgattaaagaaaacatcagccagccacgcggcgttagtgtccacaatttgtccgtgcaacacttcatcgccggttgacagcatttccacgtttaacattcttttctccagcattagcggtcaaaacactataacgcatggcgggggaatgcaggagggaaactggcgcggcagggtgccgcgccggaggatcagaagctggcgctcacgccgacgtacgggccgtcggccagtttgctgtcgccgttgccgtctttgccgctcagatcgatatagcggtaacccacttcgacgctcagcggacgcagcacggaaatacgcgcgccagcgttggcttcagagaaatctttcacgccgctggagagcgagtccggcgagtaataatattcaccgaacagcttgatgctctcgccaatcggcagctgtaaaccgccacccacggcggcggcgtagccttcgtcaccttcgttcgggttcaggtagacgcctttaccgccgacggttgccataaacgggccgagggggagattaaggccgaggcccagaccggcaatatcgccgtgatcgtcgttgtgcgcccagttgccgctcagcgccaggccgctggtttcggtgcccattcccacgccaatattggtgtaatcttcacccgcctggccgctgatgctcagggcattcgcgcccgcagaaacaaacagcaggctggtcagggtcattaatgcaatctttttcatcgttcactatccgcgcaagtaattgttagacgttctgaaaagcgccgctagtgtacagggctttgccttaacactctgcaccaaaagtgattttcccgcttcgttgtcatctcaatgcttttgggtatctctctgatagacagagccagattgcccgcgatcaagactcccggtaaaaacaagccctaaagtgatttctgaagttatacggaaacacagccgtttttttgacttccaccaggagatgtatgatgaataaaaaaggattaaccaccgccgctggcgcgccggttgcccataataataacgtgatgaccgccgggccacgcggcccgatgctgttgcaggacgtatggtttctggaaaagctggcgcattttgaccgcgaagtgatcccggagcgccgtatgcatgccaaaggctctgccgcctacggcacctttaccgtcacccaggatatttcccgctatacacgcgctaaaatgttttctgaaccgggtaaaaagactgatcttttcctgcgtttctccacggttgccggtgagcgcggcgccgctgatgcggaacgtgacatccgcggtttttcgatcaaattctataccgaggaggggaactgggatctggtgggcaacaacacgccggtgttctacctgcgcgatccgctgaaattcccggatctcaaccacgtagtgaaacgcgatccgcgcaccaacctgcgtaacccgacctacaaatgggatttcttctcccatctgccggaatcactgcatcagttaaccattgatttcagcgaccgcggcctgccccgttcttaccgcaatatgcacggttttggcagccacaccttcagttttattaatcacaataacgaacgcttctgggtgaaattccatcttaaaaccatgcagggtattgataacctgatggacgatgaggcgaaacgtctggtggcggaagatcgcgagagttcgcagcgcgatctgtttaacgccatcgaaacgggagatttcccgcgctggaagttttacgtgcagatcatgccggaagccgaagcctcacaggtgccttataacccgttcgatctgacgaaagtctggccgcacggcgattatccgctgattgaagtgggcgtactggagctgaaccgcaatccggataactactttgcggaagtggaacaggtggcgatgtccccggcgaacatcgtgccgggcattggcttctcaccggatcgtatgttgcagggccgcctcttctcttatggcgatgcgcaccgttatcgtctgggggtgaaccatcaccagatcccggtcaaccagccgcgctgcccgttccataattatcaccgcgacggcgcgatgcgtgtggacggcaacagtggcaacggtccgacctacgagcctaacagcttcggcgttttccaggagcagccggactacagcgaaccgccgttgtcggtggagggcgctgcggatcactggaatcaccgggaagatacggactatttcagccagccgcgcaagctgtttgccctgatcggtgaagaagaacgccagcgcatgtttgcccgcatcgcgggagatatgaaagatgtgccggaatttattcagcagcggcagattggtttattcagcgaagtggatccggcgtacggggcgggtgtcgccgccgcgctgaacgccattaacaccgcccgataacatcaacaccttgcccggcggcgcacgcttgccgggcctacaatgtcaaaagagtaggtcgggtaagcgcagcgccacccgacattgagttcacaccgtcgccacccagtgctgtaaggcgcggcgggagattttgatgccgccctgcgccaggtgatcgggcagcggcaaccagcggatcggttgctggaagcgggccagtttatcccggcaccagtcggccagcgctgacgacgggtagccgtcctgcaactccaccaccgccacggatcgatgaccaaattcggcgtcctctttggggacgataaacacctgccgcacctgtggatgtgcggcaattacgcgttccacttcttccggctggatcccttcaccgccgctgaaaaacagattatccatgcggccagcaatggtcagacgatcgccctccaacaggccacgatcgcgggtggcaaaccagccgtcggcattgcccagcggcaccagattcccgtcacgccagtagcccgccgccatgctggccgcgcgcagccagacttcgccatcgacgattttcacttcgcgcccaggcaacgcactgcccacatccggcagcccgtcggcttctttggcgcacaccgtggaggcgaattccgttaagccataaccgcaccagctgcgaatgccgcgcttgcgggcgagttctgtcagctccaccgggatggccgcgccgcccagcagcaccgctttcagcgccacgctggcgttgtcgttgagtaatcgccacagctgcgtcggcaccagcgaggcatgggtgcagccctgcaacgccagctgcagaggcattttttcgcgcacggtgatgcgcgcccccgccagcagccagcgccataaaatcccctgtccggagacgtggtacagcggtagcgaaagcagccagtcgtcctgttcactgaaaggcatcagcgacagcacgcccgccgcgctcgccagatgcgcatcaggcgtgtgcaccgccgctttgggcagaccggtagagccggaggtcagcgtcatggtggcgagccgctgcccttcccagggcacggcatgatggccgctaattacgccagcttccagacgcgaaagcccggcgtagtcgccgtaatccgccagatccagcgcatggcgcagcgtcattgacggcaacagctcgcggagaagcccgtcaggtagctgcggatttaccggcagaatgcgcgcgccgcattgcagcagcgccagccacgacagcagggtcagcggatgattacaggcgcgcagcatcacgccgtcgccgcactgtacgccctgggcggcaaagccgctcgccagcgcatccacccgctcgcacagcgcctgccagctcagcatctcatcgccgaggcggatcgccgccgcttccgggcgctgttcgcgccagtgtcgccagggccagtcgtgaaaggtcacagcagcggctccaggacgtctgtttgcaggcagggcagcgcgctgtccggccagcggcgcagtaattgcgcctgcatcaggttaagcgtatccagacctggcgtggtagctggcgtcagccaggcggcgatgcgcgccagctgcgtcaggcccaggctggattcaagagaggagctgatcaccgccgtcaggccgagggcgtgggccgcttcaacctgctggcgcactttttcgagactgccggtcagcgttggcttgatcaccaccgcgcttatgccctcctccgctataaaggtaaaatcatcctcgcgcaggctttcgtcccaggcgatggcgatgccggtgtcacgggcaaaggcgcgggaatcatcacgggttttacagggctcttcgagaaaagcgatacgatggcgatgcgtcgggttgacgtatttggcgaactgctgggcttttagcggcgtccaggcgcggttggcgtcgaggcgtaaatgcagctccggcaccgcctccagtaacagattgaccaccatgccatcgcgcaccgcttcatacagaccgactttcaccttcgccactttctcgcccggcatggcggcaagggcgacgatcagctcgtccggatcgccggtacagagcggcgcagcgcgatagttacctgccgcgggtaattcatcgtgcaactccgccagcgcgcagcttaatccaaaggcggcggaaggcgctgagggccaggccggtgagtcgccagccagccaggcgtttacccagtccagcgcggcgcgctctgcgtccgccagtgattcacggctgaagcccggcaggggggcgatctcgccccacccttcccgcccgccgtcacgcagctgcaccagcaggccatcgcgggttttcagacgctgttcacgcagcacgacgcccgcatccatcggcagctgccagcggtaaacctgcgcctgacgcattacggattccgtttgtatttgctgaagtcgggctggcgtttttcgttaaacgcgttgcggccttcctgaccttcttcggtcatgtagaacagcatggtggcgttgcccgccagttcttgtaaaccagcctggccgtcgcagtcggcgttcagcgccgctttcaggcagcgcagcgccatcggactgttttgcagcatttctcgacaccagcgcacggtctctttttccagatcggcaaccggcaccacagtgttgaccagccccatctccagcgcggctttagcgtcgtactgacggcacaggaaccagatctcacgcgcttttttctgcccgacgatgcgcgccatataggatgcgccccagccgccgtcgaaagagccgactttcgggccggtctgaccgaagatagcgttttctgccgcgatggtcagatcgcacatcatatgcagcacatggccgccgccgatggagtagcccgccaccatcgccaccaccggtttcggacaggtgcggatctggcgctggaaatccagcacgttgagatggtgcacgccggagtcatcctggtagccgccgtagtcgccgcgcactttctgatcgccgccggaacagaaggctttatcgccttcgccggtgaggatgatcacgccgacgttatcgtcgtaacgcgcatctgccagcgcctgcatcatctcttttaccgtcagcggacgaaacgcattacgcacctgcggacggttaatggtgattttcgcaatgccatcggtggacttgtggtagcggatatcggtgtagccttcggaacagtcgagccactcaaccggcgcgtaaagcattgtttcatctggatagatcataaggattccttagtgaagacgcagaatatgcgccagacgggccgccacagcggcggggttttcccggtgggcgttgtgtccggcgtcagcaattaacaggcaaggcgcggcgagttcatcgccgatggcgcggaatttcgcgtcgtgctcgccacataagtagtaaaacgggaaatgtcgctcacttagcgcggcgcgcagatccggctggcgtgacagcgaggtggcgtcgagcatggcggcaagcgcggtaccactgttgtgctgacgtaacgccaccagcgcgcggcgctgttcagcgctgagggacgcaaaaaccggctgctgataccagtcgatgaatacgtcctctgatggttcatggcgaaaccgcgccgcccagcgggcgtcgttttccgcgcgctggcgacgggcggcggcatcggttaatcccggatgcgccccttcgacaatcagccctgccagacccggcggttgcgcacaggcgtgatacatcccgaggcgaccgccgagggagtagccgatgagccagtattttagtatgttgtaactaagaagggtgttactgagcaacgcgctgacctgcgcaaaatccgccgctgtaatatctgccgagccgccgtgccccggcaaatcaatatacagccgggaatgatcgcgaaactgctcgcccaccggctgccattcgcggtgatcgccggaaaaaccgtgcaggaacaccagccacggcagcgcggcgttagcggcttcagcgcgggcatgcaggatcatagctggctgactcccgccagcagttgctggagcgtctgcgcgccgtcggtttcgctgaccaccagttcgataatcgtcgcctgcggcctgcgccacgcctgcgtcagcgccccgtccagcgcctgccagctttccgggcgatggtaatgcaggccaaacatggcggcggcatgttcaaaatggacgttctgcggcatctggtaaaaacgttcgcgttcagctggcggcgtgggcagcagggagaaaatctgcccgccattgttgttcaccaccatcagcacgaagggtgcggagacctggcgcagtaacgccaggccattgagatcgtagagcgcggagagatcgccgacgatggccagcgtcggtttaccgctggcgcgctgcacgcccgccgcggtggagagtaagccgtcgataccgctcgccccgcggttgctgtacaccggataacccgcgggcagctgcccgagcgcatccaccagacgcaccaccagactattgcctaaaaagagctgcccctgttccgggagatagtccgccagacggtgcgccagctgcgcctcgccgaacgtctcacgctgcgcttccaccgcctgccaggcctgttgcgccagcgccgggatgtcgctgcaccagggcgcgcgaggttccgccggatgttcatccagccagtcgccgatggcggacaccagccgccgtccgcgatgatgcgcgggatcaagccgtcccggcaggttgtccaccagccagtactcttccggctcgcaggcggcctgccactgaagcagccgttttccggtcaggctgctacctaactggataacaatctgcgcctgcgccagctcggttaccgcgcgggcattgcccagccacagatcggcacagggcagcggttggccggtctgcgacagcacgtcgccaatcagcggccagccgagcgtctgcgcccattccgcagcctgtttgccttcggcagcgctcatccgcccggccaccaccacgccgcgcttttgccgccagaaaaaccagtcgcgctggcgggcgctgtgtagccgggtgttttcccgcagccagggcttatcgctgcgccaccagtcgccaagctgttgttgccagtcgaggccggtggcatccagttcgccatacagcggttcggcaaaggggcagttaatgtgtaccgcgccgcaatgcagcgatccgagaagattatcaatcgtactcaccagccagcgggcgggaatgtcctgggtcgggcgcggaagcgacagcgcctgtgcgggatgggaggcgaagataccaggctggcggatcgcctgatttgcgccgcagtcgatcagctccggcgggcgatcggcggtgagcaggatcagtttttcgccggtcagccccgcctcgatcaacgccggataaagattggcgactgcggtaccggaggtgacgataaccgtcaccggctcgccgctgaccttcgccagcccgagcgccagatggccgaggccacgctcatcaaaatgggtatggtgaacgaaggctttatttcctgcggcggccagcgtcagcggcgtcgagcgcgagcccggcgcgatgcagacgtgtcgcacgccgtggcgggttaaggcttcgagaatgacttcggcccagcgtcggttgaatgagcttactgacataagtttgtccggtatcaatattacggcacagtataaagaacacagaacgccgggtttttgatatgaatcggtaatgagtgaatctgtcttaatccatcaggagtacggagcgcaaaccggccgctttgttttcgatctcctgccattcgagttgcggatcggaaccggcgacgatcccggccccggcgtagagccgcaccctgccgcctgagacatgcgccgagcgcagcgccacgcaaaattccgtctgctgaccggagaggtagcctgcggatccggcataccagtcgcgggaaaagggttcatgctgccggataaattcctgcgccgcctcgcgcggcaggccggccaccgccgcggtgggttgcagctgatgcagacagtgcgcgtcgtccggcgcgtttagcgtcatccagatgcagcggcgcagatgctggacttttcgcaggcgcacgacctgggcgggaagaatatcgtagccgttacccagcggttccagccgctgacagatatcctccaccaccagctgattttcccgctggtttttgtcgtctgccagcagccactggccgagggcatgggcgcgagcgtcgtcggcatggttttcaatagtgcccgccagcgcttcggtgcgcagcgcgcggtcaatgcgccgccacagccgttcggggctggaacccagaaacgcctcctgcgggctgaacgctatataaaagtgataacagctgaaattgacgcttcggctggcggccatcagcgccgcagcgttcaccggctggctgaagtgcaaatcgctggcgcgcgccagcaccactttgtccatctgctgccgttctatggcctctgtagcgagacgcacccgctggcaccagccgtcgtgatccgggctgtgttgctcgccggtcagatggaggtgcagggctgaaaacggcgtggcggggcgtaactggtcaaggaatgctgcggcgcaaatggcatcgtcgcgcagggaggtttcactccagagagtcagatacagccgggcctgctcgccctcacgacgccattcgagacgcggcaggaacagatcgccacgctgtggatcgaaggcgttcagcccccagatgcgcagttgcgcatcgccgctgtgctgtagaaatgtttgtgcgtcggcaagggagctaaagcgccggagcgcgccgagggcggcagcctcgtcttcattgccgcgctgctgccagtaaaactgtggaaaatgaggttgtccggcaagccaggcgaggggatcgcgggactcgtcaaacgccagcggaatgcacaggcggcgcagaccgggctggtccggcaacggcgttgccagttgctgtctgagctgccacaacgcttcatctattatcgccacgaatgatcccacccttttgcataaacccggacattatacggggttgttcgtgtaaaaaaagacaccccgccggggcggggtgttttggtttgatgagctggtttttgcccggcggctcttcgcttgccgggcctacaggttgtggcaggccgggtaaggcgctgccgccacccggcaaaccatcagaacttatacttgtagttcagcataaagcccttgtccttcacgccgtcttcctgccactggaaggcatccgccgtgaactgcgcgttaccggcgctgtatttcacgcccgccatcgcctggccgttcacgccgccgccctgctgggcatcgtcaacgctgaacgtctggcctctggcacccgccagagaagccgtacggttgctcttcgcatagctcaggttcgggccgccttccagcgacgctgtcgctgcccagccgtcttcacccgcgtagctcagcttcagacccaccaccgcatcaaccgccgtttcgctgctgctgctcatgctcaggttgaagtcgcccgcgcctttctcgctgtagccgtcttccatggtgtgacgcattttcagaccggcaaacggcgttaccgtcaggccttcctgcaccttgaaggcttttgacccttcggtacgaaactccatgtactgctggcgggtgtcggcgttcgccgttttgttcacgtcgccgtaacgtaccgcacggttgctgtcgaagttatgcacgtcataacgcagggcgttatcccagttcaggccgccttccgtcagcggcaggctgtgcttcagccccaggaactggctgtaaccgcccgtcacgccgttgtcgccggcgctcatcgcattaccatcaccgtccagacgggcgataccgtactccatggtcagcgtctggttgtcaccgaacgccaggctctggcgcagcgccagcatgtcgtaggtggtgtcattacccagctcggcacgcttgtcacccttcgccaccacgttgaacgccagaccgttattcatcaccggtgccgtgtccgccagcatgtcgaagcggttgctcaggatacgcgcatcgcgggatacgccggtcgccttgctgccagaaatctgcttcagggcgctggtcagctccgcgctggttgccaggttcaggctgttgtacagctcgttgctggtgtaggccgcatccagtgcattcgccacgctgttgacgctcgcatcgcccgccacgtccgcataggcgtttttggtcatggtgacatccacgttaccgctggcgtccttctcaccttccgctgtccagaccacgctggcggaggtgatgttctgctcaccctgaatgtcttccccgacaaagacgtcgttgaaggtcacagaggtgtccgccgtacccgcggtaaagccggtgtcaacgttcacgtcctgaatgtcaacgtggctcgccgtcagcgtacccgcactgccgtctgcgctggtgccgacggtgtactggttgatgctgctgcgcagaccggtgctctggggtgccacagtcggatcggtcggcagcgtataagacgcgtaatgcgcttcgctcttgtctgccgtattgccgttaaccccggcaacctcgacaccactctctttcaccagaccgctgccgctaccttccagatttaccgtgccattgttaacgatacgcccgttcgcgcccagcttgctgaaggcgtaagagttggacgcatagatgttgatcgcgccgttgttctcgatcaccgcgtcagccgtggcgttcgcgtccagctgcatggccaccatgccgctttcagtggtgcctgcggtacccaggttaatggtgccgttgttcaccagctgggcgttattgctgcccttcatgccgactgcgtcgttgccattcacgttcatggtgccgtcgttgacgcccacatagttactgtgcgtcagactgaccgcactctggccggtttgagaggcggtaaagttcaccaccccgtcatcctggttccagaagaacgccttgctggcagcggcattatccgcagatcttactacagaggtcattcccgagccgttgaccgtaccgtcgttaataaagtcagccgttccgccccagatattaaacgccgccgcatgactgctggcggtaaaattcatggtcgcgcccttgtcgtttttcacggtgctgttgtcattcatatgaacagcattttttatattatcacccgtcattacgccaccagcggcgttttcaaacacgctgttctttttcatctccagcatgctggcattcgctttgtcggatgcgctaccgagcgaaaacgcgccgctgttggtaatatgtgcagtgtcccccagaatcgcgccgcctgtaataataccgtcgcttaccaccttgccggaagcatttaccgcaatactttgagtgatggtaccgctgttattcacggtcccggtaacagtaaggggcgcattaacgattcccgtcgcctggttttcaagagtgccgtccacaaatagccggcctggaccattcagcgtgccggtattacttaccgtactaccggttagtattacgccacttttatctaaggtggtagtgtcgctcagaatggtaccgtcagcatattcaatggatgtgaattcgtcgctattatcagcagccgccggtacacctgcactttcattaacattaatctcaccacggttaataatacggttattcgcatcgccgtcggaataaaaggcaatcccgttttcagcgttaatattaatcacgccggtagtatcgttgatggcgctaccgccctcatataccgccataccgactaagggttcgtcgccggtatagttttcgttctgatttaggttgatggtgccctgattaatgacgacgttggtggcaccgactgctgccataccggcaccggcgttattaacagtaatgattccaccctcgtggtttattgcggttccgtttttgccatgggtataggtattaccggcccccatgccaacggcataatcaatggctttatcagagggaaccccttgcgcataagtggtgtcatctccttctgccacccataatgcatccgtggtgatttgcccgtagttatctgccgttgaatcctgggcatgtaatgcttcaccgcggccatacaatgtgagtgagccattattaatggcctgtgcgcccttctgagccgtcataagaacgatggagcctacatcatcattcgtcatttgaccgctttcgatgtcgcccgcaggcaggatgcttcctcggttaagcagatatccggtaatgctaccctcgttacgtacaagggatcctttattcatggccgttggccctaccaccacggcgccatccgttcctgcggaaaccatcgttttttcgagcgtaatttcgccttcgttaataaaggttgacccgtttgcgacctgagcaaaaccaatatcgttgatactgatcgcccccttattgaccatggtgctgttagtatcgatatagccaagataattataattataaagcaggtatttatttatgctggttatatcggtttcgagcgtggcatcttcgctaatttcaaagtaaccaccatcagaaacaccaataatgctcttgaacggctgaccaaaatcaccatttatagacgactcaccatgcagatacacggatgagtttccgctcacgctaattactttagaggaactgggaccatttcgcttatttccggtttcattatcagccgtctgatttatttccccggtcagttcgataccacccatgatatctacacggttgccctctccggcgaccaccaggccaaaaataggctcctgagaaccatcatattttgcccatttgtggctatctgccatttcggtatcgagcaccacctgcatgtgcccgtccagcaccacggtattatcattacctgccacgttaatgccggtagatggcttaaagaaatactctttcgcgagcggtgatttctgatctttatccaccaccatatctccggtcagggtcaccgtgttggtgttcccggtaatattcaccccggtcgcgtcatagcctgtgattttcagctcatcggagataagattcacgttattgctgtccccggtaacattgatgcccgtggagaaatctcccacgatcatcttaccgttctgattgagggtattgctgttaccactgatttgcgttccggtgccgccatcagtgacgctggtcgcgccggtattattaatggtgttctcattaccagtgacagcgaaaccggtgccgtccgtagtggccgtaatcccaccttcattgttaatcgtatttttatcaccctttacttgcgtgccgataccgctatccgtgccggtgctgtcgcctttgataatgataatcttgccgtcaacgtcaatttcttcaccaacgttgtccgtggctgtaccagtgccgccattaatcactagcggctcatcgccaccgtcatcgccatcatcgccgttatcgttattgtcatcattgccattgtcgccgttatcattgtcgtcaccattatcgtcgccgccgttatcaccgccgtcattatcatctccgccgttatcgccgccatcatcgttaccgctgtcgctgttatccgaactttcaccatcgtgatcgttttcaaccgcaatacccactgccgctactaccgccgccatgccaccgataacccagtttttgggatcttccataaacgaaggctcttgcagacattcagccgctaactgcgctttttgctcttccgtcagcacactcatattcgcggggcagaggttagcggtacgatcttttgctaagtgttcggtttcggcatagccattgccgcttaacgccagggcgatacagatcgacaggactgattttcgttgcatgatgaatgttccttattcagctgatatatatattaacgacagaaaggtatggcggtgtcgccagataagattgattaaaaaaatttgagggattttatagagggttactattttttgttcaagaggattatgattcaaatcgttgtaataaaagtcaactgcttgatatcaggagagatataaataccgggagtggcgacgacaaattataagccggcagaatatatagacgatattaatgtattttttcataaatcattctctgaattaataaattaacccccaccaataattaaatacattcatgtctacaataataaaaaaacaccccgccggggcggggtgttttgaggttgggtgattgtttttttgcccggcggcgcttcgcttgcacgggcctacatgttcatcgttaagtcatgcaggccgggtaaggcgctgccgccacccggcaaaccctcatcagaacttatacttgtagttcagcataaagcccttgtccttcacgccgtcttcctgccactggaaggcatccgccgtgaactgcgcgttaccggcgctgtacttcacgcccgccatcgcctggccgttcacgccaccgccctgctgggcatcgtcaacgctgaacgtctggcctctggcacccgccagagaagccgtgcgcttgctcttcgcatagctcaggttcgggccgccttccagcgacgctgtcgctgcccagccgtcttcacccgcgtagctcagcttcagacccaccaccgcatcaaccgccgtttcgctgctgctgctcatgctcaggttgaagtcgcccgcgcctttctcgctgtagccgtcttccatggtgtgacgcattttcagaccggcaaacggcgttaccgtcaggccttcctgcaccttgaaggcttttgacccttcggtacgaaactccatgtactgctggcgggtgtcggcgttcgccgttttgttcacgtcgccgtaacgtaccgcacggttgctgtcgaagttatgcacgtcataacgcagggcgttatcccagttcaggccgccttccgtcagcggcaggctgtgcttcagccccaggaactggctgtaaccgcccgtcacgccgttgtcgccggcgctcatcgcattaccatcaccgtccagacgggcgataccgtactccatggtcagcgtctggttgtcaccgaacgccaggctctggcgcagcgccagcatgtcgtaggtggtgtcattacccagctcggcacgcttgtcacccttcgccaccacgttgaacgccagaccgttattcatcaccggtgccgtgtccgccagcatgtcgaagcggttgctcaggatacgcgcatcgcgggatacgccggtcgccttgctgccagaaatctgcttcagggcgctggtcagctccgcgctggttgccaggttcaggctgttgtacagctcgttgctggtgtaggccgcatccagtgcattcgccacgctgttgacgctcgcatcgcccgccacgtccgcataggcgtttttggtcatggtgacatccacgttaccgctggcgtccttctcaccttccgctgtccagaccacgctggcggaggtgatgttctgctcaccctgaatgtcttccccgacaaagacgtcgttgaaggtcacagaggtgtccgccgtacccgcggtaaagccggtgtcaacgttcacatcctgaatgtcgacatggctcgccgtcagcgtacccgcactgccgtctgcgctggtgccgacggtgtactggttgatgctgctgcgcagaccggtgctctgggctgccgcagtcggatcggtcggcagggtgtaagacgcagcatgtgtctcggtaccgttgccgccggtgccattaccttccagcgcaacgtcctgctggatcaggccgctgccttccccggccagggttaccgtgccgttgttaacgatacgcccgttcgcgcccagcttgctgaaggcgtaagagttggacgcatagatgttaatcgcgccgttgttctcgatcaccgcgtcagccgtggcgttcgcgtccagctgcatggccaccatgccgctttcagtggtgccttcggtgcccaggttaatggtgccgttgttcaccagctgggcgttcttgctgcccttcatgccgacggcgccgctgccgctgacgttcatggtgccgtcgttgacgcccacatagttactgtgcgtcaggctgaccgcgctctggccggtttgagaggcggtaaagttcaccaccccgtcatcctggttccagaagaacgccttacccgcagccgcattaccttgtgaagccaccagcgacacaccagtggcgttcgctgtaccatcgttaataaagtcgcccgtaccgccccagatatttacccccgccgcgtgactgctggcggtgaagttcatggtcgcgcctttatcgttcttaaaggtaccgttgttattcagatgaacagcatttttgttattatcgcctgtcagcacgccgccagccgcgttttcaaacacgctgttggttttcagatccagtctatggacatccttaacgtctgtcgctgtacccagcgtaaagctaccgctgttgataatgcgactgtctccccacatctccgcgccgccagtagcgctaccattgttaaccactttcccggaggtgcttgtgataacaaaagcgttgatggtgccactgttattaattacgccattagtgccggaaacactgacgggtgaatcaataataccagagctctggttattaaaggtgccctcaacatataaccgtcctgtaccgttcaccgtgccggtattactcactgtgctgtcagaaagtacggacgtagtttcagtcagcgtattaataccgcttagcacggtgccgtcagcaaattccggcgtttccactgcatcactgttatcagcttccggcggtacgcctgcaccgatattaatgtggccacggttaatgatacggttatctttattaccgtctgtatagaatgccttaccgttttcggcgttgatgttaattacacccgtggtgtcgttaaccaccgtagcgccgccatagaccgccatacctaccagcggctggtcagcaacgtaattctcgtttttctcgagattaatcgtgccctggttaacagccttgttactggaaccgtaggccaccataccagcaccggcattatagacggtaatggtgccgcccacgcggttagtggcaacagaatttgactgcgcggtaatggcgttgctacctgcccccatgcctacggcatagttcattgggttatccccggaagggacactggttctcacgtcagaggtgtcggcggcatctttccacatcgcatcggtggtaatctggccaaagttatcggctgtcgagtttttattcgccaccatcccggtaccacgtccgtacagctcaagctgaccttcgttaataaccgagctaccggcataggcggtcatcagttcaatagcagcgacgtggttgttcagagcatcctcagtcgacatactgtaatgatctttaacgttggtgatgcttccctggtagaccgtcttacctgtcattactccctggttaacacccgtggctccgtttcttacagaaatgcctcgcagcgccgtacgatcggtggagagttcagagcgaaccatctccaggcgaccgttattaacgactttcgaacctttatcttttgcttcaaaggcggtcatgtctgaaatagacatttcacctttgttagcaatggtggaaccggattttgcagtgaaagcctggcttacatgcatgtcatagttatagtcgctgacttcttctacaccggaagtactgaaagtcgaaccttcggtaaattcaagatagccaccatttttaacgctaataacgttgttgatacccacggggaaatagccattaacggacgaatcgccatgcacgtagaccgaagattttccatcaacagttacaaccgaggcattgctggtgccggttctctggttagcggttttatccgcatcgtccagctggtctttctcacccgttaattcgatgcccttcatgatgtcaacacggttattgtcacccgttacggtggcgccctgtattaactccatcgagccgctgttattggcataatttctgccagcatcttcgctatcgacaaccacctgtaaatgaccgtccagcacgacagtgttattactgccgctgacgttaatccctgtggaagctttgtagaagttatctgccgccagtggtgatttttgatctttattgaccaccatattgccggtcagcttgacggtgttggactcgcctgtaacattagcgccggtggcctgctgcccggtgatgctcatatccgatgaatcaagattaagggtattgccattaccttctacgttaatgccggtggagaaatcgccgaccgccatcttgcccatctggttgatctggttgttgttacctgcaacatcaaccccggtggaaggtttggtgctgtcggtgctggacacgtctaaatcgccagagttgatgatgttgtcatcaccattcactttggtgccggtgccgccatccgtcgcggtgctgccgccggtgttatcaatggtgttgccattgccgtccactttggtgccggtgccaccgtttgcgccgttgttgccaccattgttattgatgtcgttgttatcacccgtgacatcagtaccggtgccatcgttaatcccgctgttgttgccgttgttattgatggtgttgtcgttaccgtcaacgtcagtgccggtggaacctgtgccatcaccggtgttgtcaccgttgttgtcaatggtgttgccgttgccgtctacattggtacctgtgccgccattggtgccgctgctctcaccaccgttgttgatggcgttaccgttgccgtctacatcagtaccggtggaaccttcgccgtcgccggtgtttgtgcctttgttatcaatggtgttgccgtcaccgtccactttggtgccggtgccgccgccggtgccgctgttgttaccgttgttattgatgtcgttgttatcacctgtggcatcagtaccggtaccatcattaatcccgctgttgttgccgttgttattgatggtgttgtcgttaccgtcaacgtcagtaccggtggaacctgtgccatcgccggtgttgtcaccgttgttgtcaatggtgttgccattgccgtctacatcggtgccggtgccgccattggtgccgctgctctcaccaccgttgttgatggcgttaccgttgccgtctacatcagtaccggtggaaccttcgccgtcgccggtgttggtgcctttgttatcaatggtgttgccgtcaccgtccactttggtgccggtgccgccgccggtgccgctgttgttaccgttgttattgatgtcgttgttatcacctgtggcatcagtaccggtaccatcattaatcccgctgttgttgccgttgttattgatggtgttgtcgttaccgtcaacgtcagtaccggtggaacctgtgccatcgccggtgttgtcaccgttgttgtcaatggtgttgccgttgccgtctacattggtgccggtgccgccgccggtgccgctgttattgccatcgttattgatgtcgttggtgtcgccgttaacgtcagtaccggtaccgccattggtgccgctgttatcgccgccgttatcaatggtgttgccgttaccatcaacatcagtaccggtggaaccttcgccgtcgccggtgttggtgccgtggttatcaatagcgttgccgtccccgtccacttcggtaccggtgccgccattggtgccgctgttgttgccgttattgtcgatggtgttgccgtcgccatcgacttttgtgccggtgccaccatcgttaccgttggtgtcgccgttattattgatggtgttatcgtcaccgatggtaatagagccgttattaccctcgcctgaggccgtgccgccgtttgtatcgatcttgttattgttgccttcatgccagttcacggcatcagtgaaattgatttcaccagtgatatccagataccagatcttgctgccatccgcagaggtgcctttcatagtgacggcattgctggcctcatccagagcccatttatccagcacaatggttttgccggtagccggatcggtcagggtgtaagtaccgttcggattggcggtgtaattccaggtaatgcccgcaaaggccaccgtttttttggtttcgttccaggttacgccgttgctgtaggttttaataatatcgccagtcggcgtggaagagccgtcatccccgctatcaccaccatcaccaccgccgccaccgcccgcagccaggccgactgccgccgcgacagcggccacgcctccggcaacccattcccactgttcttccagaaaagagggctctttaaggcattcaggaggcagttttgctttttgggcttcgctcagcgcgctgatatttgccgggcacgcctgcgacttgcgttctttttcgctcagatctgttccggcataactattgccgctcagcgccatcgctatacagagggataatacggattttttttgcatgatgaatattccttattcaacaagagtcaatatcaacaatgtcagacggacacgatagcgtcgtcaggagagaacattaaatacaattttcgccggttttatagggtaaagttgatttttattcaaggacaatttaattaaaagaatattaattaaggataaccgattgaattagttagaattgaatttggaggaaaatcttaggcaattttattcattttgtgaaacacattcactcaaaaaatataaaaaagcaaaaaccattcaccaagataataaattaagccatgagaatatttatttttatgcggagatgtcttttattaatatatccattaataaataagattaaacttataagacaggtaaaacaaaacagcctcctgaacaggaggctgctaacattagcgaactaatgtgaaaaattaattagcggcgcagtagcagacccagcaccaggcctgcagcagcaccaatacctacgccctgccacggtttttcatgcacgtaatcatctgcacggtaggcaacctgcttggcgcgcatgtagtagttgtcggaagcctggctcacgcgggacttcacgtcgtgcagcgcttgttcggcgcgtgctttcagttcgatatatttctggtcagcaggatcgccggaggaacgtaacacctcttccagcgtttcgctcagcagggtcaggtcgtcgtcaacgcgtgtttctgtgaattggttagtcatttgttttctccatgttttgcactggtttgctaactatagtcaatgacctgcggttacgcctggcgaacttcccgcgccataccgatgtgcgggataccgtcttcgtcataaatatcggtcaccggccggaagccaaaatgggcatagaaagattgcaaatgtgcctgcgcacccagatatatcgcgcgctgcggccagttttgctgacaactggcaaccgcccgatccatcagctgataacccagtttctcccccctgacctgtgggctgacgatgacccggccaatcactaccggggcgaaatcatcctcatttttcagaatcctcgcatacgccaccagctggttatcgcgccagccgagcagatggcgattctccccgttcagatcttcaccgtctacatcctgatagacgcagttttgctccaccacaaagacttcgcagcgtaatttgagtaattcgtaaagcgcgctgacgctcagttcgctgtggtgcagatcttgccagtggatcatggtgctctccttaattgattcgcctctcgctatactaatggcttttcatcttccggaaagggcgtaacgcacatatggaacttctctttcttggcacctcggcgggggtgccgtcgcgcacacgcaacgtcagcgcgctgttgttgaacctgcaacacccgacgcagcccgcgctgtggctgtttgactgcggcgaaagtacacagcatcaactgatgaaaaccccgtatcatcccggcaagatagagaaaatttttcttactcatctgcatggcgatcacctgtttggcctgccgggactgatatgcagccgctccatggcagggatcactcagccgttaacggtgtatggcccgcagggcatccgcgagtttattgaaaccacgctgcgtctgagcggcacctggacggattacccgttgagcgttgttgagattagcgcaggcgaagtgatggatgacgggttacgccgcgtgaccgcttacccgctggatcatccgctggagtgttacggctaccgtatcgaagagcatgataagcccggcgcgctggatgcccgtgcgcttcgggatgcaggcgtggcgcccggcccgctgtttcagcgtctgaaagccggagaacgggtaacgctggatgacgggcgtgtgatcgacggccaggattatctctcccccgccacgccgggtaaaaagctggcgatttttggcgataccgccccctgccccgccgcgcgcgacctggcgcaggatgtggatctgatggtgcatgaaaccacgctggaggcggcaatggaggcaaaagccaacagccgtggtcacagctccacgcgtcaggcggcgcagctggcccgtgacgccaatgccggacggctggtgatgacgcatatcagttcacgctacgacgccgtcagcagccagaagctggtggaggaatgccgggccatcttccccgagagtattctggctgaagatttcgttgtcatcacagtttgatgtaaaacgttcctccatttttcccccggcgtgccgataacagtgttaacgcacgcattccactccgagggcacgatggatagtttccagaaagatattgatgacagggctaatcttaccctgtccaaccgctttgagcttttgctgttccgtcttggcgcgtcggtgcatgacgcgaagtcagagctctttggcataaacgttttcaaactgcgtgaaattgtgcccatgcccaccttcacccgccctgccgggatgaagccgccgatgatgggaatggtgaatatccgcgatcaaatcattccggtgattgatttgacggcggtggcgggctgcaaacccactaccggactgaatattctgctcatcaccgagtacgcccgtagcgtacaggcgtttgccgtcgagtcagtggagaacattattcgtctggactggaaacaggtgcacacggctgagaaagccgttaatggtcgctacatcaccagtatcgcctgtctcgacgatgagcaggattccaataatctggcgctggtgctggacgttgagcagatcctttatgacattacgccgccggaccacgatctgcatgccaaaaatctggagaacactaaaaagttcaatatgaagccgggcgcggtggccattgtcgccgaagattccaaagtggcgcgcgccatgctggaaaaaggcctggaatccatgaacattccgaacaccatgcacatcaccggtaaagatgcgtgggagcgcattcaggtgctggcgcagcaggcggaagcggaaggcgtgccgattagcgataagatttcgatggtgctgaccgacctggaaatgccggaaatggacggcttcaccctgacgcgcaaaatcaaaaccgatgagcgtctgaagcatattccggtggtgatccactcgtcgctgtccggcagcgcgaacgaagatcatgtgcgtaaagtgcaggccgatggctacgtcgccaagtttgaaatcaatgagctttccgcggtgatccaggaagtgctggatcgcgccacgcagcacgtcagcgggccgctgattagccataagcagtttgtgtaagatggatggttgccgggtggcgcttatgcttacccggcatttttttaagaagacgaaaaaaaaccgccgaatcatcggcggtttttttatgggctaacgcgcttacatcagcggcttcgcgagctgcacgatgtcgatcagcggctgcgggtagacacccaacagcagtaccagcaacgcggagatcagcaccacgataccgcctgcgctgtactgccagttagacggcgcatcgcggttcagttgctgcggagcgttcagatacaggctcactgccacgcgcaggtagtagtagagaccaatcgcggagccgagcacaacagcaccggtcagccaccacaggttcgcctgcacacccacggccagcacgtagaacttaccgataaagcccagcgtcatcggaatacccgccagcgacagcatcatcaccgtcatcaccgcagacagaaccggacggtgccagaacagaccacgataggagtacagggaatccgcgtccgggccacggtacgggctggacatcaggcttaccacgccgaacgcgccgaggctgctgaacaggtaaccggccagatacacgcccaccgtttccatcgacatctgaccgctttgcagcgcaatcagcgccaccagcaggtagccgaggtgcgagatagaggagtaaccaagcagacgcttgatattgctctggctcagcgccatcaggttgccgaagatgatggaagccgcggcgataatacccagcaccatgcgaaccgcttcgctgtcgcccaccggcgcatacaggaacagacgcatcaccacgccaaagatggcgattttgctggcggttgccaggaaggtggaaaccggagcaggcgcaccctggtaaacgtctggcgtccacagatggaacggcaccagcgacagcttaaagcccagaccgacgatcatcatacccaggcctgccagcagcagcggctcgtgcagcatgccgtcgcccaggctcttaccgaggccagggaacgacaggttgccggtctgcgcataaaccagtgcgatgccgaacagcaggaacgacgaggcggcggcagacagaatggtgtatttgatactggcttccagcgagcgtttctgacggaaagcgtaacccaccaggccgaacagcggcagcgagataagctcgataccgaggaacagcgaagccatatggttagcgttcgccagcagaatgccacccagggcggcaatcagcaccagcaggtaaaactcttctttgttgtcgtagtagccctcaagccacggatacgcgaaggtacaggttgcgaggctcgccagcagcacaaggccggtgtagaacattgcgtaaccgtctacgcgcatcagcggcgtgacatccatggcgcccgcctggccaacaaaccagagcgacactaacgcggcgttaagcccaatgaccgacagcgtggcattggtaaagtggttgcgtcgccacgcaatggagagcatcacaaccaccaccgtcaatccgacgatcagcagcggtagcagcgcaatcaggtgttgtggagttattgtcatggcgatttacggccttgtagtagaaacggaattaacaaaccactgctggatattgctcatcgcagaatgcgaggtatccagaatcggctgcggatagaagccaagcagtaccagaagcacgaccagcaacagaatgataaacagctcgcgcagtgacattcccggcagttctttacttgcgatctcgctcttcgcttgcccgaagaaggcgcggtgcagcatcgccagcgagtaaactgacgcgaagaccagaccgaaggtcgaaatcacagtgatcaccggcacaacctgatagctgccgaacaggatcatgaattcaccgacgaagttaccggtgcccggcatcccgagagtcgccacggcaaagaacatcgacagcgctggcagccatttaattttgctccacaggccgcccatcatgcgcatatcacgggtatgcagacgttcgtacatctgaccgcagataataaacataccggcggcagacagaccgtgcgcaatcatctggatcaccgcgccctggaacgccagctggctaccggtatagatcgcgatcagcacgaagcccatgtgcgaaacggaggtgtaagcaatcagacgtttgatgtcggtctgtgcgaatgccatccatgcgccgtagaagatgccaatcacacccagccacatggcaatgggggcgaactcagcggaggcgttcgggaacagcggcagcgagaagcgcagcagaccgtaggccgcggttttcagcaggatccccgccaggtcaacagaacctgcggttggcgcctgggagtgcgcgtccggcaaccagccgtgcagcggtactaccggcattttcaccgcgaaggcaatgaagaagcccagcatcagcagatattcaacgccatgggacatcggcgtcttgagcagctgctcgtagctgaaggtccagacgccggtcgcattgtagtgcacgaacaccagcgccaggatggcgatcaacatcaccagaccgctcgcctgggtatagatgaagaacttggtcgcggcagtgatacgcgtcttcccgtcggaggctttatggccccacagtgcgatcaggaagtacatcggcaccagcatcatttcccagaagaagaagaagaggaacatgtcgatggcaaggaacacgccgataacgccgcccaggatccacatcaggttcagatggaagaagccctgatatttctcgatttcgcgccaggagcagagtaccgccagcacgccgaggaatccggtcagcaccaccatcagcagtgacaggccatccagcgccaggtgaatgctgatgccaaagcgtgggatccacggcagcaggaattcagactgccactgcggtaaaccagccgattgggtcagagagtagccgccctgcaaccacagttgcagggaaagcgccagcgtcagtcccattgtgaccagcgcgatccagcgcggcatcttcacgccgaagcgttcggtctgccagcacaggaagccgccaataaacgggataagtattaaccagggtaataacatagctgcgtatgtcccttatattctaaacacttcacaaaaaatcaacgcaataccatcaacagcgcgaggacgaccaccgcaccgatgctcatggatgccacataccagcgcagatagccgttctcgctaaacagcagacctttacccgccaggcgggagaggattgccgggatgttcatcaacgcattcagcgggtcacgcttgataagccaggcgatacccaggaatggttttacgaaaattttgtcatacagccagtcgaagccccaggcgttgtaccaccaggtccccagcaggcggcccggcgcgctgttggcgattgaggtcaccagagtgcgcttgccaagccacagccaggcggcaatcaggatcccggcaatggcgatcacgcccgatgcgatttccagcgtcatcacgctgccatgctcaagctcggtggtttccggcagaacaccctgcaacggcggcacgatcatcgcgcccacaaaggtggagagcaccagcagaacaatcagcggcagatggtgggtaatccccttccctgcgtgtgcgtgaatttgttctttaccgtggaagacgatgaaaatcatgcggaaggtatacagcgaggtcataaatgcgcccgccagacctgccaccatcagattcatgtgtccgttcgccatcgcgcccgcgaggatttcatccttactgaagaagcctgcggtgatcagcggcagtgcggaaagcgccgcgccacccaccaggaagcagacatacaccagcggaatagacttacgcaggccgcccattttgaagatgttctgctcgtgatggcaggcaaggatcaccgaaccggacgagaggaacagcagcgctttaaagaacgcgtgggtcatcagatggaaaatcgccgcatcccacgcctgtacgccgagcgccaggaacatgtagccaatctggctcatggtggagtaagcgagtacacgtttgatgtccgtttgcaccagcgcggcaaagcctgccagcaccagagtgacggcaccgacaatccccaccagatgcaggatttccggggtcatcaggaacagaccatgcgtacgggcaatcaggtagacaccggcagtcaccatggtcgcggcgtggatcagcgcggaaaccggagtcggacccgccatcgcgtcagcaagccaggtctgcaacggcagctgtgccgatttaccgaccgcaccgcccagcagcatcagcgtcgcccaggtcagcatattattgccagcctcgaagtgcgccggtgccagttccaccatttcgcggaagttgagcgtacccagttcgttataaagaatgaacagcgcgaaggccaggaacacgtcgccgacgcgggtcaccacgaacgctttcattgctgccgcgccattcttcggatcggtgtagtagaaaccgatcagcagataggagcacaggcccacgccttcccagccgagatacatcagcagcaggttgtccgccagtaccagcaccaccatgctcgcgatgaacaggttggtgtaggcgaagaagcgggagtagccctcttcgccgcgcatgtaccaggaggcaaacatgtggatcaggaagccaacgccggttaccacggagagcatggtcagcgacagaccatccagcaccaggttaaagccgatgttgaaatcgcccaccgacatccaggtccacaacggctggctgtaggcctgttgaccgttattaaagaagtcgaagccgacaatggcggtcaccagcgccgccagaccgactgaacccattccaaccgcggcggagaggttttccgaccagcgaccgcgggagaaggagagcagtaaaaagccaatcaatggcaaaataatggttaaggcaagcatgttcatccacgcaactcacttactgaatcgatattcaggctctggcgacggcgatgcagttgcagtaacagcgcaagaccaatactggcttctgctgccgcaaggctgatggcgaggatatacatcacctgaccatcggtctggccccagtagctaccggcgacgacaaaagccagtgccgccgcgttaatcatgatttccagcccaatcagcataaacagcagattgcgtcggataaccagaccggtcagaccgagtacaaacagtatcgcggcgaggatcagtccatgttgtaaggggatcatgcgtgctcctccgtttttcttttcgcatcgccaggacggttgctgagcacttcgcccgcgcgttcttcacgacccacgtggaaggcgacgaccagacccgccagcagcagcatggacgccagttcaaccgccagaacgtatggcccgaacagggtaatgcccaccgctttcgcgctgattggcgtcccgtcgatgccctggtcgttgacgccgagaatggcgtagatcatcaccgccagcaggatggctgacaacgcgccaggaccaatccagatttgcggtttcaaccactgacgttcctgctcgatttcagcgccgccgaggttcagcatcatcaccacgaatacgaacagcaccataatggccccggcgtagacgatgatttccagggcgcccgcaaaataggcgcctaaggagaagaagaccccggcaatcgccagcagggacataatcaggtacagcagcgcatgcaccggattagtgtgggttatcacccgcagcgtcgtcaggatggcaaccaggccacagatataaaaagcgaactccattgcccctctccttacggtaacaggcctttgacgtcgataggtttggcttcgttttccgcttcacctttatctttgccgtcgattgccatacctgccatccggtagtagttatattccgggtatttgcccggaccggagatcagcagatcctctttttcgtagaccaaatcctgacgcttgaactcgccaagctcgaagtccggcgttaactggatcgccgttgtcgggcaggcctcttcgcacatgccgcagaaaatgcagcgtgagaagttaatgcggaaaaactccggataccagcggccgtctttcgtctctgctttttgcagagagatacagccaaccggacaggcaaccgcacacaggttacaggctacgcaacgctcagcgccgtccggatcgcgcgtcagcacgatacggccacggtaacgaggcgccagataaaccggctcttccgggtacatacgcgtttcgcgtttggcgaacgcatgcaggccgatcatccagatactgcgaacctgggtgccgaagcccacaattatttcttttaaagtcatggtcttttcaccccttattgcgcctgccagagaatgacagccgcggtgcccagcaagttgagtagcgtcagcggcaggcaaactttccagccgaaggacatcacctggtcataacgcggacgaggcaatgctgcgcggatcaaaatgaacatcatcatgaagaacgcggttttcagtgcgaaccagatgaagggcggtaagaacgggccatgccagccaccgaagaacagggtaaccatcagcgcggaaatggtgacgataccgatgtactcccccacaaagaacagaccgaatttcataccggaatattcaatgtggtaaccgtcggccagttcctgctcggcttccggctggtcaaacgggtgacggtgacacactgccacgcccgcgatagcaaaggtgataaacccgaagaactgcgggatcacgttccagatgtcggcctggttgttgacgatatcggtcatattaaatgaaccggcctgcgccaccacgcccatcagcgagaggccgaggaacacttcgtagctcagggtttgcgcagatgcacgcatcgcaccgagcagcgagtatttgttgttgctcgaccagccagcgaacagcaccgcatataccgcgaggcctgccatcatcaggaagaacaggatgccgatgttcagatcggccaccacccacgacgggctgaccggcacaatagcaaaggccagcagcagcgaggtgaaggcaatcatcggggccagggtgaaaatcacgcggtcggtgaatttcggtacccagtcctctttgaagaacatcttgatcatgtccgcgaccagctggagtgaaccaccccagcctacgcggttcggtccgtaacggttctggaacaggcccaacagacggcgttcaccgaaactcatgaacgcgccgcaggtcaccacaaccagcagaataaccaccgctttgagaatgctgagcaggatgtcaatcaactccggggtaaaccaactcattgctgtgcctcctgcagatcctcaacgcgtgcgcctgccagtaccggcgcgatgcccggcatacccatcggcaagccgacctgccctgccgtcagtccttcagaaatcaccagcggtaagctgaccgtctgaccttcatagctgaaggcaagtttcgcaccgtcattcacgcccagtttcgcggcgtctgccggattgagcgcaatgtacggctgcggcatacgttgctggaagaccggtgaacgctgggacatttcgtcactgccgaacagatggtagtaaggcgcaacacgccatttcccctcttccgcctggaaaccagccggtacgtgatcgaaataatccagcgcgctgtcagaggcttcgatcagacgtacgcccggatcgccatgacgcagtttgccgcccacttcggcctggaacttgttccatgcctgcggggagttccagcccggcgcccaggcaaacggaatttgcgagcgcggcgcggatggctggttgttcccttccatagagaaggcaaacatagtgtctttgtcctgcggctgacgcggttcatgcacgctgatgttggcgcgcatggcggtacggccactgtaacgatgcggttcacgggccagtttctgaccacgaatacggaagctggcatccggcgcggcatctttaataccggccagctgcggcagcgccgcaaccgcggcgtcgatcacgtgatcgagctgcgtccagtccacttcgcggctctgcacggtgctgtgcagcgagtgcagccagcgccagctttccagcatgatggcgttgcggtcgtagtaagacggatcgtaaacctggaagaaacgctgtgcgcggccttcgttgttgatcaccgtaccgtcgctttcggcgaagctggcggtagagagcaccaggtgcgctttgtccatgatcgccgtgcgctgatggtcgataaccatcaccagcggcgcgcgggagagcgcggcgtcaacgcgggcggcagaagcatgacggtgcagatcgttttccaggatcaccaccgcatcagcacgaccggtttccagttcggtcagggcgtcgtccagcgagccgccgccgatcataccgaggccgacgctgttcactgcacgggcaatcatggtcacgccgacgtctgcgccacggcctttcagcgctttggcgacgttagcggcggcctgaatgaccgccgtgctgccggcgttagtaccggaaataatcagcggttttttcgcgctggccagcgccgagacgatcacgtcgatcttgttttgcagatcgcgatcgatgccttcaacggccggtgcgctggcgtcgagggcattcgcaatggcaaagcccaaacgcgcctgatcttcaaccggtgcgcgataggtccaggcggcgatgtcgtccatacgggtgctgtcaacgttggtgacaaacagcgggtgtttggcacgctgaccgatgttgaggatagcggcgatctgccagtccgcgactttctgcgcggcggccatttcacgggctttccctttcacggcctggcggacagccagcgcgacgcgcgcgccggtctgggtaatgtcttcgcccagcaccagcacggcatcgtaggtttcgatgtcgcgcagcgccggggtatgaatgccgctttcgcgcagcactttcagcatcagctccagacgttcctgctcgccgctggcgataccggtatagaagttttccgctcctaccagttcacgcagcgcaaagttgctttccacgctggcgcgcggggaaccgataccgatcactttcttcgattgacgcagaatatccgccgcgccctgcatcgcctgttcagcgttgagggtgatcagatcgtcaccacgacgctgaaccggctgacgcggacggtctttcaggttcacatagccatagccaaaacgaccacggtcgcagaggaagtagtggttaacggtaccgttgtaacggttttcgatgcgacgcagctcgccgtaacgctcacccgggctggtgttacagccgagagaacattgctggcaaatgctcggcgcaaactgcatgtcccatttacggttataacgctcagagtgcgttttatcggtgaacacgccggtcgggcagatttccaccaggttgccggagaattcgctttccagcacgccgtcttccgggcgaccaaaatagacgttgtcgtgcgcgccgtacacacccaggtcggtgccgtcagcatagtctttgtagtaacgcacgcagcggtagcaggcgatgcagcggttcatttcatgggaaatgaacggccccagatcctggttgcggtgagtacgcttggtgaaacggtagcgacggaagctgtgaccggtcattacggtcatatcctgaaggtggcagttaccgccctcttcacagaccgggcagtcgtgcgggtggttagtcattaaccactccaccacgctttcgcggaactgtttcgcttctgcgtcgtcaatagaaataaaggtgttatcggtagccggtgtcatacaggacatgaccaggcgtccgcgcgtgtcttccgcgttctgatactgcttcaccgcacactggcggcaagcacccacgctacccagcgccggatgccagcaaaaatacggaatatcaagacctaacgagagacatgcctgtagcaggttgtccgccccgttgacctcgtaatctttgccgtctacatggatcgtagccattagcatgcttccaaattaaaaaaatcgttaccacttcctcattcaggctgcctctgcgttggctgcctggatgaacttgtgggcttcaccagcgggctttcaacaggttcggctgaataccgttgattgcatgggtattgctgaacggctgtttgatgccagcttcgaattcttcgcggaaatatttaatcgcgctttgcagcggttcaaccgcgcccggcgcgtgtgcgcagaaggttttacccggcccgaggaaacgacacagttgctcaagtgtctcgatatcccctggctggccttcgccacgctcaatggcacgcagaattttcacgctccatggcagaccatcgcggcacggcgtacaccagccacaggactcacgggcaaagaactcttccaggttacgcaccaggccaaccatgccgatctcgtgatccaccgccatcgccagcgccgtacctaaacggctgcccgctttgccgatgctttcgaattccattggcagatcgagatgcgcttcggttaagaagtcagttcccgcgccgcccggctgccaggctttgaatttcaggccatcgcgcatgccgcccgcgtaatcttcgagaatttcacgcgcggtggtgccgaacggtagttcccacacgcccggatttttcacgcggccggagaagcccatcagtttggtgccggcatctttgctggtcgagatgccctgataccactccacgccgttcgcgaggatagccggtacgttacacagcgtttcaacgttgttaacgcaggtcggtttaccccatacgccggagcttgccgggaacggcggcttggaacgcgggttcgcgcggcggccttcaagggagttaatcagcgcggtttcttcaccgcaaatgtaacgccctgccccggtgtgcacgaaaagttcgaagtcaaaaccgctgccgaggatgtttttgccaagcagaccggcttcggtcgcttcggcaatcgcacggcgcaagtgcacggctgcttcgatgtattcgccacgcaggaagatatagccacggtatgctttcagcgcgaacgcggaaatgagcatgccttccaccagcaggtgcggcagttgctccatcagcagacggtctttataggtgcccggctccatttcatcggcgttacacagcaggtaacggatgttcatggattcgtctttcggcatcaggctccacttaaggccggtggagaagcccgcgccgccgcgccctttcagacctgagtcttttacggcgttaacgatatcgtccggtgccatgccggtcagcgctttacgcgcgccttcatagccatttttgctctggtattcttcaagccataccggctgtttgtcatcacgcagacgccaggtcagcggatgggtttcgggagtacggataatgtttttcatttataccgctccagcagctcagggatcgcctccggcgtcagatggctgtgagtatcctcatcaatcatcatgctcggacctttgtcgcagttacccaggcagcaggtcggcagcagcgtaaagcgaccgtcgaaggtcgtctgccccggcttgatattgagcttctgctcaattgccgactgaatgccctggtagccggtgatgtgacacactacgctgtcgcaatagcggatcacatggcggccaaccggctgacggaagatctggctgtagaacgtcgccacgccttccacatcacttgccggaatatccagcacttctgcgatcgcatagatcgcgccatccggcacccagccacgctgtttctgaacgattttcagcgcttcaatggacgccgcacgcgggtcttcgtagtggtgcttctcgtgctcaatggcatcgcgctcgagggcactcagctcgaaagcctcggtctgtggttgttgattctcgtgcataattagcggtccacatctgacataacaaaatcgatactacccagatagacgataaggtcggataccaggctgccgcggatcgctgacgggatctgctgcaaatgcgggaagcttggcgtacgcacacgggtgcggtagctcatggtgctgccgtcgctggtcaggtagtaactgttaatacccttggttgcttcaatcatctggaaggattcgttggccggcatgaccggaccccaggaaacctgcaggaagtgagtaatcagggtttcgatatgttgcagcgtgcgctctttcggcggcggcgtggtcagcgggtgatccgctttgaacgggccttccggcatgttattgaggcactgctcaaggatgcgcagactctggcgcagctcttcaactttcagcattacgcgggtatagctgtcgcttaccccgccgcctaccggcacttcaaagtcgaagttctcataaccggagtacggacgcgccttacgcacgtcgaagttgatgccggtcgcacgcaggcccgcgccggtggtgccccactccagcgcttctttcgcgccgtaagcggccacgccctgggagcggcctttcagaatgctgttacgcagcgcggctttctcataggaagccagacgcttcggcatccagtcgaggaattcacgcagcaggcgatcccagccgcgcggcagatcgtgcgcgacaccgccaatgcggaaccaggccgggtgcatacggaagccggtgatcgcttccaccagatcgtagattttctgacgatcggtaaaggcgaagaagaccggcgtcatcgcgcccacgtcctgaataaaggtcgagatgtacagcaggtggctgttgatgcggaacagctcagagagcatcacgcggatcacatcgacgcgttcaggcactttaatgcccgccagtttttcaaccgccagcacgtaaggcatttcgttaacgcagccgccgaggtattcgatacggtcggtatacggaatgtagctgtgccaggactggcgctcgcccattttttccgcgccgcggtggtgatagccgatatccgggacgcaatcgacgatctcttcgccgtcgagctgcaggataatacggaatgcaccgtgcgcagacgggtggttcggaccgaggttaaggaacataaagtcctcgttatcggtaccgcgtttcatgccccagtcttccggcttgaaggtcagcgcttccatctccagatcctgtttggctttggtcagctcaaatggatcgaattcggtggcgcgcgccgggtagtctttgcgtagcgggtggccggtccaggtctgcggcatcatgatgcgcgtcaggtgcgggtggccttcgatattgataccgaacatttcccaggtttcacgctcataccagttggcgttcgggaaaagtttggtgaaggtcggcacattcagatcgttttctgacagcgccaccttcagcatgatatcgcggttgcgatcgaaggaaatcaggtgatagaaaacggaaaaatccgcggcgggtaacccgtcacggtgggtgcgcagacgttcgtccatgccgtgtaaatcgaacagcatgacgtacggtttcggcactttctttaagaaatcgccaacttccagcaattgttcacgcttcacccagacaacgggtaccccggtgcgggtcgcctgaacggtaaaggcatccggcccaaaacggttgcgcagttcgccgatgatcgggtcatcgagatggtccctggtctgccatgcggcgtcttgcgcggttaagtcggtcatagtgttcaccattgcaaatggtccgtggtgactgtcgggcgtggcttcgcgctatttgttttgatatgcgaagggtttctccacagcccgcaggcgcaaattaaatctcgtcaggagaacgcagattggttacagcaatgcgttcaccgcgtttgcgctcgcgctctgactgcatgttggcgcgataaacgccctgatcgccaaccacccaggagagcggacgacgttctttaccaatcgattcctgcaacagcatcagtgcctgcatatacgcttccgggcgcggcggacagccaggaatgtacacatccaccgggaggaatttgtcaacgccctgcaccacggagtaaatgtcgtacatgccgccggagttggcgcaggcacccatggagatcacccattttggctcaagcatctggtcataaagacgctgaatgaccggggccattttggtgaaaggtgtgccggcgataaccatcaggtcagcctgacgcggggacgcacgcaatacttcagcgccgaaacgcgccacgtcgtgcaccgccgtaaaggaggtcaccatttcaacgtagcagcaggacaggccaaagttataaggccagattgagtttttgcggccccagttgaccatatcgtgcaggacattttcgagcttgcccatgaacacgctacggttcacttcctgctccagggggtctgttacgatctcctgtttttgcagggggtaacggtcgttctcaccgttaggatctatgcgggtgagcgtgtaatccatcttattgcctcgcggttagccttgacggttagtgttaccggtgatttcagggttcatacgctcgcgacgcgaacgcacaggtgtccagtccagcgcgccaatacgcaccagataaaccaaacccgccagtagcactaaaatgaaaattgcggcctcgacaaagccgacccaaccgctttcacggatagaggttgaccatgcgtagagatagagcgcttccacgtcgaagatgacgaagaacatggctaccagatagaacttggcagacaagcgcaggcgagccgtgccgacggaatcgatacccgattcaaacggcgtgttcttatgcctggcgcgggccctaccgcccaagaaccagccgcctaccaacatcaggcagcacaggcctatagcaacaataagaaagatagcgaatgcccagtgatgagcgataacttcagtggatgttgacatacgcattgcttaactcaaaaagtagcgctgaaacctctgctcttgctggcagatgaacgccacatcgatttaagggaggaacaaaaaaaaccatacatttactgcgagtagtgccgtagacagtaaaatgatgtggttttttactcctttctataaccttttgtcaactttaacaaaagttacctcacattagtttacatccaagacatttcattaacatttaatgcctttttattcgccagtggtaaaacgccgggagcatttttaccctgttgaatcgtgtccgttgtgaggttaaacaaaaattaccctcttattttgacaggatttccccaggattcctccccctaaatgggagtattttcttgatctgtgacacgcttttgttaattcacccaaaaaaacagcaacaaaccagctcgttttttaacatgaacagcagctatgaataagaccattacgggcagggatatagcaaaacgccaatcattaacataatgatatatatagatataaatgatgatttaagattaaaactgatgggatagtgaggttttcaaaccaaaggcggcattattgccgccattggtttgttttgcgtaattacattttgttacgagtttacagcacagttgttactcaagatcctgctcgacaataaagggatccccaccctcttgcggagtaacggtgctgtactgccagggcgtgtgataattttccatcgcctggaagacaacctgcgccagttcgctctctgcctgcgggttatggcagagtacgtattccgtgtcggccagcggcggcagaccgtcggccgggcccagcacgcgcagatccggactcatcatttctaccggccgggcagtgacccccagtccggctttcaccgcggctttgactgccgcaagggttgaggccacatacgccatgcgccagggaatatctgccgcattcagcgtgtgaataaccgtatcgcgcagtacgctcggatcctccagcagcaccagcggcagcgactcccctttttgcagaacgtattccgcggcgcagtaccagtgggttggcgaacggcgcagggtcagggattcgaattgcgcaggccggtgggtgctgaccaccagatccacttcattactttccagcatctccagaatatagggcgtgcgtttaacgcgcacatccagagcaattttcggatagaccgtgctgatgcgatttaacaaaaacggcagtatggtatctgcggattcgtcagacgcgccgatggtcaacacgccctggatattactgaacatcaacgaggtgcaggcttcatcattaaagcgcagaatttttcgcgcatagcccagcaactggatgccatgttcagtcaacagtttgttgcgaccatgacgggcaaacagctctttccccaccagctgctcaaggcgttgcatttgctgactgaccgctgactgtgtgcggcaaactgccgccgctgccgctgcgaaagtgttaagatcggcaaccgcaacaaaagttctcagcagatcgaggtcgagatttagtatcggacgatttgcatttatcatattttttcactcccaggtcgccctcgatgagccgcccggtatttgctgtattcgtaagaaagaagtaattccatttaaaacatgcatccagcaacgtcatggtccagggtggatttgacgcaggtcagggcatctattttgcgggcttatctggcaaatcccgcttatggtcttattttcgactgctcgggttagcattgatataagtaaacaaacatttaccggtaaaatctttatctcagtttacattcgtttgcgttttcacgcgggtaccgcaatacctgaaccccaacgtttttattatcgattacaaaataaaatcctgtaataacaatgaattgaattttgtaatagatatgacaaccaaaaaaagccatacgtatccggcatttgttacaggcatcttaccgcaaaaaccttattttcataagtgttattgggaatgttctgatgctaacgaagaccggagacgtagcttagacttattgatatttaccgtcaccctgatttttcaatcataatattaaataaatattaattgataaattgagaattcattaatactgctgaacaatagcgggcgcacggttttgattccgtctaatccagttcatgccgcaaacacgctgatataacggcctcaacgaatatcagactaaaactcccgtgatttcctttaagccaagatcaagcgctttcactgcaaattaaacaggaattttaactggacaaccactcccccgcgcagcgttaacctctgccagcgactgacgaaaggccgcaaaatcttcttctgtaaagccttctaaactgccacccggcggagtacattattcggtgctgacttccacggcagggagtggccaataacagctaaaaggtcaaaggttcatgtcacccatcgaaaaatccagcaagttagataacgtctgttacgacattcgtggcccggtgcttaaagaagcaaaacgcctcgaagaagaaggcaataaagttcttaagctcaatatcggcaaccccgcgccttttggctttgaagcgccggacgagatccttgttgacgttattcgtaatctcccgaccgcccagggatattgcgattccaagggattatattccgcccgtaaagcgatcatgcagcactatcaggcacgcggcatgcgcgacgtcaccgtggaagatatttatatcggcaacggcgtgtctgaacttatcgtgcagtccatgcaggcgctgctgaacagcggtgatgaaatgctggtgcccgcgccggactacccattatggaccgccgccgtcgcgctctccagcggtaaagccgtgcactatatttgcgacgagtcttccgactggttcccggatcttgacgatattcgcgcgaaaatcacgccccgtacccgcggcatcgtgatcattaacccgaacaacccgaccggcgcggtttattcaaaagagctgctgctggagatcgtcgagatcgcccgtcagcataacctgatcatcttcgccgatgagatctacgacaaaattctctatgacgaggcagaacaccactccattgcgccactggcgccggatctgctgaccatcacctttaacggtctgtccaaaacctaccgcgtggcgggcttccgtcagggctggatggtactgaacggcccgaaaacacacgctaaaggttatatcgaagggctggagatgctggcgtcaatgcgcctgtgcgccaacgttccggcgcagcacgccattcagaccgcgctgggtggctatcagagcatcagcgagtttatcgtgccgggcggacgcctgtacgagcagcgcaaccgcgcatgggagctgatcaacgatattcctggcgtctcctgcaccaagccgaaaggcgcgctctatatgttcccgaaaattgatgcgaaacgcttcaatattcacgacgaccagaaaatggtgctcgatttcctgttgcaggaaaaggtgctgctggtgcagggaacggcgtttaactggccgtggccggatcatgtgcgcatcgtgacgctgccgcgtcttgacgatctggaaatgtccatcacccgctttggtcgcttcctgtcgggttatcgccagtaacatacgcaagggggaagtttgcatcttcccccgctctgcgggcacaatggctttacgttgttgccaccggcaggttacccatgagtcaaagtcatttcttcgcccatctttcccgtcttaaattaatcaatcgctggccgctgatgcgcaatgtgcgcacggaaaacgtctctgagcatagtttgcaggtggcgatggttgcccatgcgctggcggcgatcaaaaaccgcaaatttaacggcaacgtcaatgccgagcgtattgcgctgctggcgatgtatcacgacgcctcggaagtgctgaccggcgatctccctaccccggtaaaatatttcaatacgcagatcgcccaggaatacaaagcaattgagaaaatcgcccagcagaagctggtggatatggtgccggaagagctgcgggatatttttgcgccgctgatcgacgagcaccagtacagcgaagacgaaaagctgatcgtcaaacaggcggatgccctgtgcgcctacctgaaatgtctggaagagctgtctgccggaaataatgaatttttgctggcgaagtcgcggctggaaaaaaccctcgccgcgcgacgcagcgaggagatggattattttatggcagtatttgtaccgagttttcagctgtcgctggatgagatcagccaggattctccactctgaccgccctgcccggcggcgctgcgcttgccgggcctgtgatttcacaccaaatcgtaggtcgggtaaaacgcagtcgccacccggcaaaatatcccctcatacctcaaaacgggaacaacaccgggatcaacactacgcacaccaccatcacgatcagggtgaacggcacgccaatcttcacaaaatcgctgaacttataattccccggtcccagcactaaggtattcaccggcgaggagaccggcgtcataaaggcggcagaggccgccatcgccaccatcatggcgaaggggtatggcgataattccatggatttggcagtcgccagcgcaataggcgccatcagtaccgccgtggcggtattggaaataaaaaggccaatggtggcgcagaggacaaacagacaaagcagcatcatgtgcggcccgtagccgccgccgaactgcatcagcccttttactgccagatccacgccgccggtcttttgcagcgccagcgcaaagggcatcatgccgacgataagaataatgctcggccagtgaatggctttccaggcgctttccgcgtcgatacagcggaacttgcccatcagcagacaggcgataatggccgcgatgggattggggatctcatcggtcagcatcagggcgatcatcagcaccagacaaaaaatggcatggggcgcctggctgtgcgcgggggaggcatcgctctcctccaccggcatattcagcaccacaaaatcgcggcccttctgccccagcgcggaaatcagcttccagttgccgatcaccagaaaaatatcccccagcgccagcggctcatcgacgatggccccctcaagggcgctgccgtcgcgcttgatacccaccacgttcaggccgtaacgactgcgaaagccgatttcacgtaccgttttaccgataagctcggaattggggatcaacgacacttccgccatgcccacatccagcgcctggtcggaaaaatactcgccgcgcaggatcatcggctccagctgctgctcgctgcaaaactcacgcaaatcaacatccgccgccgacatatcgatcagcagcacatcgcgggcgcggaattccgacacgccgttaacgttgaccatcacgcggcgaaaatgccgccagcgctcgacgccgatgacgttcgcgccgtagcgctcgcgcagtttcagatcgtccagccgctggccgatcatcggcgagccggggcggatcgccagacgccgtgcgcgcccggtcaggcgatactctttaattaagtcgcgaaaggtgcggcgcttccagccgtcgcgctgatgctccggctgctcgcctttcagcgcaaagcgcattatcagcatgtacaggatgccaagcccgaggatcgccagccccagcggcgtgacgctgaaaaagttaaagcccgtcagcccctcgcgcaacaattcgctgttcaccaccaggttcggcggtgtggcgaccagcgtcatcatgccgctgataagcccggcaaagctgagcggcatcatcaaccgcgacggcgagattttcatgcgtatggagacgctgagcacgacgggaataaatatggcgaccacgccggttgagctcatgaaggcgccgaggcccgcaacggtgatcatcaacatcaccagcattctggtttcgctgctgcccgccaccttaaccagccacgcgcccatactggtggcgacgccggtacgtaccagaccgtcgcccatcacaaagagcgcggcgataagaatgacgttaggatcgctgaagccggaaaaggcttcgctgagcgttaaggttccactaagtacgaaggcgatgatcaccagcagcgcgacggcatccatgcgcaccttgccggtagcaaaaagtacaatggccacgcccagaaggcaaagaacccaaattaattccccgttcaccctatatccttattcgttgagagggtaattattgtgccataaaaaagccccgtcggaacggggctaaatcatgggatcaggcgttaatttgtacttctacttcaccgtccggccgccgggtgatgaccagcgcctccaggctttgcagcgcaaaatccacttcatcaagacgcggtgagttttccggggcgttaacggaaatgacatggcagcccgccgccagcccggagaggatcccggcggaggcatcttccaccaccacacagttttccgctggcaggccgagcagctccgctcccagcagataggcgtccggctccggtttgccgcgtttcacctgttcggcggtgacaaatactttcggcgagggtaaaccggcggcctgatgccgcgcacgggcgaccggcatcgatccggacgtcacgatcgcccagggaatgtccagcgcgtcgagatgcgtcagcagcgccaccgcccccggcagcgcgatgataccggtggtgtcgctggcttcgatgccttccagacgggtgaattccgcggcgatctcctcttcactgcgtcctttcataaagtgacgcagcgaggtgatggcctgtttgccgtggatgaaattcagcacctcgtcatgcgcgatgccaaaacggtccgcccagttacaccacgcccgctcaacggctggcagcgagtccaccagcgtgccatccaggtcaaacaaaaatcctttacacagcacaggcaggtcctcaggcgttaataatctggttaatttcgttggcgctcagatggtactgacgcgggcaggcatgccatgcgcccagcatacgctggtatttttcccacatcggggtttgtgcattgaagccatgcgtaccggcatcgaaatcggtgtaacgcccttcggtgttcaccataaagcgaacatagctgaggtaacgggattctgtcgccgcatcgaagccgagaaaagtgacccgacgctcgtcaatcgtctgcgcgtctttcaggttggtccaggatacgtgcagcgcgtgatacatctccataatgtcgatcaccacccggcaggtctcttccgacagctcgccgaattcacgatccagttcgcgcatttgcaggccaaagccgcgttccacgatggtttgcagacggcggtaacgctcggcattattgggatccagcatggtcatcattttgtactgattcgacaggatcaggcgttgggcgttggtcatttccattcgttactcctcattacttcacggcaaaaaaaagaggcacataaattatgtgccttctttatatgcgtaatcatgggcgaattacaaatcatccaggaaagttttatccagttgtttgaaggcgcgcttaagcgtgtcagccagcgcctgataatcgggtttgccttcaacaggggccagcgcctgcccggcctcctggagtttgccccgcacttcataaaaccattgcagaatggagggcggtaatggcgtgaccgaacgcttgcccagccaccacaggccctgcatcggcaggctcagcgcaaaaagcgcggtggccaccgccggaccaagttgaccgccaagggcgatctgccagcaaagggtgaataccgcgaggggcggcataaagcgaatggcgtagcgcgtaacgcggatcgtgcggttttcaacaaaaagcggagcgaggctcttttccatgggccaggttttcgcataatgctgtccccgacgaaacaggctgaaaaagctcacatggcgatcttcaggtgcagacatggcgttacctcaacttcacatataaaaattaaaaaatttgtgcaaaacaacaactgctcgggacaacgttcaaaatattttgtcataccacgctgctatcaggtatcctgtttcagcctgatttggccatagacgacgaatcaaacatcgtcaatttaatgaatattatgccactgcctgaaatttgtacaaaatggcataaaattatctgtattccctttcatcgtgccaaaaagttaactgagcatgatgttaatcataaatgtcagcgtcatcatacgctacgctgtgagactcactgacgtttttttagccacgtatcaataataggtacttccatgtcgagtaagttagtactggttctgaactgcggtagctcctcactgaaattcgcaattatcgatgctgtaaacggtgaagagtacctttctggtttagccgaatgtttccatcttcctgaagcccgcctgaaatggaaaatggacggcaataaacaagaagcggctttaggtgcaggtgccgctcacagtgaagcgctgaactttatcgttaacactattctggcacaaaaaccagaactgtctgcgcagctgaccgcgattggtcaccgtatcgtccacggcggtgaaaaattcaccagctccgtaatcatcgacgagtccgtgatccagggtatcaaagacgccgcgccgttcgcaccgctgcataacccggctcatctgatcggcattaccgaagcactgaaatccttcccgcatctgaaagacaaaaacgtggcagtgttcgacaccgcgttccatcagaccatgccggaagagtcttacctctatgccctgccgtacaacctgtacaaagagcacggcgttcgtcgttacggtttccacggcaccagccactacttcgtgacgcaagaagcggccaaaatgctgaacaagccggtagcagaactgaacatcatcacctgccacctgggtaacggcggttctgtttccgctatccgcaacggcgagtgtgtcgatacttccatgggtctgaccccgctggaaggcctggtaatgggcacccgtaccggtgacctggatccggctattatcttcttcctgcacgataacctgggcatgagcgttgatgacatcaacaccatgctgaccaaacagtccggcctgctgggtctgaccgaagtcaccagcgactgccgttatgttgaagacaactacgcagaaaaagcggacgctaaacgtgcaatggacgtttactgccaccgtctggcgaaatacatcggctcttacactgcgctgatggacggccgtctggacgccgttgtcttcaccggcggtatcggtgaaaacgccgcaatggtgcgtgaactgtccctgggcaaactgggcgttctgggcttcgatgttgatcatgaacgtaacctggctgcccgcttcggcaaatccggtttcatcaacaaagaaggcaccaccccggcgatggttatcccgaccaacgaagagctggtcatcgcacaagacgctaaccgtctgactgcctgattcaccacaccgccagccaacgctggcggtgctgttttatcttccgcccgcagcggcggtaacgaaagaggataaatcgtgtcccgtattattatgctcatccctaccggaaccagcgtcggcctgaccagcgtcagcctcggtgtgatccgtgcaatggaacgcaaaggcgttcgtctgagcgtgttcaaacctatcgcccagccgcgcgctggcggcgatgcccctgaccagaccaccaccatcgtgcgcgcaaactccggcctgccggctgcggaaccgctgaaaatgagccacgtggaatctctgctctccagcaaccagaaagatgtgctgatggaagagatcatcgcccgctaccacgaaagcgcgaaagacgcggaagtggtgctggttgaaggcctggtgccgacgcgtaagcatcagttcgcccagtcgctgaactatgaaatcgccaaaaccctgaatgccgaaatcgtgtttgtcatgtcccagggcaccgatacggcggagcagatcaaagagcgtattgaactgacccgcagcagcttcggcggcgcgaaaaacgccaacattaccggcgttatcgttaacaagctgaatgccccggttgacgagcagggtcgtacccgcccggatctgtccgagattttcgacgactcttccaaagcgcaggtcagcaatatcgatccgacccagctgcaacactccagcgcgctgccagtgctgggcgcagtgccgtggagcttcgatctgatcgccacccgtgctatcgatatggcgcgtcacctgaacgccaccatcgttaacgaaggcgacatcaatacccgccgcgtgaagtccgtgactttctgcgcgcgcagcattccgcacatgctggaacatttccgtccgggctccctgctggtgacgtctgcagaccgtcctgacgtgctggtggccgcctgcctcgccgcgatgaacggcgtggaaatcggcgctatcctgctgaccggcgcttatgaaatggacgcccgcgtcgccaaactgtgtgaacgtgctttcgccaccggcctgccggtattcatggtgaacaccaacacctggcagacctccctgagcctgcaaagcttcaacctcgaagtgccggctgatgaccaccagcgtatcgagaaagttcaggaatacgttgccagctacatcaatgctgactggatcgagtccctgaccgccacctccgagcgtagccgtcgtctctctccgccagcgttccgctatcagctgaccgagctggcccgtcaggctggcaaacgcgttgtgctgccggaaggcgacgagccgcgtaccgttaaagcggctgccatctgcgcagagcgcggcatcgccacctgtgtgctgctgggtaacccggacgaaatcaaccgcgttgcggcatcccagggcgtagagctgggcgctggcattgaaatcgtcgatccggaagtggtgcgtgaaagctacgttgcccgtctggttgagctgcgtaagaacaaaggcatgaccgaagccgttgcccgcgaacagctggaagacaacgtggtgctgggtacgctgatgctggagcaggacgaagttgacggtctggtttccggtgcggttcacaccaccgcgaacaccatccgtccgccgttacagctgatcaaaaccgcgccgggtagctcgctggtctcttccgtgttcttcatgctgctgccggaacaggtttatgtttacggtgactgcgcgatcaacccggatccgaccgctgaacagctggcagagatcgctatccagtccgctgactccgccgtggccttcggtatcgagccgcgcgtggcaatgctctcctactccaccggtaactctggtgcaggtagcgacgtagagaaagtccgcgaagcgacccgtatcgctcaggaaaaacgtccggatctggttatcgacggtccgttgcagtatgacgcagcagtaatggctgacgtggcgaaatccaaagcgccgaactcgccggttgcgggtcgtgctaccgtgttcatcttcccggatctgaataccggtaacaccacttacaaagcggtacagcgttctgccgacctgatctccatcgggccgatgctgcagggtatgcgtaagccggtgaacgacctgtcccgtggcgcgctggtagacgatattgtctacaccatcgccctgacggcgatccagtcttcgcagcagcagtaataccggacgcccggtggcgctaacgcttaccgggcctacggttttgtaggccggataagcgaagcgccatccggcaagaaaggcgaccccatacaggtcgcctttttatttacaacaactcccgcgccgccgtgacaatatcctgcgccgtcaggccatactctttttgcaggaaatcctgggtgcccacctggccgtaccgccctttaaccccgacgcgacgcatcggcaccgggcaggtttccaccagcacttccgccaccgcagaacccagtccgttgtgaatactgtggttttcacaggtcaccactttgccggttttctcggcgtagtttttgatcagcatccggtcaatgggttttagcgtgaacatgtcgatcaccgccgcgctgacaccctcctgcgccagcgtctctgcggcttgcaacgcttccgccaccataatgccgttcgcgataagcgtgatgtcgctgccatcgcgcagcacgttgcctttgccgatggtaaaaaccgagccgggcgcataaaccgtcgccgcctgtttacggatggtgcgcagccagtaaaagccgtcgagcgtcatcagctggcgcagcacatcatcgaacatcaccgcgtcggtaacttccagcaccaccgagtgcgccagcccgcgcacaatgcccatatcctcgaaggacatgtgggtgccgccattgtgacaggcggtcacccccgcatctgaggcaataaccttcacgttattgcgctgatagtccagcgccataaacagctgatcgaaacagcgacggctggcgaaggcggtaaaggtatgcacaaagggtttacgcccagtgagggaaagccccgccgcggtgccgatgacgttagcttccatgatgccgcagttgatcacgtgctgcggataacgcttgtgcacgccatccatcgccatggaactcatcaaatccgcttccagcgcgataatatcgctgccgctctcaatctgctctgccacaaatccggcgtacactttacgcatttcaacggcgtcttttcccccgacgggtgcgagcttaatcatgcgcggcctccagttgtgcgatggtctgatccagcgcctgcttcatctcatccgtcaggcgtaaatggtgtgaattgccgagctgttccagataaggcacgccctggcccttgatgctgtcgaggatcaccaccctggggcgcgcctccgccgccggtcgcggcgccactacctccagcagcccggcaatgtcgtcgcctttaacggtataaacgtcatagccgaaggcgcggaatttcccctccagatcgaaggcgcagatgatctcgtccagctcgccgtccagctgctgtttgttccagtcgacaaataccgtcaggttattcagccggtgatgagcgataaactggaacgcctcccagcactggccttcgttcagctcgccgtcgccgacgatgcagaacacccggttcgcgcgcccggccagcttatgggataacgccatgccgcccgcgatggagatcccctgccccagcgagccggtggtcgcatccacgccgcgggttttcagccgatccgggtggcttggcaggcgtgtgccgttctgattaagggtctgcaactcctcaagcgggaaatagcccttaatggcgagagtactgtagagcgccggcccggcatgccccttcgacaggacgaagtaatcacgctgcggccagtcgggatccgccggatcgatacgcatcacttcgccgtacaataccgccagggtttccaccaccgacatgctgccgccgtaatgcccgaaacccagcgtggtcagtgatttcagggtggcgatgcggatctcccgcgccagctgcgtcagttctgcaatactgctcataatttcgctccgctattgggctgcgtgtcgccagccgcaggtttttttcgtgcaaacagattccacgccaccagcgcggcgaacagcgccaccaccagcccggtgatcgccagcggtgagagatagcgcgccagattgcccagcacgatgccgatcacgccgaaatccgcgtccgagaaggtggtattggcgaaaccgatggcccccagcaccggcaacagcagcactggcaggaaggtaattaacagcccgttggcaaacgcgcccagcatcgcgccacgccgtccgccggtagcgttaccaaacacgcctgcggtggcaccggtaaagaagtgcggcaccacgcccggcaggatcagcaccagtttcatctgaccgagcaggaacagccccaccagcccgccgaggaagctgaacaggaaaccgatcagcacggcgttgggcgcatacggataaaccaccgggcaatccagcgccgggcgggcattgggcaccagtttttctgaaaagccggtaaatgccggaacaatttccgcgaggatcagacgcacgccctggagaatgataaataccccggcggcaaaggtgatggcctgaataatggcgtacacgaggaagttctgtccgccgctaatggtgctttcgatatattcacgtccggcacaaaccgccatgatgagataaataatgatcatggtgagcgagatggagatagagctgtcgcgtaaaaagctcaggttcttcggcaggttcatctcttccgttgaacgcgagcccttaccgcagacgctgccgatccagccagccagcacataacccagggtgccgaagtgaccaaagccgatgtcgtcggtgccggtaatacgccgcatatagcgctgggcaatggccgggaagaaggccatcaccagacctaaaatcagcgagccggtaaataccagcccgacgccttcaaacccggcgacggtaaggatcacgccgatcatacaggccatgtaaaacgtatggtgcccggtgaggaagatgtacttcagccgcgtaaagcgcgcgacgataatattggcgaccataccaaaggccatgatcagcgccgtcgatgcgccatatttttccagcgcaatggaaacaatcgcctcgttatttggaatgatcccctgaatattaaaagcgtgttcaaacataccgcctaatggattaagcgatcccactaataccgtggcaccgccgcccagcacaataaaaccgagaatggttttaaccgtgcctttaaccacatccgaaaaggattttttctgcgccaccagaccaattaaggcaattaagcccaccagcactgacggcactttcagtatatcaacaataaaattgagcgtttcaaggataaacatatccgcctcgctttatatgcagttaccggttggcaaaataagtctggagcttggtttccagctcattaatatcgataatattgttgatgaccaccagctggttgtccggcacgctggcgctggcggcgatgtctttcgccatcacgaacagatcggctgcccctggcgtggcggaggagagatcggagtgttccacctccgcctcaatattcagctttttgagcacttttttaatattcatttcgaccataaaactgctgccgaggccggatccgcaaattgccataattttcattattatcacctttcgtagggtaaagttcaggcgcaccacgcaatatggcgtgatgttataaaagcattagcgtgtataaatctaaaagcgttgaataatgttttctatttcctcccgggtggttgcctgatgtaattctgctaagtcctgatcgctggaaaataattccgcgagggtggcgatcatctcaatgtgactgtgcttatcggctgccgcgagcataataatcagatccaccggatcgaattccccggcgttaaatgaaacaccgtgctgtagtttcaacagtgataagccgtgcgcctttgccccctcttccggccgggcgtggggcatcgccagccctggcgccagcacgtaatatgcccccagcgcctgctgctggctgatgatggccggtacgtaatccgccgtgatgacccctgcatccagcagcggctgcgcgcagatcgccagcgcctgttgccagtcatcaacccgttcgcggcgttgaatggtgggaccgttaagccatgtttccagcactctgcttccctctttaatggcaaaagatggacaaactttatgcaaggatccgcagactgaccgtgacgatagtcacaaagatagcgctatcaaaaaccactgtgcagaattgtgatagcgctatcagatcacattcattgttctgaatcgcggtaataatggggttatacggcgtatacttcttttgccacgaataaaataaatcgaaaaaagccactgagatcatcgtctttacgcaggaacgagaatgtctattacccgaaaacggcgcaataccggaaaggtgacgctggcggatgttgcccagctggcgggcgtcggcaccatgacggtttcccgtgcgctgcggacgcccgagcaggtttccggcaagctacgtgaaaaaattgaggcggcggtacaggagctgggctatctgcctaatctggcggccagcgccctcgcctccgcctcgtcgtggaccattgcgatggtggtgcccaatctggcggagtccggctgttcggaaatgtttgccgggcttcagcaggtgctgcaaccggcgggctaccagatcatgctggccgagtcgcagcaccggctggagcaggaagaaaagctgctggaaacgctgctggcctcgaacctggccgccgccattttgctcagcgtcgagcacagcgaaaccgtgcgtcactggctgaccaacgccagtattccggtgatggaaatcggcgcgacgcgaaccgatcccattgatatgaatatcggcattgataacgtcgccgccatgcaggaattaacgcaaacgcttatccagcgcggttatcagaacatcggcctgctgtgcgccaatcaggaacagtggatctttcagcagcatttgcagggctggtataaagccatgctgcgccaccatatgtcgcccaaccgggtaattaacgccgccgcgccgcccaccttttcgaccggcgcggcgcaactgccggagtttttactggcatggccggagctggatgcgctggtttgcgtgtcagatgagctggcgtgcggcgcgctctatgagtgccagcggaggcgcatcaaagtgccggacgatctggcgattgtcggctttggcgacagcgatgtcagccgggtatgccagccgccgctgaccaccatcgccgtaccgcatcgccagattggtattgaagcaggtcgcgccctgctggcgcgactgaatgatgatgactggacgacacgcgcgcctattgcctcgacgctgtgtctgcgggagagttgctgaggttactgcgccgtttccagctttggctgatcgttgttggcattgcgggtcatccacagtgccagcgctttcagcgaatccggggtgaactcatcgcagcgggcggtgatctcttccggcgtcatccagcatacttcgctgacttcatcttcctgaagggcaaaggggccgtgggatacacagctgaacagcgcgccccagacgcggcagtgttcatcttcgaaatagaactgcccgtgctcggcgaggggcacgcccgcaatgcctaattcctcttcggcttcccggcgcgcggaatcgagcaagacttcatccgcctgtaccacgccgcccgctgtggcatccagcatacctggcataaagtctttggtctcggtgcggcgctgcaccagaattttgcccatgccatcatgcacgacgatataggtcgcgcgatgacgcaaacactgcgcgcgcatttgttcgcggctggcctgcgctatcacctcattgtcttcgttgacaatatctacccattccgtgcctgtaaaatgacgttgttccaccatcaggaaaccttctctctaagcgttcttatgacgcgtttttggttgtcgggtaaattacggattaatcgtgacctgtgcaataacgcgttgatcattcagtgcgattacacgcaaaaccttttcatccagcatgccgtagctggcgacatttccgcctttaggaatgctgaccgagccgggattaaaatgaacaatctcatcacgccgttccgccaccggcagatgggtatgaccatacaccagcacatctcccgctcccagcggcggcagattatccggcccaaacagatgcccgtgggtcagaaacaaccgctgattatccatcagcacctgttgccagggcgcggtgatgggaaaattcagcagcatctgatccacttcgctgtcgcagttgccgcgcaccgcaataatgcgcgccgcctgctcgttcagccgcccggccacctgcgcaggcgcatagccttccggcagcgcgtttcgcggcccgtgattcagtatatcgcccagcagcaccagccactgcgcgccgctttcggcgaaccgttgcaacacgcgttcggtagccggtaacgatccatgaatgtctgaagcgaacatcagcttcattgcgcaaacctcgtggtaaaaatcccgtctaatgatagcggatctctgaccgtcgatcagtctgaaggctgcgcagaaagtgcgacataacgctgcactgaggagcgctgccactggaatgtcgcgtattccacaagcgcttcgggcacctcatcgccattaagcaccaggcggttgagcatcagcgccagatcggcatcagcaatgcaccattcgccaaacagattcggcttgccgtgagcaagcagcaggctggcagtatcaaagagtttttgagcgcttgccagaccagcggcgctgagcggcgcttttttcacgcccccgaataccacgtcagtggagcgctcttcacggatcggcatcaggtcgctgcgcagccaggcctggatttgtcgcgcgcgggcgcgtttttgcatgtcgtggggatagatgcgctcccattcaggcggggcgaacttctcgtcgagatattcggtaatggcggaggattcactgagctcgaaaccgtcaatttccagcaccggcacgcggcgggtcagcgtatagccctgccagccagggcgcgtattttcgccgctatccagatccaccgttttcagggtgaagggcaggcctttttcgtgcagtgccacatacaccgacataacataaggtgaaaagtaatttgcatcagaccataacgttattgccgcatcgctcataacaacctcacgcaccagggaatttaccttcaaaatagtgctttacgacacgtctgtcactcaggaaaactcaccacgccggtgttacgcctatactccattctgcgacgccaccgctacgacaggagctgacatgatcgatctctattacgccccgacgccgaacggccataaaatcaccttgtttctggaagaggctgaacttgattatcgtctgataccggtaaatatcggcaaaggcgatcagtttcgcgctgagtttctggaaatatcgcccaataataaaataccggccattgttgatcatacgccttcagatggcggtgcgcccctgagcctgttcgagtccggggagatcctgctttatctggcagagaaaaccggcctgctgctgagcggcgagctgcgcgagcggcaccgaacgctgcaatggctgttctggcaggtgggcggcctcggcccgatgctcgggcaaaatcatcatttcaaccacttcgcccctaaacccgaaccttacgctattgaacgctatcaggtggaaacccagcggctttataacgtactgaacaaacgccttgagcaggtgccctggctgggcggggaacattacagcatcgcggatatcgccgcctggccgtgggtcaacagccatgagcgccagcggattgatttaaataattttcccgcggttaataactggtttgagcgcattcgtaatcgccccgctacccagcgggcaatgcaaaaagcgcagcaactttaggggcgctgcgcgcggcaataatcctcgtgtatgatggagccattcattacaaggagaattatttcatgccgcaacctgatgctgttattcggataaaaaacctgcgcctgaggacttttatcggcatcaaagacgaggagatcgcgaaccgacaggacatcgtgatcaacgtggtgatccactatccggcggagaaagcgcgcgccagcgaagacattaatgatgcgctgaattaccggacgatcaccaaaagcattattcagcatgtggagaataatcgcttctccctgctggaaaaattaacccaggatgtactcgatattgcgcgggaacatcgctgggtgacctatgctgaagcagagatcgataaacttcacgccctgcgttacgccgattcggtatccatgaccatgagctggcggcgctgagcgttaacaggaggttgcatgagggtcctgattacgggcggtaccgggttgattggccgccatcttattccccgtttacttgaactgggccacagcgtgaccgtagtgacgcgcaacccgcacaaggcgcagggccagctcgacgcccgcgtcacgctgtggaaagggctgcacgatcgcacggatctgaacgatatcgacgcggtgatcaatctggcgggcgagcccatcgccgacaaacgctggagcgagacgcaaaaacagcgcctgtgcaacagccgctggaccatcacccaaaagcttgtcgatttgatcaaggccagcgacacgccgcctgcggtgctgatttccggctcggccaccggctattacggtgatttaggggaagtggtggttaccgaagaggaaccgccgcacaacgaatttacccataagctgtgcgcccgctgggagcagatcgcctgcggcgcgcagagcgaggccacccgcgtctgtctgctgcgtaccggcgtggtgcttgcccccaaaggcgggatcctcggaaaactgctgccggtgtttcgcgccggtcttggcggccccattggcaacgggcggcaatacatggcgtggatccatatcgacgatatggtcaacggcattctctggctgctggataacgatctgcgcggcccgttcaatatggtctcgccttatccggtgcacaatgaacagttcgcccactcccttggccatgtgctgcatcgcccgaccatcctgcgcacacccgctaccgccattcgcctgctgatgggtgaagccgcagtgctggtgctgggcggccagcgagcgctgcctaaacggctggaggaatcaggctttggcttccgctggtttgaactggaagacgcgctggcggacgtggtgcgctgaatggtaccggtaatggtcactctcaccaccccgcgcctgacgctttccacctttcaggaaagcgactggccgttctttttacgtctgcgtcaggatcctgacaacatgcgctatatggcggatattgccgccgaggacgaagtgcgccatgtgtttttcacccgcctgaataactccggggcctttgtcatccgccgtcatcacgatgcgacgccgctcggcgatctcgggctgcgtatcagctcgcagaatccgctggaggcggatgtcggctacagcgtggtaagcgaggcgcagggccagggcatcgccagcgaagcgttacgggcgctgtgtgagtatgcgtttgcacagacgggcgtgacggcgctgaatgcgtatgtgctggcggaaaaccgcgcgtcacaacgggtgctggaaaaactgggatttgtgcagacggacgtgctgccaaaggtttacagggtgaacggcgtgtttcatgacgactgcgtgtatcgtcttgagctggcggattttaaataagcccctcacccacaggatgagggggccggtttacttcagcgatcctttaaggaactgctgcaaacgcgggcttttcgggttgtcgaacagctcggcaggggtgccctcttcttcaattttcccctgatgcaggaaaatcacgtgggaagatacatggcgggcaaagcccatttcgtgggtgaccaccaccatggttttgccctcttccgccagctgctgcatgatgcgcagcacttcgcccaccagctcaggatccagcgccgaggttggctcgtcgaacaataacacttccggctccatcgccagcgcgcgggcaatggacacgcgctgctgctgaccgccggacaggtgcaccggatatttcccctgagcgcgctcgtcgatgccgactttcgccagatatttcaccgcccgctcgcgggattcctgcttgctcagccccagcacctgaatgggcgcttccatgacgttttccagcaccgtcatgtggctccacaggttgaaatgctggaacaccatggtcaggcgggtacgcagcaggcgcagctgatttttatcggccaccttcaattgaccgtctttatcgcgcaccagcgtgatgttctgcccgctgaccacgatcgtcccttcgctcggtttttcgaggaagttaatgcagcgtaaaaaggtacttttaccggagccggaggagccgataatggtgatcacatcgcccgcattcgccttcaacgatacgcctttcagcacttcgtgttcgccgtagtgtttgtgtagatcggtaacgtttagtttgttctcagacatcgtattctcagtgcgtcgaagaaggtttcacatgctgtaaccagcgcttttccgctttgcggaacagactgatcagcacataagagataatcagatacagcaccgccgccagcccaaaggcggtaaagggctgataggtcgccgagttaatatcacgggcaatcttcagcagatccggcacggtggcggtaaaggccagcgctgtggagtgcagcatgaggatcacttcgttgctgtaggcgggcagcgcaatacgcagcgccgacggcagaatgatgcagcgatacattttcacctgggaaaagccgtacgcccgcgccgcttcaatttccccgtgcggcaccgagcggatagcgccggcgaaaatctcagtggtataggcgcaggtattgagcgtcagcgccagcaccgtacagttcaggccgctgcggaaaaaggcgttcagcagctccgtacccttcaccacttccagggtgtacataccggagtagaacaccagcagttgtacgtagagcggcgtgccgcggaaaatataggtaaacagccagatcgggaaccagataaatttgttgctggaaacgcgtccgatagccagaaacagcgccagaatgccgcccattaccacggaggagatcaacagccacagggtgatcgccacgcccgttaagcgatagccgtccgtccacagcagggattgccagtactcctgaataatctcgatcacaggtcagccctcttcacacccacggagtagcgacgttcgagcagaagcagcacaccattggagacagtggtaaacaccagataaattaatccgcacactaccgcgaaatagaacggctcccaggtgcttttcccggccagctgcgtggcttttaccacgtcttccagacccagcagcgataccagcgcggtggcttttaaaatcacctgccagttgttaccgatgcccggcagcgcgtaacgcatcatcgccgggaacagaatacggcgaaagatctgcgatccggtaaaaccgaaggcggtcgccgcctcaatatgccctttcggcaccgccataaacgcgccgcggaaggtttcggtaaaataagcgccgtagataaagccgagggtgatgataccggccaccatcggatcgatatcgatctgccccatgccaatggcttcggtaacgctgttaatggcaatttgcagaccgtagaagatcagcagcatcagcaccagatccggcacgccgcggatcagcgtggtgtagccttcgaagatgatgcgcagcaggcggttgccggaaagcttgcccccggcccctgccagaccaatcgccaccgccagcactacggaactgagcgccagctccagcgtaacgatagcgccctgtaaaattacctgtgaaaacccgtacagcatgcagcctgtgtcctgtgtgtgttgatgccggatggcggcttcgcctgatccggcctacgaaatgcgctcaccgcgtaggccggataagacgcgtcagcgacgccatccggcgacctgatagcgatcagccaccgtaaacgtcaaaatcaaaatacttcttcgccagtttttcgtaggtgccatcggcgcgcatctccgcgaaagctttgttcagcgcttcacgcagttcggtatcgtctttacgcacgcccatgccggtgccgacgccaaacagtttttcatctttcactgacgggccgccgaatttataagcgctaccgaccttcgttttcaggaagccttcgctggcggcgacttcatcctggaaagcggcgtcaatgcggcctgcggtcaggtcagcgtagatattgtcctggccctgataggagacgatttccacgcccttcggtgcccagtgcacattaccgtaagtttcctgggtggtgccctgcaatacgcccacgcgcttgccctgcaacttcgccagttctggcacgatatcagaatcttttgccactaccagacgggaatctgccgcatagagcttgtcggtaaaggcaatctcctgctggcgtttttcggtaatcgacagcgacgacataatggcgtcgattttcttcgctttcagcgacgggatcagcgcatccagcgggttctcaatgaaggtacattgcgtattaatacgtttacagagttcttttgccagatcgatgtcgaaaccaactaattcaccctgtgcatttttcgattcaaagggcgcgtaagtcggatcggtaccgatacgaagtttttgcggaatggcagcgaaagcgccggagatactggaaacagcgaacaccagagaaagagataacaccagttttttcatatttatcctcaacagcctgactttccagggggatttgttaaatgaagttgactggtatcgtgccattgttcgccccgacaaggcaaaatattctgtaacaagttacgcttttttttgcatcgcttttgcttaactatgcatgaatgctccattgcggtgcatgaaacgcaccacgctgaagcattcatgtcagttatgcaccacggcgcaacaggtatcagtcgccgtagacgttaaagttaaagtattttttcgccagcttgtcgtaagtgccgtctttgcggatctcatcaaacgctttatcgaacgcagctttcagctcggcgtcgtctttgcgcagaccaataccggtgccgtcgccgaaatattttttgtctttcactgaagcgcccgcgaagtcgaaggttttaccggctggctgcttgaggaagccttcgctggcggccacttcatcctggaaggcggcgtcaatacggcctgcggtcaggtcggaataaattagatcctggttctggtaggccacaacgtcgacgcctttgctgcgccagttgtcatttgcataggcttcctgggtggaaccctgtagcacgcccacgtgtttgcctttcagcgaatcggtggtcggctggatgggcgagcctttcaccgcgatcagacgggcgttagcagcgtacagcggctgggagaaggcgatttcctgtaaacgtttttcggtgatcgacagagacgaaataatcgcgtcgattttcttcgctttcagggaggggatcagcgcatcaaaatcgctgccgacccaggtgcatttcactttgatacgggtgcacatctcgttgccaagatcgatatcaaaacccacgaagtcccctttcgcatccttggatgagaatggcgcgtaggtggcgtccgtaccaatgcgcacggtctgcggcagtgcggcgttaacgctggcgacaccggacaggcccagcagtaaagacagagcaacaaccgtcttcttcatacattcccctcaagttttctgattttattatgtattgcgttgtgttgtgtgtttgctacccgtcaatgcttgcatgtcttatgccagtttgttgccgctgcgatttaccgcgttgagtatgttaacaaaaggttgcaatactgacgtacagtgaaagatagcaggtctgccgacacactcgcgggttacaaaccgaaaacggggattaaatgtcgaggatatgatcgcgcttgcagaattgccccttaacggggcagcgcactactttgaggcattgccgcccggccagcgggtgaaaagatcggcgggcagttcaatatcaaactgatccagcacgcggttcaccgtctgattaatcacatcatccagcgtctgcggacgatgatagaacgccggaacaggcggcatgatcactgcgcctatttcagcggcctgggtcatgagacgcagatgtccaagatgcagcggcgtttcacgcacgcagagcaccagcggacgtcgctctttcagcaccacgtcagcggcgcgggtgaccaggctgtcggtatagctgtgtacgatgccggagagggttttgatcgagcatggcagaatgaccatgccagcggttttaaacgagccggaggagatagtggcggcgatatcgcgggagtcatgcactacatccgccagcgcctgcacatctttaactgagagatcggtttccagcgccagggtctggcgggcggcattactcatcaccagatgggtttccaccccggcaacatcccgcagaacctgtaataaacgcacgccgtaaatggcgccgctggccccggagatccctactatgagtcgtttcatgtccatcgccctttcgctaatttgctgaggactttgcaggattttggcgggagttgcaacagccctctcccggtgagagagggccggagtgagggcgttatccctcgttatgcatctctaaactttccacttcgttctgacgcagcagcgctttggtatcgtcattacgcacggcgtcgagatagtcgagatactgctgatccacgtctttggtgacgtagacgccgttgaacaccgagcattcaaactgctgaatatccgggttctcggcgcgcaccgcgtcgatgagatcgttcagatcctggaaaatcaggccgtcggcaccgatgatctggcgaatttcatccacttcgcgaccgtgagcgatcagctcattggcggtcggcatgtcgatgccgtagacgttcgggaaacgaatttcaggcgcggcggaggccaggtacactttcttcgcaccggcttcgcgggccatctcgatgatctgctcggaagtggtaccgcgcacgatggagtcgtccaccagcagcacattcttgtcacggaattccgcgcggttggcgttcagcttacggcgcacagacttacggcgcagctgctgacccggcatgataaaggtacggccaacgtaacggtttttcacgaagccctggcggtacggcttatccagaatacgggcgatttccagcgcgatatcgcaggaggtttccgggatcgggatgaccacgtcaatatccagatcttcccattcgcgggcaattttctcgcccagctttttacccatattcacacgggcgctgtacacggaaatcttgtcgataaaggaatccggacgggagaaatagacatactcgaacaggcacggattgctgaccgggttttccgcgcactgacgggtgaacagctggcctttttcggtgatgtacaccgcttcgccaggcgccacgtcgcgcaggaattcaaagcccagcgtatctaacgccacgctctccgacgccaccatgtattcggtgcggccatcggcgagatcgcgtttaccaagcaccagcggacgaataccgtttggatcgcggaaggcgaccataccgtgaccgatgatcatcgccacgcaggcataggccccgcggatctgacggttggtggcggcaacagcggcaaaaatgttatccgcttctaacgggtagtggcggaagttatccagctcgctggcaaaaatattgagcaggatttcagaatcggaggtggtgttaatgtgacggcgtttttcttcgaacagacgcttacgcagctcgtgggcgttggtcaggttgccgttatgggcaagcgtgataccgtacggagagttaacgtaaaaaggctgcgcttctgaagcgctggagctgcccgcagtcggataacgcacatggccaatacccatgttcccctgcaggcgctgcatatggcgggcttcaaatacatcgttcaccatgccgttcgctttacgcaaacggaagcagttaagttcatcaatggtgataatgcctgcggcgtcctgaccacggtgctgcaacaccgacaatgcatcataaatcgactggttaaccggcatgaaaccggcgataccgacaataccgcacatacgtatattcctcgttaagccacatctcaggacttacgccctgggcaagaaacttgacgagctttgcagatagtcaaagaaccatctgatgataaaactaaactgcgggatcagctgcgacttttgccagtcttcgcttttggaaaagccggtaaaggtgtcgagaaagaacagaatggcggcgacaatcagcgcaccgcgcagcgcaccgaagcaaatccccaacacccggtcagtacccgacaggccggttttctcgacaagctgactgataacatagttaacaatagcgccgacgatcagcgtcgcgataaacagcaccgcgatagcaatcccatttcgaaccagttcgtcttcaaagcccgtgaaccagacagacaggtaagtgtagtaatgactggcgacaaagaaagcacaaccccatgtcaccagcgacaacgcttcacgaacaaagccgcggataaggctaaccagacaggaaaaaccaattaccgcgatgatggcgtaatcaatccagaccatatgtgtcccacgattaatcgccctgtcatccagttcggggcgaattctaacagaaaaagaaaacgtttgcgtagggatttccttcccgcgcgtaaataaaaatggcgctgaaaaaatcttcaacgccagcacaggcctggcctctgcgggccgggtttttgtgcgttttttctcccctcaccccggccctctccccagggagagggggaaggaagtccgcgaacggttccctctccccccgggagagggttagggtgaggggaaaatcagttcggggtataacccatcaccacgccgcttaagccggagatctgcttcagctcgccaagggatcccttaagcttatctttcgaggcgtccgggccgaccagaatacgggtgattttaccctgcaccggcgtgcccggaatagtgaatacccgataacccgcgctgcgcagtttgccggtcacttcattaaccttatcggcattcttcagcgcccccagctgcacgacatacgccttacccgtcggcgcaggcttctcttcttcggcctgcttcgacggcgtcgtggctgcctgttgctgagcggtatcgcgctgcggttttggtttttccaccggcttaggtttaggtgttaccaccggctgcgggtcaatatccatttcaggattgttggccgcctgacgcgaggcctccagcgacggcgctgcggcgttgcccgcccgcacttcttcagccgcgccttccggcggctgtgccggaagcgcctgcgtggccgccggcagcatgtccggctcgtcgcgatcgccgggttttggcaccagcgggatcgccgcaaactcatcctggtaatgttttttctgcccgtccagcagccccggcagcacaatcacgcccagcgccaccagcacaatggtgcccattaaacggttctgaaacttactcgccaccggttctccccgcgtccatcgcttccatgacatgtgctacggtgtggaaggaaccacacaccagcacggtatcttctggtctggcatccgccattgccgcccgccacgcctgttcgacgctggcaaaggcgctgccgccgttaaggtgcgtcagcagctgttctgccgtcgcgccccgcggcccttccagaggggcacaataccagctatcgacctggctctccagacaggcaagcgttccggcaatatctttatcatgcagcatgccgaccaccgccagcacgcgtccgcttttcggcaacgctgccaggcgtccggccagataagccgccgcatgaggattgtgcgccacatccagaatcacgcgcggcgactggctcactatctggaaacgtcccggtaaaatcgctttcgcaatgccgtcgcggatcgccgtctcgctgatattcaggccgctggcacgcagggcagccagcgcggttgccgcgttgggctgcggcacctgcggtaacggcaggccagtcagctcgccctgagcatcgcgaaaacgccagcggtcgcccgtgacctcatactgccagtcggcatcgcggcgcagcaggtgcgcgcccttctcgcgtgcgacatcggcgatgctctgcggcatatccggctcgccgaccaccgccggtctgcccgcccggaagacaccggctttttcgcggccaatgctctcgcgatccggccccagccagtcggtatgatccagcgcgatgctggtcaccacggcgacatccgcatcgacaatgttggtggcgtcaagacgcccgccgaggccgacttcgaggatcaccacatcaagcgccgcctctttgaacagccacagcgccgacagcgtgccatattcgaaataggttaaggaggtatctccccgcgcaacttcgatggcggcgaacgagcgggtgtgatcgctttctgccagctcttcgccctgcacgcgcacgcgctcggtgtagcgtactaaatgcggcgaactgtaaacccctacccgtagccccgccgccagcagcacagactccagcgtacggcaggtggtgcccttgccgttggtaccggccacggtaaagacaaaaggcgcaggtttgagcacgtcgagcgtagccgccacggtctgaacgcgcgcaagtcccatatcaatggttttactgtgcaggttttccagataagaaagccacgtggccaggggcgacgtggcttgaggaatgcttttcgtttccatgatgcccggcttgaatgcagttgaaaaagtaaaaaggcagagcacctgcgctctgcccttcgattttatcaggcttcgttttcctgatcgggtaccggcggcaccacgatgctttcacgcggcgcatccgggtttggcgtcggcagattcatcagcttcgccagaatgctcgccagcttcaggcgcagttccggacgacgcacgatcatatcgatagcgcctttttcaatcaggaactcactgcgctggaagcccggcggcagtttttcgcgcacggtctgttcaataacgcgtggaccggcaaagccgatcagcgctttcggttccgcgatgttcagatcgcccagcatcgcgaagctcgcggagacgccgcccatggtcgggtcggtcagcacggagatatacggcagaccgcgctcctgcatcttcgccagcgccgcagaggttttcgccatctgcatcagcgacatcaatgcttcctgcatacgcgcgccaccggaagcggagaaacagatcagcgggcaattgtcttccagcgcctgttcaaccgcgcgaacaaagcgagcaccaaccacggaacccatggaaccgcccataaaggcgaattcaaacgccgcagcgacgaccggcataccatgcagcgtgcctttcatcaccaccagcgcgtctttctcaccggtttctttctgggcagacgtcagacggtctttgtactttttggaatcacggaacttcagcacatctttcggctcaagttcgctacccagttccaccatcgatccttcatccatcaggctatgcaggcggttacgcgctgacatacgcatgtggtgatcgcatttcgggcagacctcaaggttacgctccagttcggcacggtaaagcacctgaccgcagctgtcacatttggtccacactccctcaggaatgcttgccttgcgggtgggggtaatattgcttttaattcgttcaatccagctcattgatgacctttatgcatgaacctggtagcccataaatggggcacattaaaacataacgctcggcaacttgggacaaaaaagtggtcgaaccgctgacgggttcttattttgtctgtcgggctgctgcgcgtcggtgacgaataatttcgattacgcctggcaggatcgagagcacgataattgccacgataagcaatttcaggttctcctgcacaacgggcagatcaccgaacaggtagccggcgtaggtgaacagtaacacccacaacagcgcgccgatgacgttataggccgcgaagtgacgatacgacatatgccccattcccgccacaaagggcgcgaaagttctgacgataggcacaaatcgcgccaggataatcgtcttgccaccgtgcttatcgtaaaacgcatgggttttatcaagatagctgcgacggaagatttttgagttcggattgctgaacagcttttcgccgaacagccgtccaatggtgtagttcaccgcatcgccaaggatagcggccacaatcatcagcgtcaccatcaggtgcacgtttagatcgttcgtcggcagagcggagagcgcccctgcgacaaacagcagcgaatcacccggtaaaaacggcgtcactaccagtcctgtttcgcaaaacaggatcaggaacaggatggcgtaaatccagacgccgtactgcgcgaccagctcagccaggtgcacatcaatgtgtaaaataaaatcaatgagaaaataaatgaggtccatgtcttacgcctttgtctgaatgcatttagtccgctaaaaacagcggacccattggcgggcgcggcagatcgaagcggtcgggataatccaccgccaccagatacaacccttccgctttcgccgttgctgccgcgagcgttctgtccttcgccgccagcagttctgctatccagctctccggctggttgttggcgcctacttccatcaggctgccgacaatattcctgaccatatgatgtacaaaggcattggctttgatatcgaccaccacatatgcaccgtaacgcgccacgttaatgtgcatcacgtttcgccacggcgtgcgcgactggcactgaaccgcccgaaacgaggtaaagtcattttcccctatcagcgcctgggccgcacgatgcatccgatcggcatccagaggatgatagtagtgagtgacgccgcgccccagcacggcagggcgcaaacgatgattgtagatgacgtagcggtaacggcgagccgtggcgctaaaacgtgcatgaaaatcatcgggcacattttttacccagcgcaccgcgatgtcaccaggtaaattcgcatttacgcccagcgtccaggccgcatctttgcgctgtacgctggtttcgaaatgcaccacctgcccggtgccgtgcaccccggcgtcagtacgcccggcgcaaaacaccgtgatcggctcatccgccactttcgagagcgcggtttccagcttttcctgtacgctgcgtacttcgttctgccgctgccagccgtaatacttactgccgtcgtactcaatgccgagcgcaatcttgctgacgggctttgcctgcgcgtcggacattagtacatgtactcctgcaccagcttctcggcgattttcaccgccatcagcgcgccgccaaaacggacgttatcggccaccgaccagaactggatctgctccggcatgccgtaatcgttatgcacacagcccacggaaagctgcggattgccggaagcgtcgcccacctgggtcgggaagtcgttagccggggacagcgcaatatcttcgccgcgctcgaaggcatcgcgggcttcttccgccgccagcggacgcagcccttcaaagctgaccatctgcgccagaccgtagaataccggcgaacgtacacagttaacggagatcatcaggccatcgtcctggaggattttacgcacctgatccaccaccacacgggcttcacgcacgctgccctggctgtccggcagcatcggcagcatgttgaacgccagctggcggccaaagaaatcgtcctcatcaacgggaatgccgttgagcagttttgcgctctgccctgccagcgcatccacggcgactttgccctgggaggacgcagacagcaggctggtcacggcgatacgcgacaggccgccttcatcgatcagcggcttaagggcggtcagcagctggctggtgaggctgtccgccaccgccacgatattacggttacggtaatctgccagcacgaacggattgacgtccgggaccaccagcggcacgtccggctccattgcgaacagaccgctggcgtcgatcaccagacaaccggagttggtggcttcctcaatgtaacgggctgaggcttcaggcccggccacgaagaacgccagctgcgcctgcgtccagtcgaattcttcggcatcggtcacgtagaccgttttgctgttatagcgcagggccttaccggcgctttcactgcgcgccagggcgaaaatctcgcctgtggggaattcgcgctctgcaagagtttcgagaagcgcttcgcctacggcgccggtggcgcccaggatggcaatattccagccttcagacatggtggtttactccagacaatagcaatacgctcccctgcccgcaggcgggagagcgacagaaaatgagttagcgtgtcgggtgatgaacggcgttaaagccgagctgttgcagtaaggtcgcggcctgtgcgtcatcacactggatgtacagcgaagaccactcgcgacgctcaagataatttttgcgcagcttgtcaaattcacccggaatgcccgccacttttcgcagtggcgcatcatcgcggcgcacatcatacactaaatgcaccagtcgtttcagcgttggctcatcaagcgggccgtgcagcgtgatgcgaccgaattccggggcgggcagcagggtatccagcgccacctgctgacgcttgccgagaaattcgctgtaggcctcaaacacctgggtggtgccgcgcgctttgccttccagcgtgtaacccgcgatatgggcggtgccgatgtccactttatcgagcagcgcgacgttgagatccggctccggctcccagacatccagcaccacgctgagatcctgaccggcgttcagccgcgccagcagcgcggtgttatccaccaccggtccgcgacaggcgttgattaaaatggtgccgggtttaagtctggcgatcagcgcctcatcggcaaggtgcagcgttttgtacgggccgtctttgaacagcggcgtgtggaaggtaaggatatcggcttcctgcaccagctcgtccagcgaacggaaatcgccctcctcgccacggtcggcgcgcggcggatcgcacaataaggtgcgcacgcccagcgcctccagccgcgcctgcaaacgcgagccgacgttgcccacgcccacaatgccgacggtgcgatcgcgcaggctaaaaccatcgcgctcgcccagcatcagcagcgccgaaaagacatattccaccaccgcgatggcgttgcagcccggcgcggcagaaaagccaatgcccgcctgcgcaagccaggcgtcatcgacatgatcggtaccggccgtggcggtgccgacaaactggatcgcggttccgctgagcagggatgcattgaccttcgtcaccgagcgcaccatcagggcatcggcatcgttcagttccgccaccggtatcgggcggcctgggacaggtttcacctcacccagacgactgaacaaatcacgggcataaggcatattttcatcaacgagaattttcacgttccggtacctgtatgataacgagagataagcgtgcaagtgtgccataatctcgccgccaggcataccgagaatgccgaccaccgttacgaggattttgaatgatgcaacccatccagggtgtgccggtgcgccctccggggcaagacccaactccacccgccagtgctgcgggcgaacaaccgctctcctcgcaacagcgcaccgtgctggagcgcctgatcacgcgcctgatctctttaacgcaccaacagggcgcggaagtatgggcaggagtgaagcacgatctgggcttaaaaaatgataccccgctgctgtcgaaacactttccggcagcggaacagagcctgaatcagcgtctggagaatgccagccagcagcacgctaaccgccaggtcctttcccggctgacagagctgttaggccagggcaacaaccgtcaggcggtgagcgactttatccgccagcagttcggccagacggcgttaagccagctgtcgccggatcagctgaaaacggtgctggtgatgctgcaaaaaggcgagctgaatattccgcagcctcagcagcgccctgctaccgacaggccgctggtgcccgccgagcacaatgccctgaatcaggcggtgactaagctggcggccgcgaccggcgagtcaggcaaacagatctggcagtcgatgctggagctgtccggcgtgaagaccggcgagcttattccggcgaaacattttgcgccgctgatgacctggcttcaggcgcgtcagaccctcagcctgcaacccgcgccgacgctgcataccatgcaggccgcgctcaagcagccgatggacagcaacgaatggcagcatattcaggattatgcccagcagacgttccagctcacgccgcaaagtgtgctgaccaatgcccaggtgcaggatctgcttaattttgtcttcctgcgtcgtaccgagcgcgcgcaggaaacgctggaagtgcgcgatatacagccgatttacagcccgctgttcgcgccggtgatggaaacggtgaaaaccctttcagcccgcccgggcctgatgtttgttgccctgatggtggcattgttgctggtgtggatcgtcatttaacgacaccgccgggtagatttccctacccggcgttctgtttagcgcttacacattctcgccattactttttataacgtcgcgataccagtcgaaggatttcttcttactgcgcgccagcgtgcccttgccctcgttatctttatcgacataaataaaaccgtagcgctttttcatctcgccggtaccggcagagaccagatcgatacagccccacggggtataacccatcagatccacaccgtcctccaccaccgcttttttcatttcgcggatatggttttcaagatactcgatgcggtaccgatcgtttaccgtgccgtcaggctctttttcgtcgatcgcgccaaaaccgttctcgacaataaacagcggcagctgatacatatcgtagaaccagttcagcgaataacgtaagccaaccggatcgatttgccagccccagtccgacgctttgacatacggatttttcaccaggcttttggtttcgtcataatcgagctgcggattatcgtccgtcgctttggtggcaaaagacatgtaatagctaaagccaatataatccacacagccgcgggtcaggatctggcgatcctcatcggtaatgtccaggttaaaggctttctgctcgaagtaatttaaaatgtgctgcgggtaatagccgcgcacatggacgtcggtaaaccagtagcggcgatgcatagcgcgaaccgacatcatcatgtcgttcggatcgcagcttaacggataaatcgggcacatggcgatcatgcagccgatctgaaactgcgggttaatggcgtggcccgcttccaccgccagggcgctggctaccagctcataatgcgccgcctgatacatgattttttcgcgatcttcaccgggcttataatgcaggccggagttagtgaagggggcaaaatcttcgtggaaattggcctggttatttatttcgttgaaggtcatccagaatttcactttattctggtagcgggtgaataccgctctggcgaagcggacaaagaattcgatcacctgacgattgcgccagccgccgtattcggtcaccagataatagggcatttcaaaatgcgagagggtgatcaccggttcgatattatatttcaggcactcatcaaacagatcatcatagaattgcagcccggcttcatttggctccagctcatcccctttcggaaaaatacgtgtccaggcaattgaggtgcggaagcatttgaatcccatctccgcaaacagcttaatgtcttctttatagcgatggtaaaaatcgatgccttcgtggttgggataatatttgccttcgatcaccccttcggtgatctcacgcggcacgccatgacggcctgccgtcatcacatccgccacgctgacgccctttcctccttcgcgccagcccccttccagttgatgcgccgcgaccgcgccgccccagagaaaatccgctttaaatcctggcatgcttacccccttttccgttgataacgcaaagagaataacaacgacgcggcagctttaccggatcgacatcacattattggccaaggctcagaaatgaaaaaaggagccatcaggctcctttcagattcttgccgggcggcggctgcgccgccgggcatgttaattacgcgtcaaatttacgcatcaccagcgtggcgttggtgccgccgaaaccgaagctgttggacattacggttttcagttcgcgctcggtggttttggtcacgatgttcaggccttctgcctgcggatccatttcttcaatgttaatgcttggggcgacgaaaccgtgctccagcatcagcagggaatagatggcttcctgaacgccagccgcgcccagcgagtgaccggtcatggctttggtggcggaaatcgccggggagttatcgccgaagacttcgcggatcgcgcccagctctttcacatcgccaaccggcgtcgaggtgccgtgagagttcaggtaatcgatcggcgtatccacgccgtgcatcgccatcttcatgcagcgcactgcgccttcgcctgacggggcaaccatgtctgcgccatcggacgttgcgccgtaaccgacgatttcagcatagatgtgcgcgccgcgcgccagcgcatgctcaagctcttcaaccaccaccataccgccgccgcctgcgatcacgaaaccatcgcggtttgcatcataggtacgggacgctttggacgggtcgtcgttgtatttggtggacagcgcgcccatcgcatcaaattcacaggccatttcccagcccagctcttcgccgccgccagcaaacacgatgtcctgtttgcccaactggatctgctcaacggcgttgccgatgcagtgtgcggaggtcgcacaggcggagctgatggagtagttaacgccgtggattttgaacggcgtggcgaggcaggcggaaaccgcagaggccatcgctttagtcaccacatacgggccaacagctttcagaccgcgcgggctacgcatggcatcagcgccgaacacctgcgctttggacgagccgccggaaccggcaacgatacccacgcgtgggttgttctggtacatctcttcagtcagaccggcgtcctgcactgcctgctgcatagacaggtaggcataaacagaggcatcgttcatgaaacggaccactttgcgatcgatcatgccggtggtgtcgagttttacgttaccccatacatggctacgcatgccagcatcaagaaattcttgagagaaagtgatccctgagcgtccttcacgcagagatgccaggacttcctgctggttgttaccgatgctggaaacgatgcccaggccagtaatcactgcacgtttcattcaatacccctgtaagtcgaacaattttaatattcgagtggcaagatagcgtacacttgtacgccgaacaagtccgatcagcgaatttatgcagaaatttgcaccaactgacactcctcgttaagatcgtgacactgcccgccacacgagtaacttacgtgaaacaaaccgttatacaacctgccaacctcgaatttaacgctgagggtacacctgtttcccgagattttgatgacgtctacttttccaacgataacgggctggaagaaacgcgttacgtctttctcggcggcaatcagttgcccgcgcgttttcgcccccatccccgcgatttgatggtggtggcggagagcggttttggcaccggcctgaatttcctgacgctgtggcaggcgtttgacgccttcaccgcggcgcacccccatactggcgtacaaagattacattttatcagttttgaaaaattccctctgcgcgccgacgacctgcaaaaggcgcatcagcgctggccggaactggccccctgggcggaacagttacaggcgcagtggccgctgccttttgaaggctgtcaccgtttattgcttgatggcggacgggtgacgctggatctgtggtttggcgatattactaccctgaccgacgcgctggacgattcgctggatcaaaaagtggatgcctggtttctggatggttttgcgcctgctaaaaacccggatatgtggactccggcgctgtttaacgccatggcgcggctggcgcgcccggactgcacgctggcgaccttcacctccgccggttttgtgcgtcgcgggctacaggacgccggttttaccatgcaaaaatgcaaagggtttggccgtaaacgtgaaatgctcaccggcgtgatgacgcagacccgtgagcctgccccgcgcgcgccctggtttgcgcgcagcggcgcatccggccgtgaagtggcgcttatcggtggcggggtggccagcgcgctgttatccctctccctgctgcgccggggctggcaggtgaccctttactgcgccgatgccgcccctgcgcttggcgcgtccggtaatcgccagggggcgctctatccgctgctgaatgcccacgatccggcgctggcgcgcttcttccccgccgccttcacttttgcccgcagactgtatgacacgctgccggtagcgttcgatcatgactggtgcggcgtgacgcagaccggctgggatgaaaagagccagcataaaatcgatcagatgttatctctggcgctgccgcaggagatcgccgcggcagccgatggagcgtgtattgaagcaacgaccggcgttgataccggctgcggcggtattcagtatccgctcggcggctggctgtgtccggcccagctaacggcggcggccattgagctgggcgttactcagggcctgaaagtgcattatcagcgggacgttgccgaactgacgcagggggaaagtggctggcagctgcgttttgctgatggcgctcaggccgcccatgcggtggtggtgctggcgaacgggcaccggctgggggatttcacccagaccgaggcgttgccggtctatccggtggcgggccaggtcagtcatattcccaccacgccggggctgtcgcctttacgtcaggtactgtgttacgacggttatctgacgccgcaaaatccgctgaatcagcagcattgcatcggcgcaagctatcatcgtggcgatcgggaaacggcgtatcgcgaggacgatcagcagcataatcgccagcgcttgctggactgttttccggatgccgcctgggcgaaagaggtggatgtaacggctaaggaggcgcgcaacggcgtgcgctgcgccacccgcgatcatctgccggtggtcggcaacgcacctgattttgcggcgacgttacgggaatatgcgaccctggcggaacacccggcgcaggcggtcagcgcaccggtgtgggaagatttgtatctgctgggggcgctgggttcgcggggattgtgcagcgcgccgctggcggcggagatcctcgccgcgcagatgagcgacgagccgatcccgctggatagcgaaacgctggcggcgctgaacccaaaccgcttctgggtacggaaattgttaaaaggcaaagcggtgataacgccccacggggcgggccggtaaacctgcacgtatcgcccggcggcgcaggcttgccgggcctacatacctgttgtaggccgggtaagcgccagcgccacccggcaaaacagcgggcacggtgccaaatatatcgcccggcggcgcaggcttgccgggcctacatggctgttgtaggccgggtaagcgacagcgccacccggcatatcacgcaaacacccctgccgcgacctgttccggcgttaccacgcccgtatccagcacccagccgctgatcaacgccgccggggtcacatcaaacgccgggttgtacacccgtactttttctggcgcccattgcaccgcgccaaagctgcccgccacgcctgtcacttcctctgccgcccgctgttcaatggggatggcgtcgccatccggacagccacaatccagtgtagtgtgaggcgcggcaacgtaaaacggaataccgtggaatttcgccagcaccgccagcgaataggtgccgatcttgttcgccacatcgccattggcggcaatgcgatctgccccgacccacaccgcgtccacctgccctttcgccatcaggctggcggccattgaatcggtgatcaactggcagggcacacccagttcgcccatttcccaggccgttaaacgcccgccctgcaacagcgggcgcgtctcacccacccagacattcgccacccgcccctgctcatgggcgcgggcaatcacgccgatagctgtcccgacgcccgccgttgccagcccgccggtattgcagtgggtcagcaggcgacttcccggcgttaccagcgcgcttccggcgcgggcgatggcgtcacacaactgcttgtcttcatcgatcaggcgcagcgcctccgccaccagcgccggaacataattctcccgcgccagcgccgctttcatgcgatcaagattattcatcaggttcaccgccgtcgggcgtgccgcgcgcagcgtcgccagcgattcagccagttcatcccgcgtcagcccctgctctgcctgtaacgccagcagcaggctggcggaaaggccaatcagcggcgcgccgcgcacgcgcagggcgtggatatgccccaccagttgttctgtggtgctggccgcaagccagtttttctgctgcggcagcgcctgctggtcgaggataaaaagctgattttcgctgacgcgcagactggtggtctgtaatggctgcatatcgttaaatccctgttgcgttgttgtgacctattgtgtcaggatgacttccggaagtatagacgtctgaatggctttattaacataagaatgaggatcagggcaatgtcggaataccgcaccttcaacgcgcaggacgctgtcgcttatgcacaacaatttggcggtctggccgatccgtccgaactggtggatgcgcaggaggtcggcgacggcaatctcaatctggtgtttaaaatttttgaccgtcagggcgtcagccgggtgattgttaaacaggcgctgccctatgtgcgctgcgtgggggaatcctggccgctgacgctggatcgcgcgcggctggaagcgcagaccctggtggaacattatcagcactgtccacagcacacggtgcagatcctgcattttgacccgcagctggcggtgatggtgatggaagatctctccagtcatcgcatctggcgcggcgagctgattaataacgtcagctatccgcaggcgccgcaacagctgggggaatatctggcgtatacgctgttccacaccagcgatttttatctgcatccccatgagaaaaaagcgcaggtggcgcgctttatcaacccggaaatgtgcgagatcactgaagatctgttcttcaacgacccttaccagatccacgagcgcaataattatcccgccgaactggaagcggacgtcgccgccctgcgtgacgacgcccagcttaaactggcggtggcggcgctgaagcaccacttcttctcccacgccgaagcgctgctgcacggcgatattcacagcgggtcgattttcgtcgccgacggcagcctgaaagctatcgacgccgaatttggtttctttggtccggtgggctttgatatcggcaccgccatcggcaacctgttgctgaactactgcggcctgccggggcatctgggtattcgcgatgctgcggctgcccgtgagcagcgcctcgccgatattcagcagctatggcatacctttgccgagcgtttccagcaactggctacggaaaaaacccgcgacgcggcgctggcgacgccgggctatgcctcgcagttcctgaaaaaagtgtggactgatgcggtgggctactgcgggacagaactgatccgccgcagcgtcggcttgtcccacgtcgccgatctggataccatccgcgacgaggagatgcgccacgcctgtctgcgtcatgccattgagctgggtaaatccctgatcctggtcgccggacgtatcgacagcgcagaggagttaattgcgcgggtgcgccagtacagctgaaccgcgccacggcgcttacggaatgcgggcaatgactttaatttcaaaatcgaagcccgccagccagttgacgcccaccgccgtccagttgggatagggagcctgcgggaaaatctcctgcttcaccgccataatggtggcaaactggttttccggatcggtgtgaaaggtcgtcacatcaaccaaatcatcgaacccgcatccggcagcggccagcgtagcccgcaggttagcaaaggccagccggacctgggcggcaaagtccggctccggcgacccgtcttcccggctgcccacctgcccggacacaaacaataaatccccggagcggatcgccgcggagtagccatgctgctcatataaagcatgccgattggccgggaatatcgcttcgcgttctgtcatcactcacctcttttattcagtcagaaaatccgggcgtcacgcgccaggatcatttaacatacacgctgtatgtgaaaccgagtatctttgcatacgccgcgtatgtcaatttaaaatacgcgacgtatatgaaatgaaggagtgaagaatatggccgtcggtcgtcgtgcagaaatgatggaagagaaccgcaacaaactgattgccgccgcgcgtaaggcttttgcggaaaaaggctttgccgcggcgtcaatggatgaactcaccgccagcgccgggctgacccgtggcgcgctgtaccataattttggcgataagcgcggcctgctcgccgccgtggtggcgcaggtggacggggaaatggcgcagcaggcgaaagatcgcgccagccttgcgccggaaggctgggagcggctgcttgctgaaggcacggcttatattgaaatggcgctcgatccggaagtgcagcgcattgtgctgctcgacggcccggcttttctcggcgatccgtctggctggcccagtcagaatgcctgtctggaagccacctgtgaggcggttgcagagatgatcggccagggcattatgaaagcggtggacgttgaagcggctgcccgcctgctgaacggggcggcgatgaatgcggcgctgtgggtggcggcggcagatgcgccggatgagcgcttgcctaaagcaacgcaggccttcgtgctgttagcggaaggcctgcgtcggtagtgcgattgctggttagttaacggtcagggtggtggttacctcgtaatccagcgcccatgaggtgtgccagtccttaccggcaaaggtcactacgccgcgataaacgccagctggcaggccggggttgtcgctgtgctcatagtgcaacgatgccgcgtagccagtgtactgccatccgtcacaacccgccgctgagttgaaggtgcggtttgaacagttagaatggcgttgtccccggatgtttacattccatgtctggcccatttcatcagtcattggcacagtaagttgcgaataaccattctctgcccagaccagatcacgtggcccctgggtttcgccgatagcgacaaaaccgaggtcaccgaaaccaaatactccatccgttttataagtgctgctatcgtcgctgatctcccagtctgcctcatacttcgcaatgaatatgatttcctgactgaccttgctgctgccgttgatcgaagcggtcaccgtcgctgtacccgcttccggccccgacagctcagctttcgcgatgccgctattattggtgttgctggctggagctgagaggttattcaaggtggtttcccagctcacttccgcgtgcggtaccgcattgtcatgggcgtcaaccacagtagccatcagttccaccctggtggtgttaacgatagcggtggtggtactgacgttcagtgcgacgattttcgcggtttttaaatcaccgacaaaggcgacggcactggctttacgctcttttgccgggctggtcagcgctgcggtcaccacaacattacccgctttcagcgtggtgccgctggtggtcacttcaccgttgctgttggtggtggcgttttccggcgttagtgtcacatcactgcgatccgccttccagtttaccgtcacgtccggtagcaggttgtggtttttatcctccactatcgccttccaggtgatagcctcagagccatccgccacggcctcagttttatccgccacgacatcggcgaactgcgccgtttcaacgttgccaatcaccgtcagcgtcagcgtcttgtcaccgtgggtatgcgaggcggtgacatcgacactgcccgctttcagggttttaaaggtggctgttgcctggccgttggcatcggtcaccgacgtcgctggcgtgaaggtgctgttagcgtcgtcgctgctgagccagttcaccgtttcgcccgccaccggatgctggttagcgtccagcaacgtcgccgtcagcgtcaccacatctttatccgccacaatgtcagcggtcttatccgccgtcaggctggtaatctttgccgtggcgctatcggcggtgaatctcaggctgctgatggagtcgctgttgccattgaccgtcgccctgacttcatagctggcgacaacggctgatttcagcgtcacctgcgccacgcctgcggcattgctggtgctggtgctcgctgacagcattccgctttctggcgccacttcccaggtcacatccgttgcgtctaacgggttggcgttggcatccgtgaccgtggcgctgagggtgatcacatctttatcgttcgccagcgcggtagttttgtcgctgctgacggccacgactttcgccgtcgtcttatccgcgataaaggttgcgctgttcgcctgcattgccgtttccgggctggtctgggcggtaatgactttctcaccggctttcagtgacgttacggtaatggtcgatttgccgttgccgtcgctggtggtctgtgtgctactcagaatggcatcggaggtgtctgcggaccagctcaccgtcgcgccattcaccgcgttgccctgctggtcggtcaccgtcgcttcataggtaatgcgatccgtaccgtcggcgatggcctcggttttatcgagggcgatcgtggtgactttctgggtactgctgtcggcgataaaagtaatgtcttcggtccgtaacggcgtgccgccgttgatagccgccgagacgctgaccgatccggttttcgcagatttcagcacggtcgtcgccacgccctgcgcatccgtctgcgaggtgcggttgccgagggtagtgccgtcggttttatccaccttccaggtgacgctgatgcccgataacggatgattattcgcatcggtgactttcgccgtcagcttagcgctgtcgatgttattcgccaccacctggtttttgtcgggctccactgataccagtttcgccgaggccgggtccgccacaaagttcagcgtctcgctgcgcagggcttccgcctgaccacgctgggcagtgatcaccgtagcgataacatccgcgctggtcaccaggatctgcgcctcgccctgggtattggtgacggattgcgtgtcagagagctgtgccttgatgttatccgccgtccagttgatcgtctccccggataccggatgcccgctgttatcgataaccttcgcggtcagcgtgatagccgtattgttgtctgccagagcctccgttgacgatgccgtcagcgtattaaggtgcgccgtgccgctgtcgacaataaagtacaatcctgccagggtttcgctgctgctgccgctggatgccgtcacgctgtactgcgccacgtcccgcgagctgagtgtcacccgcgccacgccggaggcatcggttttactgctgctggcggagagcgtgccggttgccgggtctaccgtccagttaacgtctgcattgttcaccaggttgccgttcgcatcctcgaccgtggcggtcaggctgatggcatcgctgccgtttgccagcgcagaggcgcgatcgcttttcagcgttttgatggtcgcggtggcgctgtcggcgataaaggtcgcaggctccgcctgtagcggcgtggcttcgctggtcttcgcagtgaccacgaccttgcccgctttcagagaggtcacggtgatggtcgatttaccgtccgcgccgctggtggtgttgctggcgcttaatgtagcatccggattatccgctgaccacgccacgcgggcagcgttgatggcgttcccctgggcatccgtcacctgcgcttcataggtaatactgtccgtgccgttcgccagcgcctgggttttactgagcgtcagggtggtcactttttgcgtgctggtgtccgccacaaagacgatcggatcggtttcctgtacggcgtcgcggttcaccgccgccaataccgtcactgtgccggttttcggggatttcagttcaagcgtggcgatgccgtcgttgtcagagaccgacgttttactgctgaccggcgtaccgtcgcgctttttcaccatccagttgacggtgatacccgccagcggatggttgttctgatccttcacctgcgcggtgacggtgtcggtgtcgatattgttggcgaccacctgctgtttttcactctcaatggcaaccacctgcgcgctggcaacatcggcggtaaagttcagcgcagcggtgctgacgctgttgccctgctccagttgcgcggtgacgacggtactgatgacttcacgactggtgacgtcgatcgtcgccagaccttgtgcatcagtggtggtgctgtcggtggaaagcagcgctttcgggttgtcggcgcgccatttaatggctgcatcttgtatcggtttgccatactgatccaccacgtgcgcggtcagcgcgataggcgtggtgccgtcagccggaacactgctggcggagacgtcaatctgcgttagcttcggcagaatttccgtggcttcgaggatgagttttgccgtcgccagtttggtgctgccgtcaatcagcggttgcacggtaacgctgcccggcgtggtgccgctggtgaaggtggcgacatagacgccggacgaggtttctttaaaggcgctgatggccgccgctttgctgtcgctggcaaggcctttcgcgacgctggccggagcggtaagggtcgcactcaggcgttccgcaaatccaccggcattttctcctgctgcggttttcagtgtcacggttaccgccgaggtgctgatgccatcggctggcagcgtgacgggcgaggcgctggtcgtggacaccaggcttgccacatcaatgccgctgacgttcaccttcatctggctagtgtttgaagcattgccctttttatcccgcgcgacggcggaaagcacatacgtattggcgctgccgtttttccacgccgggaaggtcagcaccacctgctcggggctggaagtatcggcgattttcccgccctggcggaagaattcatccccctgccagtcgattttttcaaggccgtatttggttttgaccttcgccgtcaccgtctgcttttcgccttccgcgccggtgagttcgggcggcaggcccagcgaaatcagatcctgcttgcgatactccagcacgatattattgttgcgatccactaaatccatgcggctgccgagcagcgagcggcgcagggcgacctggtccggatcgagctgggtgctgagcggcacgccaggggtccaggagacgcccagattcacctgggtgtcatttttaccgcccttaccgaatttctggttaacacccagcgtcatcattggcaccggggtgtaattcagcccgaaggtaatagcatgcgggtttttctgccggtcgtcttcgtcgtcgctgaacaggccgacgctgtcgccataatattgttcgtagaccagcgtggtgcccagctgcggccaggcgggtaaataaccattggcgcgaatgtcaaagccgttggcgacccgctcgtcatagtcgctgtattcttttgatgccatccagtcgctgagtcggaaatagccgttggcggaaagtttcaggtaatcccagcccatttccgtcccgacgccgaggcgtttatggtgattagcggaaatctgctcatcgtagaaaacgttggtgccccacatccagctatcgctgaaataacgatagccaagaccggcgtttaccatatttcgctcatcgtaccgacgtccacccaactgggtaaaccagaggtgttcttttccgtcatataacggcagcagcagatccagttcagaatcctggagggtaaaatgttcgtcggtgctgatgctgacgcgggcggtaccaaactgattaagccagttttgcacttcggccgtcgcggcgctggtcgcagtggagacaatagcctcgtcgagcgccccgccattaccgccgtttaagactgaccccgcctgcatggcagtctgggcgatggcctgttcgttgctggtatccggaggctgagatttaatcactctttcctgcgcctggctggtcgagaatgttcccagataacagagcgaggtcggtgagataaactggagcgcgatttgcacccatgccagtgcttttttcattcgcatgataattaagttccctttaagtaacacaccagcggggaactatatatagaatgaaaggtctttttaatattttataagtggcgctgcattattgcatctataaagcaataatcaatagtaatttaaaaaaacgaattcactcatgggcaagaaggccttccttaatttaataaggaaggccttaaatttatcagaaaataccaatgaaaaatataatcggggtgtatatcagtaatccccaattattttgaaagaagttatttcataatgaattattatcgtctaacccaggtattcaatcacggagagtccgccattatagtctgttgcataaatgatccccgccgcatcgacaaagacatcacaggactggatcacctgcgggcgtccgggacgggtgtccatcatggtagtcggtgcggcaggcaccagcgcgccggtttccaccggacggtacggatctgatatgtcataggcacgcacgccagcattctgataagtggcaaagatcagcgttgagctgacaaaactgccaggccggttttcatgcaggttatgcggcccgaagtgcgcgcccttcgccacgtagtcagtttcattcggctgcgggaaagtggcgatgctcaccgggtttgacggctcgcgaatatcaaacagccagatcagcttctcgccatcttcctgattgtcgagcaccgcttcatccagcaccaccagcagatctctgtccggtaacggcagcgcggtatgcgtgccgccgccaaagggcgggctccagttgcggtggctgatgagcgttggccggttgcgatctttcacgtccagcagcgtcagcccgccgtcgcgccagctgccataggcggtatcgccggcaataatggcgtgatgcagcgcatagcgtttaccttccggccaatgcggagtttcgcccgccgcctgatgcatcccaggtaaccaccagcgcccggccacctctggtttgcgcggatccgccagatcgatagtcaggaaaatataatcggtgaagccgtcgatcagcgccgagacgtaagcccagcgtccgccgacgtaccagatacggtgaatgccaatgccgttcagcgacaggaagctgatttcacgcggtttgtcgggtgtggaaatatcaaaaatgcgcagcccggcgctccagtctttgtcctgcacatcgcgcaccgtctcgcctaccggacggctgtaatagaccttttcatcggcaaaacgcgcgtcggcgaacagatcccgggcgttgatcaccagcagcaaatcgtcgtgcgcctgtaaatgaacgttccaggtgcccggcggcgcaggtatgtagcctgcgggtttcgggttggcaggattgcgcacgtccacaatggaaaagccctgcgacaccatatggccgatatacgcatagccgcgatgcaccatcagctgcaccccgtccggtcgaccgccctgatcgctgtggccaatgaggcgcatattgcggctgtagtcgggagtgggtaaatgagaagccacgttgtttccttgttacgatgttgccatttcgccgggcggcgctgcgcttgcaccggcctacatgatgtaggtcatgggattttgtaggcccggtaagcgcgagcgccaccgggcaacattatttctgcttcgcttccagcgtcgcaaaccacggcgcgataaagtcttccgtctggccccagcccggaataattttgcccagcgccgcgacgttaacattgcctggctgactcgccagcagcgcctgcggaatggcggcggctttaaagtcataggtggcaggcgttttctcaccggcgatcttattggcgatcagccgcacgttggtggcgccaatcagcttcggatccaccgccacgctcactttccacgggctgcccgcctcacgcatcagctgtaaatcctgattggagatgtcgatgctgtagagtttgatctcggtacggccattctctttcagcgctttatatgcgccctggctgaaggcatcccaggtgccccagatggcgtcgatctgccctttcgggtatttcgccagcaccgcgcccactttgttggcggtatccccctgtacgtccgacgacaccgcgccaatggattccagctctttgatgcccggatgctgcttcagcagttcctgataggccgcctggcgacgctccatcggcgggaaaccggcgacccacagtttgatgatgttcgccttgccgttgaaatctttcaccagctcgccaaacgacagatccgtcagggaggcgtcatcctgctgggtaacggtcacgcccgggatctccccttttaccgccgtatcaaataccgacaccgcaatgcctgcgtccaccgctttcttcaccagctcagtggaataaggatcgcgcccctgggaaagaataatgccgtcgtatttctggctgatggcctgattgacgaaatcctggaacttcgcgtcatcgccgttacttaaaaaggtgctgattttaaagccgagctttttgccttccgtcagcgccccggagacaaactgcgtcgtgttatcgtcggaaccaaggttacgaataaccgcaatacggatcgggccgtcgtgattggcgatggcggccggaaccggcgcaggcgtggcggcataacccggtactgaactcagtaagcccagcgccagcagtgacagtgcaaattttttcatctctgtttcccctgaataataaattaacggcgctggaaataagtgagtgcaagagcgccggccagcaccagccccttaataatgtccatggcgtaatagggcactgacagcatcaccagcccgttcgacagcacgccgaggatgaccgcgccaaccagcgtaccgagcgcattgggtttaccggagcccgcgagcgaaaagccgatccacgccgccgccaccgcatccatcagataaccgccccccgcgttcacctgcgaggagccgatgcgcgaggccagtaaaatcccgcccagcccggccagcagcgaggcaatcacataggccgccactttgtagcgcgtggtgcgaataccggacaggcgcgccgcttccgggttgccgccgatggcgtacatacggcgaccgtgcgttgtcagcgacagcgcaagctgcgccagcaccgtgaccaccagcatgatgatgacgatcaccggcacctggccgagcagcgcaaaaccctccgggatcagcccttccgccatttcgccgctcggcagcagcatgttttgcgtgatcgagccgccgtagctgtacgtcatcgccacaccctgaataacgaacaggctgccgagcgtggcgagcatgtcaggaatacgcagcacgacgatgagaaaggcgttgaacagccccaccagcgtacagagcgccagcgtcaccagaatggcttccgtggtgccaaatccgtgccagacaaacagcgaaatcaccagcgcgtttgccagcgacgccgtcgatcctaccgacaggtcaaaaccgcccacggtgagggaaatggacacgccgatggcgatcaccgtgacaatggcaatggagcgcagaatattgatgatgttgaacggatcgaggaagttatccgaggcgaggccaaacacggcgatcagcaccaccacggtcagcaacatgccccatttataaagaaaatcgaaaaactgctgacggcccgatgccgtcgcattcactgaaagggccttgctcacgacgccgtacctccggtcgaataataaagtaatgtctcttcacgggcgtccgccccggcgatctccgccacgattttgccgtcccacaacacgcagatgcggtcgcacagtcccaccagctcggcgaactcgccggaagcgtagatcacgcccttcccttcccgcgccaggccgtcgataagctgaaacagatcggttttagctttcacgtccacgcctttggtcggctcatcaaaaatcagtacgttcgcgttaccgcgcagccatttgccaatcgccactttctgctgattgccgccggaaagccgccgcagcagttgcgctggtccggtggtgcgcacgccggtgcgggcgatcacctcctgcgcccagcgccaggccttgcgatggctgaagatcccgccccgggagaagctgttgtctgcgctgaccgccagattcatgctcaccgattcgtcaatgaaaatgccctctttgcggcgctcctccggcaccagcgcgatgccgcgcagtacagagtccgccggatcgcgcggtttccacggctggctgttaagctccccgcgggtgatacggcttttgctggcgccgaaaagcgccttgcacagctcggttttgcctgcgcccgccagcccggcaatgcctaaaatctcgcccttgcgcagctgcagggagatgtcttttaacaggccttcatcgtgcagcccctccacccgcagcaaggtctcgtcgctgtggcgggcgcgtttcggcgggtaaatatcgctcagctcatgacccagcatcttctcgacgatctcctcgccgcgcagattgtccattggcccggattcgatcagcctgccgtcccgcagcaccgttaaggtgtcgcagatggctttcagttcatggatgcggtgcgagataaacaccaaggcgatcccctgctgttgcaggcgtttgaccaccgcaaacagccgctcgctttcgtgctgatcgaggggggctgtgggttcatcgaggatcaaaaaacggcagcggtgcgacagggcgcgcgccagcaaaatttgctgtttttcggccagcgtgcagctgtcaatcgggcgtcgcacgtccagagttacatccagctgcgccagcgcagcacgcgcctgctgacgcactttcgaccagtgatatgcatggcccggctccgccagccggtcgagcataatgttttccgcaatcgacaggccggggatcagcgccacgtccacttcctgctgcaccagatgaatacccaactgttttgcgtcgcggggcgagcgaatggacaccacctggttattgatggcgatctccccttcgtaatgatcgtgggtgccgcacagcaccgccatcagcgtggatttgcccgcgccgtttgccccggtcagggcatgaaccgagccgccgcgcagggtaaaatcgacctgcgacagcgctctgacaccggcaaaggcgagcgtgatggcgcgcatgtcgagatggttaacgctcattcgctggagatccctgtcattaatagattgatttcatgaatttttcacagcgcggcttgactgacaactacggaaaaggcataagataaagcaaaatattattagccatccggatgtccagacataacatcaggttagcgatcacgcacaaggacacactcatgagcaacaccgatattcgcgtcgtacccggccccgccaactactattcccacgccggcagtctggcgcgcctgcatgatttttatacccccgaacagctttcccgcgcggtctggatctacggcgaacgggccatcgccgccgccacgccgtacctgccggaaagctttcatacgccgggagcaaagcacctgctgtttaaaggccattgcagcgagcgcgatgtcgcggagctggtggcgcagtcgggagaagatcgcagcgtggtgataggcctcggcggcggtgcgctgctggataccgtgaaagcggtggcacgtcgtctggcgctgccggtggtggccattccgaccattgccgccacctgcgcggcctggacgccgctctccgtctggtataacgacgccggacaggcgctgcattttgagattttcgatgacgctaatttccttgtactggtggagccgcagatcattcttgacgccccggcggagtacctgctggcaggcatcggcgataccctggcaaagtggtatgaagcggtggtgctggcccctgaaccggaaagcctgccgctgacggtacggcttggcatcaatggcgcgctggcgatccgcgatgtgctgctggaaagcagtgaagcggcgctggcggatcaggcacggggcgaggtgacgcaggcgtttcgtgatgtggtggacgccatcatcgccggtgggggcatggtgggcggcctgggcgagcgctatacccgcgtggcggcggcgcattcggtgcataacgggctgaccgtgctgccgcaaaccgagaaatacctgcacggcaccaaagtcgcctacggcattctggtgcagagcgccctgctcggccaggacgaggtactggcgcagctcatcgccgcctataaacgtttcaacctgcccaccaccctggcacaactggaggtggatattcacaacgccgccgaactggataaagtgatcgtccacaccctgcgcccggtggaatccatccacgcgctgccggtgccggtgacccccgcctccctgcgtgcggcctttgaaaaagtggaaaacctcagccgctgatcttaacagcagcgcgcgccgcctttgctgccgtagcgcgcgtcctgccgatcgcggaaaaattcttcataggtcatcggcggctgatcggggtggttctggcgcatgtgctcaacgtagttatcgtagtccggcacgccgatcatcagcttcgcggcctggcccaggtattttccggctttagaaagcgtatcgaacatagtgactccgttttgatagtttggcccggcactcttaccagagcgccgggcgttaccgcatcagtgcgcgcttttcgcctgcgtcacaatctgatcgacatttgccggcatcggctcatacggcgtctcattggcagtaggacgatcaacctttattgccgccagcgcggttttaatggagtaaaacgccagtaccaccacaaccaccataaagaagatggtcagcccggcatcgagacggttgttgaacaccagctgacgcagctgtgcggcggtgtactgcgccggaatgttgccgctgtcgatcatgctctggaagcggttggcgatcgccaggaagcccactttcgcatccgggctgaaggccttctgccagcccgccgtcagggtgcagatcagcagccaggcggtcggcagcagcgctacccaggcataacgctgacgcttcattttgaacagcactaccgcgcagagcatcagcgccatccccgccagcatctggttagcgatgccgaacagcggccacagggtattgataccgcccagcggatccaccacgccctggtgcaggaaataaccccatgccagcacgcagagcgccgtcgccagcaggttggcgggcagcgaatcggtacgcttcagccccgggcttatcacccccagcagatcctgcaacataaagcgtgcggcgcgcgttcccgcatccactgccgtgaggataaacagcgcttcaaacaggatggcaaagtgataccagaaggagacgtccatcaggccgccgagcgcgccgtgcagaatgtacgccatccctaccgccagcgtcggtgcgccgcccgcacgggaaataatcgactgctcgcccacttcattagcaatttgcgtgagcgtttccggggtaatactaaagccccagccgctgaccacctgcgccgccgatgcaactacgtcggctgtccccgccggagccagcaccgccatcgggctgttcatcgcgaagtagacgcccggatcgataatacaggccgacaccagcgccatgatcgccacgaacgactccatcagcatgccgccgtaaccgatcagacaggcctggttttcattcgccagcattttcggcgtggtgccggaagcgatcagcgcatggaagccggacaccgcgccacaggcaatggtaataaacaggaacgggaacaggttgcccgtccacaccggcccggtgccgtcgataaatttcgtcagcgcgggcatggtcagggtcgggcgcataatcagaatgccaatcgccagcccgacaatggtgccgattttcaggaaagtggaaaggtaatcgcgcggcgccagcagcagccacaccggcagcaccgccgccacaaagccgtagcccacgaggatccacgtcagttgcacgccggtaaagtcaaagtacggcgcccaggtcggactgtccgccacccagccgccggagatgatagcgaacaccagaaacaccaggccaatcaccgacacttcgccaatacgtcccggacgcagataacggatatagatccccataaagagcgccagcggaatggtaaaggcaacggtgtaagtcccccatggactgtgggtgagggctttcaccacgatcatcgccagcaccgcgaggatgatcaccatgatcataaagcacgccaccagcgcaatcaccccggcggtcggccccatctcctctttcaccagctcgccgagggatcgtccgtcgcggcgcgtggaaacgaacagcaccataaaatcctgcacggcacccgccagcaccacgcctgcgaggatccagatcatccccggcagatagcccatttgcgccgccagcaccggccccaccagcggccctgccccggcaatggccgcaaaatgatgaccgaacagcacttttttatcggtcggcacatagtccagaccgtcgttatgccgcaccgcgggcgtcatacgtgtggcatccaccgccagcaccgtgcgggcgatatactgtccataaaaacgataagcaatcagataaatacagaccgccgccaccacaatccacagggcgttgatctgttcaccacggtttaatgcgatatagcccagggcgaaggcgccaacaacagagagcgcggcccatatgaggtatttccctgaattttgcataatcggtatccgttggctgagacagagagatgttacattttgtatctatatcaacctcctgcttttaacaatgttgaaaccttaaaaacgcctgtcagccccgtctatttacttcacagtgttacggcgatcactctgcgcaggtcgtcaggctgcaacagccgccgcgtttcagatccggcgtaacattccgcccttcccgccagctggtacaacctcggtcgttattctgatttatggctttttagcaattttctataggagtcaacggcttgcttcacggtttttgcccggcccatcacggataatccgttaagtttgtgaggatttatttaatcaaggagaagcaaatggatgtaacaccagacgatcgtaaaccgggtcccgtggcctacttcgcgctggcctttgcagcggtgtttttctcagggctgctgggcggtaaagagtggtacggggtgtttgacttcaccaccctgaacggcgcttttggcaaagtggtgtccggcgtcagccagaacggcgaaacgctgaaaaccaccaccagcgcctttcgcggcgtcggcggtaacggggcgatggacggctttctgttcgcccttgggctgatcccggcggtgatgtttgcgctggggatgattaacgtgctggagcattacggcgcgctgaacgccgcccgccgtctgctcacgccgctgctgcgcccgctgctggggctgcctggcaccaccgggctggcgctaatcggcagcctgcaaagcactgacgtcggggcgtccttaacccgtaatctggcggatgaaggtcagctggatgaaaacgaaaaagacgtgttcgccatgttccagttttccgccggagcgatgatcaccaactttttctcctcaggcgccattctctttacgctcatcgccgccgatggcagcaccgctgtacccacctctatcggcatgtgtatcctggtgatgtttattatgaaaattgtcggcgcgaacctgatgcgcctgtttatccgcttcacgcagaaaaaaagcgccgcgcaaggagctgcacaatgagccacccgacctctaatcccgttattaccgatgtgtttgtcgcaggcgcgcgcaaggggtggaatatcgccaccaccagcacactgcctaacgtggtgatggcgtttatcatcatcaaagcgctggagatcaccggcgcgctgaagggactcgggctgattttctcgccgctgatggggctgttcgggctgccgggggaagcggcggcggtgctgatcggcggctggatgtcgatgggcggcggaattggcgtcgccatcggcttattcgataagggcattatcaccggcgaacatctggcgatcatggccccggccatttacctgatgggatcgcaggtacagtacctcgggcgcattctcggggtgattggcaccagcgcccgccgcattccgctgatgatcgtgatctcggttatcaacgccttcatcgctatgttactgatgcgtatcattatctagaacaggatgtcttatgaatatcgaacactatattgctgaactggaaagcctggtcaacgtcgattgcggcacgcaatgcgtgcagggcgtggcgcaggtcgccgacagactggcggcgctgtggcgtcaggaaggctggcatgtgactaccgttgatctcggcactgcggtagggccgggactgctggtgaccaatcagccgcaggccacccattatgatgtgctgctggtcggccatatggacaccgtgtttccggcgggtacagtcgcccaacgcccgatgagccgcgacgacagccgcctgtacgggcctggcgtctcggacatgaaaagcgggctgctgaatattcttcaggcgatgcgcgaactgcccgccgccgataaacatcgcctgagcattgcggtggcgatgaacccggacgaagagaccggctcggtgcactcggaagcctggctaagcagcctggcaagcaccgcgcgggtggtgctggtatgcgaagcggcgcgcgccgacggttcgctggtgaaagcgcgtaaagggctggccggttatcaactgaccttcagcggcgtcgccgcccatgcgggtaacgatccggaaaaaggccgctccgccatcaccgcgctggcaaatgcggtgatcgccattaatgcgctggcggatatgccgcgcggcaccacgctgaatatcggcgtgatcagcggcggcagcgcgtctaatgtagtggccgaccatgccaccgccgagctggatctgcgctattgggaaaacagcgaatacgatcgcgtccacgcccggctggaagcgctgtgcgctgaaggttttcttgacggtgtgaccaccaccctgacgcgcgtgaactacaaaccggcgatggcggcaagcgagggtaccgccgcgctgatggcgctggtggaacaggcgggtgcggcagaaggcattccggtgacctggcaggcggtgggcggcggcagcgacgccaaccatattgccgcgctcggcattccgacgctggacggcttaggtccagtcggcgcgggctttcacagcccggcggaatggctggatatcgcttccatcgagccgcgtatcaggctgctgaagcggattgtgtcgatgctgtaaatggcgctggtgatggggactaccccatcaccgccgtacttaaccgacaggtgcagcagcgccgtccctgctcgtcaaagaccacaatttcccagctctggctttgccgcccgaggtgcagcggctggcaaacgccgcgcaccctgccctgcgataccgggcggtgatgcgtggcgttcagctccgtgcccaccacgcactgcccgtcgcgggtcatcagaaaaccggccatcgaacccagagtttccgccagcgccgccgacgcgccgccgtgcagcaggccgaacggctgatgagtgcgcgcatccaccggcatcaccgcttccagcacctcatccccgagacgggtatagacaatgcccagatgcgccaccatggtgttcgcgctggtggcattcagttcatcgagggataaatgacgtttccagatcatgcttatgctcccagcgtcgagccgccgtccaccaccagatcctgcaaggtgatgtgccctgccagatcggacgccagaaacagcacggtaccggcgatgtcctcaggtctggcgattttccccagcggaatgccgagcttgaactgctcgccgaaaccgcgaatgcgctgctgttccgcgtcctcgctggtccacagcgtacgctgcatgtcggtatccgtggagccgggggagacaagattacagcgcacgccgctggcggccagctccagcccgacggtcagggtcaggcttttcagcgccgctttcgacgcgccataagcgctcatccccatacgcggcgtgtgcgcggcgtcggaggcgacggtgacaatcgccccgcccttctgggcgcggaatattggcatggtctgctgaaagagattaaaggccccgccgacgttcaccgccatggtctgctgccagtcggcaaggctgagggcatcggtcgcgcccatgcgcaaaatcccggcggcgttcaccagcacgtccagccgtggggtatgcgccagcagacgctggcaggtgtctgccacctgtgtggcatcggcaatatccagccgcttgcaggtgaagggataatccgcctgcggaaagtccagatcgaagccggtcacctgcgcgcccgcatcggcaaaggccagcgcggtggcgtaaccgatgcctttaccggctccggtcacccacacggttttgccgctaaaatccagccccgccattatttcacctcgcgggagagcagcgcccaccaggcgtcgagagtcgggtttttcgccagcatcacgaaatcaatgtcgctgtagactttgcgccagcgggcggcgagcgccatcatgcgcaccgaatccagaccgtaatcgatcaggttgtcatcatccagcggcacgtcggattcatccagcagcggcaggatctgcgcacgcagcgcgtccttagtcagcggtaccggcagcagttcgtcggtcatcaccacgcggcctgaacgtccggccacgtagttgagcgccatcaggtgctcgtcgcggctgaaatccgccagcgcatcggcgaccataaacggcttgatgtcgcgcataaaggcatcggtggcggtggtcatgcagccgatgtgggcatacacgccggtgatcagcagctggttacgcccggtctctttcagcatctgctcaagcggcgagcggtgaaacgcgctgtagcgccacttcaccagcacggtgtcgtctgcgtcaggcgcaagggccgccaccacctgttgttcttccggtttgcgggtcaggcccggcccccacatgtcgttcagcagcgcgcgatcttcgtcgctctgctctttgggctgcgcggtgtaataaaccggaatgccctgctgtttgcagaactggcgcagcgcggcgatgttcgccaccacctgctccatcatcgggcagttatcgccccagaaattgatgaaatagtcctgcatatcgtggataagcaatgcggcgcgctcaggctcaaaggcccagttcactttgttgttcgggatctctgccgcggcgggcagcgcatagccggttaatttcgggatagccatctcttctccagtgttacgcctgtgacttttcagccagcatctgacgcagtttcttcttatcaactttgccgaccggggtcagcggcagcgcgtccacgcactccacgcgatccggcagcttaaattccgccacgccctgctcgcgcagaaaacgtcgtatctccaccggacgcaccggctggcgcaccaccagatacgcgcagcttttctcgcccagcaggctgtcttccatgctcaccagcgcggcgtggatcaccgccggatggcgcagcagcaggttttcaatctcttcggcagcgattttctctccgccgcggttaatctgatctttttcgcgcccctgcacggtgatatagccgtcggcgtcaatggagatcagatcgccggagctgtaaaaaccgttggcgtcgaaggcgctggcattgtgctccgggctgttaaagtagccgcggaaggtatagggcccgcgggtcatcaggcggcccacctccccggtcggcagcggattgccctgttcatcggcgacccacacttcatcgtccgggcacatcgggcggccctgggtgtggttcacccgcgccgggccatcatccaggcgggtatagttcaccagcccttccgccatgccgaacacctgctgtaactgacagccgatctccgccggaatacgcgcggcaagggtggcggacagacgcgcgccgcccacctgcaacagcttcagcgacgccagctgcgcattgctgccccactcggcaattgcctgcaaccacaggctgacggcgggcggtaccagcgcggtgacgttaatctgatgtttttcgatcagcgggaagcagagcgtggcgcttggatccgccgccagcaccacacagccttctgcgagaaatacccccagcgcgccgggggagctgagcggatagttatgggcggcaggcagcgcgcacagatagcgcgtgtcggcggtaaattcacagatctcgttgctgcggcggatactgtagtagtaatcgttatgagtgcgcgggatcagcttcggcgtgccggtactgccgccggatagctggaaaaacgccacttcatcggcaggggtcggcaacagaggcgtaccgtccgccgggcgttcaatggccgcctgtaaggcatgttcgccctggtcgttacgcaacagcaccacgcgcacgctggcatgttcggcgacaaagccattcaggaagctgtcatcctggaacagtttatgttcgcgatcggcgatcaccagcgccgggcggatctgcgcggcataggcgttgagttcactctgctgatggctgaagagcgcattgaccggcgcgacgcccattttcagcagcgcaaaaaaggtaatgtaaaactccgcgacgttgcccagctgcaccagcgcggtgtcgccatggcgaatgccctgcgccgtcagcgcgcaggcgaggttatccgacgcctgatccagctcgcggtagcttaacgcgcgctcgccttcaatcaccgccgtgcggtcagactgcccatgacgggtgagaatgtcggtcagcggcagatcctgccagtagcctttttcacgataacggcgggcgaagtcatccggccagcgggtaaaaggaagggtcatgatcgctccttaattcagaccaaaaacattaagcatggtggagagtttgacgccggtttcgcgccactccgccgccggggacgacgcaggcacaatgcccgccccggcaaacaggcgaacgttacgatcctggatgcgcgcgcagcgaatggtcaccacccactcgccattgccctgctcatcacaccagccgacgatgccgccgaacagctcgcggttgaacggctcaagttccgcgatgacgcgcttcgccacctgatgcgggaagccgctcagcgccggggtcgggtgcagcagacaggccagcgacagggcgttttcttcaccggcggcgagaccttcgaccggcgtcgccagatgccacagcgtcggggtattcaccagttgcggcgaggcggggatcgccagttcacggctgcgcggcgtgagcacggttttcatcgcctgcaccaccagatcgtgttcgtgacgatctttttccgaggccagcagtttgttaccggcctcgcgatccagcatgtcatccggctgacgacgggccgagcctgccagcggcagcgaactgaaccgctcatcttctttacgcagcagcagctccgggctggcaccgagcagcacgccgccatccggcagcggcacatggaagttaaagctcgccggattctgcgcgatcagccgttccagcagcgccccgctgtcaatccgggcgtcggtggcaatgtcaatcagtcgcgagagcaccaccttgtcaacggtcggcgtggcggtcaggcgtgcggcttccgccaccatcgccataaaggcgtcctgctccggaatggcctggcgcgaaaccacgttcggcgtcgggctgccctggaaatagcgcgcggaatgctgctttgccggacgggtgaacgtctgccaggactgcggaataaagagcgccgacggctgcgtggtatcaaacgggatcgcccctaccatcaccggttttgcaatgccctgggctttcgcctgcgcaaaggccgccgccagtttgcgctggaacgggctttgcaggtcatcgccgttaacggcaggctctgagaagcgcgcaaagcagccggatgtggtaaagctgcggtacggcgacataaagaaaaaccggtcgggcgacaacgcgtctgtacgctgcgcgatcccctctgccactgacgtatccatatctttctccgaaaatgataaaggcattaagaataattatcatttatattttggtcggtaagctaaaagttattgtcagcagtgtcaactctggttgatgcaacttctgcggctaacgcttgcatccgcttcgcacaatgatgaaaatgagaagcattaactgcaataaatacaggataccacgccgtgagatttgcttcgttacgcctgcatgctgtgctggcgctcagccttttcgttttaggactttccgcaagccacgccgccggatggccgcgtcaggtgactgacagccggggcactcataccctggaaagcaaaccgctgcgtattgtctccaccagcgtgacgcttaccggatcgctgctcgccattgatgcgccggtaatagccagcggcgcgaccacgccgaataaccgctttgccgacgatcagggctttctgcgccagtgggggcagatagcaaaacagcgtcaggtttcccggctctacattggcgaggccagcgcggaagccgtggcggcgcagatgcccgatttgatcctcgtcagcgccaccggcggcgactctgcgctggcgttgtacgatcagttctccgccatcgcgccgacgctggtcatcaattacgacgataaaagctggcaggcgctgctgacgcagctcggcgagatcaccggccaggagaaacaggcgcaggcgcgcatcgacgaattcaatacgcagctggcggcggtaaagcagaagatcaccctgccgccgcagccggtaagcgcgctggtttatcaccgggcggcgcacagcgccaatctgtggacccgcgattccgcgcaggggcagctgttagcccagcttggctttacgctcgccaccctgccggaggggctgaacgccagccagagccagggtaaacgccatgacatcgtgcagctgggcggcgaaaatctggcggcggggctgaacggcgaagcgctgtttttattcgccaatgacgacaacgacgccgcggccattgaagccaacccgctgttaagtcatctcagcgcggtgaaaaacaaacgcgtttacgcgctgggcagtgaaaccttccgcctcgacttttacagcgtgacgctgctgcttcagcggttcgccacgctgtttggctgatggaaacggcgtaactctttcagtagcaccaccagcagcagtccgatgaccgccagcacccagccgccaacactggcggaggccgctggcgtcatcagcgcccccataccgccgagcagtgccgcgccgatagcatcgccggtgacgttctgcgccgtccataagccgttaatgcgcccgagcatcgcctcgggggtttgcgtctggatcagcgtgtactgcaacagcgaactcaccgcgctcagccagccaaagagcgcgaggaacaacacccccagcccccagacgggcatcaggctgaacagcgccaccgccacaaaggcggcgacggtggtcaacagcatgatcgcccccggacgcgcacgctgcgccatattgccgctggtcagcgcccccagcgccgcaccgagcggaacggcggcatacaacaggccgatttccgacggcgacatttgccagttcaccgccagcgccggataaagcacgcgcacggcgctcgccatggtcagcagcccgccgagcagcgcgatgccgccgatcagcggactgcgcattaaaaactgaaaggccgccagcagggatttcagcggatgttcccgcggctgcggcggcggaggcagcaagggtaaacgcagcagcgtcagggtggtgagaaaggtccccgccgccgccagcccgtagttccacaccacaccgccggacgccagcagcaggccgccgcacagcggggagatcactgagcccaggcgtacggtcagcatggtgatcgcccccgcctgcatcagattctcacgcccgaccagcgcgggcgtcgccgccagcagcgccgtcacgccgagcgcgccaaaaaagccgtcccacaaaccgagcagataaatcgccaccagcgagggttccggcagcgccgcattaatggcaaggccgataaaacccagcccgcaggtgccgcgcgcgatcaggatcaggcgcttacgctcatagcgatccgccagcacgccgcccaccatcagcccgacaaacatcgccccgccggtcagggtgaccgcaaggcccaccagcgcgctggagtgggtcatcgcctggatctgcaccggcacgccgacgcccagcaaaccgagggataaaatggagataaaacgggcgataaataccgcgcggaatgccgggtgggttttcagcaggctcatgttgagcagccaggattgtcggttcattacagggccttttattgcgatttctcataccttttcaatggccgcacatgctaacatacccgaacaagatcgataacgataactactatcattatcaactcaaggacgttgtgatgtctttttcgctcagcctggcgcgtccaattatcgtgaccgggttattgttattgctgctccttgcggctgcgctcagcttacttatcggggcgaaacccctgcccttttccgccgtcatggacgccttcacgggcagctgccagaccgcggactgcactatcgtgctggatgcccgtctgccccgtaccctggccggactgctggctggcggcgcgctgggccttgccggggcgctgatgcaaaccctgacccgcaacccgctggccgatcccggtctgctcggcgtgaacgctggcgccagcttcgccatcgtgctgggcgcggcgctgctcggtttaacctctccctatgaacagctggcattggcctttagcggcgcgctggcggcgtcattagtggtggcctttaccggcagcgcgggcggcgggcagctcagcccggtgcggctgacgctggcgggcgtcgcgctgggcgcggtgctggaaggtttatccagcggcatcgcgctgctgaaccccgatgtttacgatcagctgcgcttctggcaggccggatcgctggacgtgcggcagatccacaccctgaaaatcgtcctgctgccggtactgatcgccgcaggcatcacgctgctgcaaagccgggcgctgaacagtctcagtctcggcacggataccgccacggcgctcggtagccgcgtggcgcgcacgcagttgctgggcttactggcaattaccgtgctgtgcggcagcgccacggcggtggtcggcccgattgcctttatcggcctgatgatgccgcacatggcgcgctggctggtgggggcggatcaccgctggtcgctgccggtcacgctgatcgccacccctgccctgctgctgtttgccgatgttattggccgtctgctggtgcccggcgagctgcgggtatcggtggtcagcgcctttatcggcgcgcctgtgcttatctggctggttcgccgccatcgtcgcggaggtggctggtgaacgccccttcccgtcgtctgattttgagctgtctgctgctggcgatcgcctgtctgctggtggcgctatggagtctgcaaagcggcgcggtgccgctgacgttttctcaggtatttgccgccctcaccggcgatgcgccgcgcggtattatgctggtggtcaatgagtggcgtctgccacgtgtcgtcatcgccctgctgaccggcgcggcgctggggatcagcggggccattttccagtcgctgatgcgtaacccgctcggcagcccggacgtgatgggctttaacaccggggcatggagcggcgtgctgatcgccatggtatttttcggccagcatctgacggccattgcgctggcggcgatggcgggcggtattctcacctcgctggtggtctggctgctggcgtggcgcaacggcattgaaaccttccggctgattattatcggcatcggcgtgcgcgccatgctggtggccttcaatacctggctgctgttgcaggcgtcccttgagacggcctttaccgccgggctgtggaacgccggatcgctcaatggcctgacgtgggcgaaaaccctgcccgccgcgccggtactgctggtgatgtttgtctgcgccgcgctgctggtacgccgtatgcggctactggaaatgggcgatgacagcgcctgtgcgctgggggtcagcgttgagcgttcccgcctgctgatgatgctggtggcggtggtgctgaccgccgcctccaccgccctgaccggcccgatctcttttattgcgctggtcgccccgcacatcgcgcggcgtatcagcggcaccgcgcgctgggggctgacccaggcggcactgtgcggcgcattgctgttgctggccgccgatctctgcgcccagcggctgtttgtaccctatcaacttccggtcggcgtggtgaccgtgagcctgggcgggatttatctcatcgccctgttaattaaggagtcccgcaaaagatgactttctcagatgcccgtttgcgcggcgaggccttaaccctcggctatggcaaaaaaatcgttgccgaaaacctgaacgtcactctgcccgacgggcatttcaccgccattatcggccccaacggctgcggaaaatcgacgctgctgcgcaccttaagccgcctgatgaccccggcgcaggggcatgtttatctcgacggcgagcagatccagcgtttcaacagtaaagaggtggcccgccgcattggactactggcgcagaacgccaccacgccgggggatattacggttcaggagctggtggtgcgcgggcgctatccgcatcagccgctgtttacccgctggcgggcagaggatgacgcggcggtgcaacgagcgatggaggccaccggcgttacggcgctggccgggcagagcgtggacacgctttccggcgggcagcgtcagcgggcgtggatcgctatggtgctggcgcaggaaacggcgatcatgctgctggatgagccgaccacctggctggacatcagctatcagattgacgtgctggagctgttaagcgagctgaaccgcgagcagggctatacgctggccgccgtgctgcacgatctcaatcaggcctgtcgctatgccacgcatctgattgcgctgcgggacgggaagattgtggcgcagggcgcgccgaaagagattgtgacggcggatctgatcgagaaaatttacgggatgcgttgcgtgattattgaggatccggtggcccatacgccgctggtggtgccgctcgggcgcgggctacggtaggtttgctgcgcccggcggcgctgcgcttgcacgggcctacagtagcctcattccgtaggcccggtaagcgcagcgccaccgggcaaaaacttagtgagaaggttccagcgtcagttccggcgtcagcgtgcg

(The sequence listing continues in the following parts.)

We claim:

1. A method of improving growth of a seedling, seed or plant under abiotic stress conditions comprising:
   coating the seed or root of the plant with an effective amount of *Enterobacter* sp. SA187 to provide the plant with resistance to abiotic stress and/or
   growing the seedling, seed or plant in a plant substrate, wherein the plant substrate comprises an effective amount of SA187 to colonize the seed or a root of the plant to provide abiotic stress resistance to the seed or plant.

2. The method of claim 1, comprising inoculating the plant's rhizosphere with SA187.

3. The method of claim 1, wherein the plant substrate is selected from the group consisting of soil, peat, compost, vermiculite, perlite, sand, clay and combinations thereof.

4. The method of claim 1, wherein the abiotic conditions are selected from the group consisting of drought, high heat and high salt conditions.

5. The method of claim 1, further comprising contacting the plant with one or more additional plant growth-promoting bacteria.

6. The method of claim 1, comprising coating the seed or root of the plant with an effective amount of *Enterobacter* sp. SA187 to provide the plant with resistance to abiotic stress.

7. A method of improving growth of a seedling, seed or plant under abiotic stress conditions comprising, comprising growing the seedling, seed or plant in a plant substrate, wherein the plant substrate comprises an effective amount of *Enterobacter* sp. SA187 to colonize the seed or a root of the plant to provide abiotic stress resistance to the seed or plant.

8. The method of claim 7, wherein the plant substrate is selected from the group consisting of selected from a group consisting of soil, peat, compost, vermiculite, perlite, sand, clay and combinations thereof.

9. The method of claim 7, wherein the plant is selected from the group consisting of rice plant, maize, barley, lettuce, groundnuts, tomato, wheat, asparagus, chickpea, beans, and potato plant.

10. The method of claim 7, wherein the plant is *Nicotina tabacum, Avena sativa* or *Vitis vinifera*.

11. The method of claim 6, comprising coating the seed with a seed coating composition comprising SA187 at a concentration between $10^6$/ml to $10^9$/ml of seed coating composition.

* * * * *